United States Patent 9,487,797 (GENOMIC PLANT SEQUENCES AND USES THEREOF) - sequence listing, part 106

SEQ ID NO: 99825 - DNA, 698 bp, Oryza sativa
attcctgcagccccgagccgctggaggctgccctcgcacgccgcccgcacgtacgccgggtccccgcggatccccaccttaccgtcggcgagaaatttaccgaacttggtggccagtgcaacattgtcgcgcacactgccgacctgtagcgcctgccttttttccaacccatatgcaaacaagcattccgtcatattttaatatatgacgctgttgactttttatcaacatttgatcattcattttattcaaatttttatgtaaatataaaaatatttatgtaatgcttaaagaacatttgatgataaatcaagtcaaaataaaataaataataatcacataaatttttttaaataaaatgaatagttaaattttggttaaaatgtcaacaacgtcataatacataaaaatatggaggggaagtaacatttaatatattctgataatatatttgttttgtgttaagaaatattactacatttatctgtagacttaatttaactttaaaattataagaaaacgaatcaaaatcgatttattgtattaaactgaagcaatacaatattcttagttcttacacaagtactcctccccgttttttttgacaaattgacccttttcaaaaacttatttcgaaactaacccctgtaaaaacttcaaccaaaaataggccgtcgactcagcgccaagcgcattgg

SEQ ID NO: 99826 - DNA, 685 bp, Oryza sativa
gtactgtgtagtgtaatatagtgtgtcatttgtcattgttagagagcttcatagtatgcatccatacagctgtacacttggttgccttggtatgcatataccataactgcatttggttaatcattctaggttgcagaggttgttcacactttacacatgcttgtctgtagctactaattatttgtagggatgcaacttctcaaagctaatatatctaatgccaggaaaaccttgagaacttaataaatccaactgttatgttgaataatctaaaataccatgtttgcgacaaagatatgcggtttgctaaaaactagtctaaattggtaaagctccaagcctccagccaaatcgccaattctgtattaactgaagatacctgccagtctacttcatcctccagaaccagcaaacaagtaatctcaccccatgatggcaagtaatcttgaaaagatgcaatttatgccattcgtttcaacatggtggtagatcttaaggtattcttctggattatagccattgttaatgtgacatcctggcccaattaggatttggcctgtgtgccctataagagctgtgtttgcatgtttagtaccacattgctaatttagcaaggtggaaccaatttataagggtttgtccctccaaccacatcactcttgggttaacccatttacacgaagtg

SEQ ID NO: 99827 - DNA, 522 bp, Oryza sativa
tttttacaacttgtagaagttgaatttaaactttgatatatttcatattagtctatgttgccaatttttttttcatattttttgatgactatttaggtgatatgcacgaaacgagaggatatcgggatgatttcactttcccctgaaaccgaagcattaaaatccacatcttgcagtatatatatatgattcaaaccaaagaaaagtgtactcagcttcagctatgtgtaagactggaggatagtgattattggttgagtagtggagttaagtggaaaaattgaatggtggggggttgtgattggttagggattagtggagaagttgttatattttgggacaaatcttgagagctaaaagttgttatattttgggacggagggagtacttgcgtttttttatttcagaaacaaatacaccatgttttgaaagctatatatatttctcaataaggaccggatttgaaaatggcaagaaaaaggataattaattcaaatgctatcgacatagttaaagctctat

SEQ ID NO: 99828 - DNA, 560 bp, Oryza sativa
aaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggctttacaatttttacgtaattgtataaaagttttaaataaaatagcagttaaatgaatgaacaacagtcaaactgaagggagtatatcacagtc

SEQ ID NO: 99829 - DNA, 599 bp, Oryza sativa
attccatatctcaaacgggcctcaagttgtggcccgtcacaaatgaccatcatctgtgacgtgcaccaacttgaggcccgtttgagataacaattaggcccgtcacagatgactcatcagtgacgggctatatacttaatctctatcgggcattaactaaagcccgtcaccgaagactatttttccatttttcatatgaaatgtttatatttataagttgactatagcaaaaataattttacaggtagtaaatgatttcaaatggaaaaaatgtcaacaacaaagttgtataacttatcaatatttacaacttttagtttggtcatttttcaatataacatttttttgagcagtttgaatttgaatttaaaaatatgacaacttcaaacaacattttcaaatactaaatgatttcaattgaaaaagtcatcaacaacaaagttgaataactcatcaagatctaaaacttttattttttttatttcttcatctgacgaaatgttagtaatattattcacaaattttacatatatgtgttatagtttataaaaccagataagagatatgtcaattttgtgaacaatgttactatcactttg

SEQ ID NO: 99830 - DNA, 558 bp, Oryza sativa
atcagctgagtgtttgcgccagtcgggattcaattatcacatctactttggtattctttatgagggataattacgcttgatctacatcatgcatgatattcatcacttggagtcatattaattggtgtgttctatacgtcatattttaagggtatcggtatacataatttaggtctaggcctaatacgtctgcagctcatattttcaggtgtggcctgtcacgttcttttagggacttaggcatttttttttgcttaggcaaaggtgcgggagattaagtgcccaataccttaaaatccttttataccgcagttactcaactttttaggagttggtacaatgcattttaaaaggtgtcgaacagtgaagctttatatagctgccccgttgactttttattagtcaaggcactgtttggttttataaagcaattgattggatacaatatcggtgttttttttgccatgtaagtgtgcatttttattgaccaatattatggcttaagctgattatatattatggtacgtcattttccaggcggttggtaaatcctttatg

SEQ ID NO: 99831 - DNA, 524 bp, Oryza sativa
gatcgaaattcagttgaaatttatcgaaaaccgatcaaaatttatcaaaaatcgtcgatattgatggggctcaaaatttagtggtaaactggtgatgtaaaccgtggtctgaactcgtggttgtttcagtatcactcacgcaactggacgccctgaaactgaaactgaaacttaagaagacttattcagtcgcttcgctttgtggatgatcattttgatagctgccgctagctagcgagtctcttacaaaaagatttactgatggtgttgattggccggccgttgggcgaattcgtcatgtgcctcgcgggggcagcatcattggagctgaattataactagtctccacggcgtgaagctcaaaagagatactaccatgtagctgcatcatcatttttcacggtgcgtgctgatcttcatttgcccaacggttagcttacagatgatcaatactacaattaacttcccagattgaggtacagtgcagaattcacgacacgatcaggcttgaaactcagtgatat

SEQ ID NO: 99832 - DNA, 550 bp, Oryza sativa
aatatcatgtacaaagagatattggcctgattttttccctatataattgtacgatgtgaccatatgcctatggttagtgcaggatgccacaaaacaatgcaccatgaaaggtcaacctataaaaaaatcagtgtgctacttgtccgcttgcacatgttctatttgtgcatgcacaggaataattagttactgctttggtgtacataagatgattgttttttgctacctccttcagtgttcctaattggcttcatggcgatacaaatgagaagaataaagtgttgattcaagctggaagataatttattatttcatagataatattgatgtttagtacaaaaggcacacaattcaacttgatcgcaaccgcttgctgcagtatgatgccatgattgcttacattacgaggcctatgtatggactgtcaggttcatggtcttcaatcagtgatatatttgttgaactgcatgtgtaacacctagcttttataggttccatggctttgcatatgcttttgtagcatttatgggatgatgagggccttcatttg

SEQ ID NO: 99833 - DNA, 1049 bp, Oryza sativa
ctgccgaagataattaaaaagctggccttattggtattttccctcagcagaatattatcatttggactgtaatgttcgtcttagtggctaatgtggagaatatggtaaccgggtacccacatggcctccatctatagtacagatctatggatctgcggccccgtctaatatgcttacaaatagcggccggtcccaaggaagtcttctaattcgggccgacaagtgcgtcaccgattcagggccgatcagatatctcaaacgggcctcaagttgtgggcccgtcacaaatgaccatcatctgtgacgtgcaccaacttgaggcccgtttgagataacaattaggcccgtcacagatgactcatcagtgacgggctatatacttaatctctatcgggcattaactaaagcccgtcaccgaagactatttttccatttttcatatgaaatgtttatatttataagttgactatagcaaaaataattttacaggtagtaaatgatttcaaatggaaaaaatgtcaacaacaaagttgtataacttatcaatatttacaacttttagtttggtcatttttcaatataacatttttttgagcagtttgaatttgaatttaaaaatatgacaacttcaaacaacattttcaaatactaaatgatttcaattgaaaaagtcatcaacaacaaagttgaataactcatcaagatctaaaacttttatttttatggttttagtttgtaattaattaaccaatcacgattagccattgttagctaccagatgaatttctcttgactttccagttattaaacaagtgttatttttaaacttggctctattgttttcaaccgtacttaagacatgatattaaatatctacttgaaccatatattaagtccaagcttgtcaaattgtacaccattggaaaataaaataattttcgccataattctcggttgaggacttgatctctattcaattcgaaacagatggcaattttaattaatatacgtttcaaatttcgtaaaacgctaaagaaattgtttttgcg

SEQ ID NO: 99834 - DNA, 637 bp, Oryza sativa
atgtccgttcgcaatcatgtcgggtgatcaagccgacgacgttagcgaggaattatccgttaacaaccttttctcgagtagtccagccatggctggtgctatgagataggtcgtcggtctttgttggtaggttgggtgcgataactccgcatttgtcgagaatattctcgataatggagtgtactcgaccacaacctactcgagtgctcaattgttcctgaaaaatattttttagaaagcaagatatatagcagatgatatcgagtatgtactcaaaaactgcgtggatcttctagtattatcaggagcatccagtttaatttgtctggcgagatcaaactatcaagcaacagatccattcccaagaatcggcgtcttttctcatcaacatcaaaactcctggcgatatccaatttttagcgtgtttgcttgaatcggagtcgacgtggaatcagccgacccaattgattgagcaattatcttgaagtgttgcactgtcccgtatgcatgtatggctcgtgcatgtacatgtatgcatactcgccaagaagtcatcaccgagcaacaggagcgctcaaacaaatatgcatgcattggttgatatgctacaagagttataatataatcctgcaacgat

SEQ ID NO: 99835 - DNA, 544 bp, Oryza sativa
gaaaaagtgaaaaaaacacaaatatacatattttttcaataatttacgtttatatacctgcacgagatttgcaaaaatatacccgcttcgaggaacggaaacgtgggaccgcgatggtcccgcagttctaaaacacgggaccgatgtcccacggaacggtcgcgcgggaccgcgatggtcccaaaacgcgggagcgaactggccagcgatttatttactgagtcggcactgtttgacaatgtttcgggtactgtttgccactttacatcactgtttagacctgtttatggccagttccgcacattgaacctgcggtaccgccttacaaaactgtgtcaaacagggctacacagtgtccatagtgctaaacaacgttaaaaatcactggctgcctcgctcccgaattttgaacttgcgggaccgtcgaggtcccgcgcaaccgttttgtaggatcgtcggtcatgcgttttggagcggtcacgcgttttagagctgcgggaccatcacaggcccgcgtttccgtcccgatatttttgcaaatcgt

SEQ ID NO: 99836 - DNA, 650 bp, Oryza sativa
aaagttctatgagatccttacaatatttcctcaaatatggcctagtcaatttttttttatatttcctttattatgaacattcacaaatgtcaagttgcataacacatcaaaacatacagtgggaacttgacataagtgaacaatgatattaccaaaatatggaccttacaaatttaatgaaaaaattgttgggatcatatataactttagttcacctcaatcgcacttcaaatgaacactacataaatctttaaggttttaatatgtgttacaagtttaagagagtttaaattagaagatcaacgtctatttcatagtaattaacaaagtgcttcatatgtaagatggtaataagtaagatacacgtgaagggagagatcccggatttgaatcctacatactagatgcatattttgtgtgaaaaaattgcgaacttgtgacaattaaaatatgaaatactttttgcgcctacaataattaaagacttgaaagtcgaacttaaaatacaaaaaaatagatttgttaacatgcagttgtgcaatccactaacacaaaactgtcgatttctataggccctatgtaacatttgggttggctaaacacttcccaaaatgggggtacccaatatattggaactgcctataaaagta

SEQ ID NO: 99837 - DNA, 647 bp, Oryza sativa
aaagaatggaggaagagcaaaatattttgcgcaaatacacaaaattgttaaattcacatcaagtaattttaagctcgatttttttaggccagattaaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgacaaaaaaagcatgcgttttttcgtcatcg

SEQ ID NO: 99838 - DNA, 613 bp, Oryza sativa
ctgctagctagattgatatggcagataattccatttaagctattgggctaaagaatatatgaatttcataaatagtatagaacattaaagcatgataatagcagccatatgattaatcagttatttatatccttggaattgttagactgacagttacttacatgtattcaatattatgctgtttgtagtatcctcatgaaccacaactttttaagcatatagcaggatcttattgatcagcttacaatattgtgtgtctcctataccttgatatatttttaccataatctgtagtattctcaaggcaagtaaagaggagaaaatagatagagataaaaatgcattgaaaagggataagatatctgcattcattgtctcatctagcttggaatattgctgccggaggacatgtagtaccataactttgaacttatagtggtgaataaaagattcttggtgatgtgaattggcatgtacgtgtattgggtatataacttacaggattgaagtttgcttaaaatttgatgctgaattgttgtgcatgcctatctgtagccttatcacttatgttcaggtaaaaaaaaaaagtcatttgcaaattttgttgaaaaag

SEQ ID NO: 99839 - DNA, 777 bp, Oryza sativa
acgatgctgatggcggctgcgatgaagatgacgagtgaccgcctccatcgacggcgccaccaacttctacgcccacaaacctaggatccgcccacgtcgtcttccaacgcccacccaacagccgctgctggatccggcctccacggggttatggtatgtggatccggctaccgccgcctccatcccccaaccgccggtgtccacgccctctccccccgaccaccggcgtcctccaccgtctccttcacccacgagcgccaccgtcatttctgactcttgtaggttgtgcttgatttttcttatcttgcaaatgttcattgccaaattttagattgggccatattctgtgttgtttgtgtggatatctagtttgttaagatgcagatcattactagtgtgatgtatattgtaactcaagttgtgtgatgtatattgtttctctgatgttatcagatctgccaatgaaatgcaaagttattgtcttgcatcttgagatgaatcttgcatcttttgcttcatgtcgtgagctgagggctgagggcttttgaattttttttggatgaattttcacacctgtgacgggtgataaattagacctgtcagaggtgtatgtcacctttgatgggctagaaagagtcacccattacaagtgattctctcctgtgacgggctatttctatgcggcccgtcaaaggagttaatcaccactgacggcttttcacccatcacaggtgaggtgcacacatcagtgaccactaatctctgacaagggctaaa

SEQ ID NO: 99840 - DNA, 2158 bp, Oryza sativa
  unsure (1)..(2158): unsure at all n locations
aaagggaaaaatacttgggccgccaagtgcaacaagngaaaaagggggaatcgcacttgtcaagaaagaaggggacgaattgttggggaggggagcctggcgcaaggggaaaaagaggagagggatttggaagtagaaataggattgaaggaattttcaaaaatagaaaagaaaaacgggtgtcgttttagcaaaagaacatgaacggtaccggaaacaaaaaagattcggtttgtcatgcaaaacaaaactgagaacggacaaaggggaatgaaccgggcatggttcatgaccaaacccggcggagagggaaaactattaattcaactcttgccacttttaaacttactgattattatttcctttgctctgatcgttctgctttaaatcctgttaatgatttaaacgcaaagagtattcgggaaaaattctctctgactttttcggttattagatgcattgataattaaggtttcctcatgattaacgaagtaatttccattaataatttattggtgattttgaaacctaagtaaaggaaaactccggacgtgacataggtgttcctcataacttgtcagcatgagctgaatcagaggaacgtaaaatatcccttatcctaaagttgcatcaatatagaacattatgctatacctcacctatatacatggcaaggtcttcctaaaaaaatactccctccttccctaaatgtttgacaccgttgacttttttaaatatgttagaccgttcgtcttatttaaaaacttttatgaaatgtgtaaaactatatgtatacatgaaagtatatttaacaatacatcaaatgatacgaaaagaattaataattacttaaattttttgaataagacgaacagtcaaatattttttaaaaagtcaacggcgtcaaacattttgggatggagagagtatatggcaaggtctcctaccatggcctcttgatttctctgcaacgcacattcttctaggtttgaaataaagcaaattctaacattattggttccattcttaaaacattggaactcatgaaaaatcatgctccaattgagaaattaaggcagaaacttgatctttaatcatctcatcacagcacaccaaggaaagtacttcacggaaaaaaaaaagaagaaattttggcctctgcttgtgcctcagcccctcagtcttgcggcgatcaatctcgcagacccgatgccatgccccatatccttcaaatccaactcaaaaaaagtcatgccttgattgaagaagaccagttaaacatagaatctttaattcattcctctcacgcacaaagggaaggactatagcaaaaggaaaaagaatgggctgtttagttggtgaaataaaaatttttggtgtcacatcggatgtttgatcggatgtcggaaggggttttcggacacgaatggaaaaaactaatttcataacttgactggaaaccgtgagataaatcttttgagcctaattaatccatcattagtacatatgggttactgtagcacttatggctaatcatggactaattacgcttgaaagattcgtctcacgatttacatgcaaactgtgtaattagttttttttatctatatttaatgctccatacatatgttcaaagattcgatatgatgtttttggaaaaagttttgaggaactgaacagccctgaagaaattctcacggttgctcgtgcttgcgttggcgattggtggagtgcgagttgagggtgcccgcgttagtgccaggcagcttccgagttgggcgtcagtcatggcccaatagcagatcgaagcgtagcctccttctgctgtacacctcgcgcaactactccctccgtcacaaaaaaaagacaaaccctgggttttaaaatntttaatggggacttaaaaactgttctaaggtgtttctatatctttttaccgtgcttttagaggcttataaggcgtctcataccgttttaatgtcgctttaaatttgtttaaccgctgtatatagctctggtatattacaacataacacggcgcatataaacatttacaatactgtttcaatttgacggtgttcacatcaagttctaataagcttacttcacttacggtgtaaaataaggcggatttatatccgtttttatatagacactt

SEQ ID NO: 99841 - DNA, 654 bp, Oryza sativa
tacatatatatatttatatatgtacgtacatttactttagtgttaatatatgttttggtaacatatatgcacataaaatgttaagtgctttaaattataaatatgtgtgtaatatatgtatttatacatatacacatacgcacatacatatatatatatatatatatatatatatatatctatatatatgtatatatatatatatatatatatatatatgtatatatatatatatatatatatatatatatatatatatatatatatatatatatatatatatatatataatcaaccatgcagcaaacagggccatgcaaataaaaaaaatggtacacagatctttagtcccggttggtaacaccaaccggaactaaagatggatcagccggccacgtggctgaccgatctttagtcccggttctgttactaaccgggactaaatatcgatctttagtcccggttatttcacccgagactaaagatcgctatctttaatcccgaattcgtagtcccggttggacaactaggactaaaggggggttacgaaccgggactacaaacggtttctccaccagtgtcagtattctaaattcacgaaaaagagacatgttaagacacaaggacaccaatcagtttgataaaacggcttgt

SEQ ID NO: 99842 - DNA, 873 bp, Oryza sativa
gagtatttttagagtattttttatataaaatttattacctcaataataggatataccaaatttgcaataaaaaaaattggtacctattcgtacctcttaagtactactacctccgtctacctccgtttcaggttataagacgttttgactttggttaaagttaaactgttttaagtttaaccaagtttgtaaaaaaaagtaatatttttaaccaaagacaaatttattatgaaaatatatttaattattgatttgatgaaactaatttagtattataaatattattatatttgtctgtaaacttagttaaatttaaaacagtttgactttgatccaagttaaaatattttataacctgaaatggagtacaaaatttctattgcctgatggcttccccttcctgctagcctcttcgttgtgtttccgtgaaagttgaaactccaaacaatcgacaaggtccgcaatcagcactaaatttaaatttttaaaacttaattttgatatattttcatcgaatttaaatttagaacttgacgttgatgtatttttaatctaagtgttttcagcattaccattaatcattaagaacatatatatatgaaagttactcacaaattattatttttcctaataagccatacagtttataatcagcctacgctgcttagataagtaagtaatcttcgtttctatattaacaaactatatttaggctgcgtttgagcgcagcagaaagagagaaagatagttttgtttttcacgcgtacgcttcccgaactactaaatggtgtgttttttgcaaaaaaaatttctatagaaaagttgctttacaaaatcatattaatccatttttgaagtaaaaaataattaata

SEQ ID NO: 99843 - DNA, 645 bp, Oryza sativa
aaataagtttttttaggtaagtttttaaaaaggattaaaatgtaaaaaaaatccagcctcacgcaggataccgtggtgcagcccattggatcaacatcactgaacttacaagccactagcctttccggccgccatctagcatttttaatggaaaagacaggaaccaatacttgtatataataaaatagtagtatagtagcggagcgagaatcctaatgagcgattgctcgcgtgagggagtggatagcgatcggttggtgggcctctctttccagttcccacgttgctttctttttttttcaccgcattgcttttctattttagtaagtttatacattttaagtttacacatctaaagtttttactgttaaagtttatatatgtttatatatataaagtttatactatgaaaatttatatactcgatttaaatttgaattcaaattttaatatattttaagcgatcagttggtgggcctctcttcccagttcccacgttgctttcttttttttttgccaccgtattaatttcctattttagtaagtttatacattttaagtttacacatctaaaatttttgtgcggttaaagtttatactatgaaagtttatatactcgatttaaatttgaaatcaaaatttaaa

SEQ ID NO: 99844 - DNA, 652 bp, Oryza sativa
  unsure (1)..(652): unsure at all n locations
ccgctttccttttgtaatgcagttgtgagctcgggatttgtccgcagcccagcatgactgtacatctactctataataaagagacctctgttgctgtgatattctgtctcactgtgatactagcactgtttcctgggactggtatcgattaacaggttaatttggagcgtcacggactagttccggtcgggactagttcggggcgtgacaccctcctccccatcccttgctcctatgtcctcccccgcgcggttttgctgccctggcatggaggttgaggtccacgtcgatgggcttcagaaatttgcggaccaaccgcccccgcgccatgctcaatgcctcaataccagcaactctttggaacctcagcaagtaatctcacgttcctcaactcgtgcgcatgctcgccttttctttttcttatggcacattctgctagttgtttcgttgcaacagacgtaaatcaaggaggaggattggaggaaacgaacagtagcagctcaatcgatcggagtaatgcaactctgctgattatttactcatatctcatcttctcttccgttcccacgctagcttgcacacatgttagtatgttacgcgttcaagggagacgacgagcgacagcgagtggnccgtggccatggccgactag

SEQ ID NO: 99845 - DNA, 760 bp, Oryza sativa
  unsure (1)..(760): unsure at all n locations
agggtacggaacgactctgcntgggcaannnnccanctnggnaccctncatccctgtacgtgtggataccggtagaggcgccactggtttgcggtgctgatcggcgggggagtacggcgaggagaacgcacgaggaggggaaggtcgagccggtgcgatcgactactttctctacatcgacgcgctctacttcgcgagaattccttcgacttcttagcaccttgtttcgctgcgcagcgcgtcgagtggtaacgatctatgatctaatacttgcatggttcctggtttacgcgatagaaaattttgatttatgctatcgtagcctacgtgtatcccaacagtggtatcagagcccccttgtatagtttatgatctagatcattgcatatagttgatatgcgggtgtagtagatgagatctattatgttgtatataagtttttaggtgatcggagcatgagatgaaccgatagctgcatgggttgatgagatcaatcggtaagtgtgttggtgacttcactggaatgtctagtactcaccaaggccgagcgtgattgtgttcatcggatagtccaatgtccactggaaccgcacgccaatgacaaaaaggagccaatgagattgacttggtttcggcataatttgattacgcccgtaaaggtttcacatggcgaatcatagatgaaatctatgtaccctgtgaaactttcagggcgctgccctgaaacccgcgggaccgccgtgtgcattgcccctgagat

SEQ ID NO: 99846 - DNA, 754 bp, Oryza sativa
  unsure (1)..(754): unsure at all n locations
atgcgttatagatgcaancctagnaggtcactggagcnncncccctnngctcttgtttttgtgaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtccactgtctcaatttcctggatctctaccgtgtgctatcgttttttaatagattaaaagtttacttcagccgacgcgacctttcgtagtttcctctagaaatatccgaatgatcattatgcacaatgtggagtaacaaaaattatatgatacttcctctgataatccgacaagatccgtttccgtttcactggattcctaaacctccaccgcccctagggccgccgcctctgctggagtcctctaccatcgctgacggtatcggcctcccccctcaccgagaaccttgcaccagcgctcaagccaccgccgatcctaggggcacagtccccgccgtcgaggaagtcttcttcccgaactaccaggctaccgccggcaggggccgctgcgtacgggacccacctccgtcggatctgccatctcgtagctgaggattgtttgtgacccttagctgtcgttgccaacgt

SEQ ID NO: 99847 - DNA, 761 bp, Oryza sativa
  unsure (1)..(761): unsure at all n locations
agagcgtgatttgannttcgtaaaaacgnctngcaanangccgaattcnagctcggtaccccaaaagtttgccgcaaagacttatggtatcttagagtttgttagagataagagtcgtatccggtatggacatagtttgtaattttcgggtataaatagaccccgaaccccatgtaatcaattaacgcacacgttcaatacaatttcggcgcatcgccacccttttgctttagttttatttcgacgagttcttgctttcgggttgagctgcatcggtttcgatcttcgacagaggtaaaacttgttatgacggcttgtgttctcgggattagtgcttccatctttatgatactctaatcttgtttatgtaatccatcgagttatcatataacttacataatctttggcaatatcgctatctaacctacaatcggctaacatctgttggaagagggtagccggttaggttagacaatgacgttgatttagattatataggatatctaccactctatgaaacttccagtggcttgattgtctagatattgttcttcttttcatacttaatgctgcatcagttgagttttatctattaagtcgtgcttagaatatcaatctctatcctgcttcctggttgccaattagggtggtgtcggagtttcagccaatcttatctgatttaactatatttgctctatatacttcgttgacatgttaaatctgcccttatgtaaagatattatcgcatctaagcatattag

SEQ ID NO: 99848 - DNA, 758 bp, Oryza sativa
  unsure (1)..(758): unsure at all n locations
ctgggatgagatgcaatncncatggccgaanccgagctcggtacccttcatatatataacccactaaactttaaatggaagttcatccaacacctctaaattaaaaccagataaccaacccttaaacttaataacaccgttcatattacccctatcttctcctctaactaatgagattttggacagttaaccgtgtcatatattaaaaacaaaggtagtatatttttatttgaaaaatagatgtagttcgtactaaataatttaccttttttatgtataagtgcactttgtgaatcaaaccgcctgtctacaaattactccctaacatattatttggatatttagttttccataatatgcattacttgattttttttctcaacttccaagtttaagttatactcagcatgtaactaccgaataaatatacacttggacttttcaacttgcctttgtctattcagcaataatttaattacatggaaatactatatataccaagttgttggtaaactaaaagtcactagtcgtgtgtacaaaatattctctttttctagcaagtacaattggcatagaccctaatcacatcactctgatcacactagcagtccagcacaagcattcacacgtgtgcatccttaatatgtacacgcttgaaatattgtcaagggcttagtgtgtactcctaaaaacaccccatagcttagtcatgcacatatccactgaatgcgcangcgtgtgtactcctaaaatacatg

SEQ ID NO: 99849 - DNA, 705 bp, Oryza sativa
ttaggtcatgatacatctatcactgtacggagttaatagtttgggtatgggatagattggtccccatgccatctactcattctattcttttcttacagtggtgtgatgtgtctatgtgttatgcctgacacaccaacgtagtgatgtcttcacatgaaaagcaaagaaaataagtaagaaaaaactaaagtttgataagaaactaaatggatgcatatatttggcaactctaccaagaaatggtatggtttgaaatgacatcaatcttaacacgcccttatttttaacgggtgataagttacgacttataagagatgacttatacacccgtcacaaatgactcatcgacaggtgttcatccatcacagatgagattttgtcatcacaaaccacttaacatctctgacgaggacagtttaagcccgtcagtgatgacttggtccgtcgtattatttacttggtgcaaattgaggacatcttaaatgggcgcacaaaacatttaggctatagcaatacaaaaagcacgagttttgaatttgcgtaatatctacatgcatggttgataccctaattctgacactggtgatatttgatcatactgcatgctgagatttagtccttccctaagtccactatagtaatttaatttttacattgactctctttcttattaaattccgaccattccatgtttagatggtgctt

SEQ ID NO: 99850 - DNA, 765 bp, Oryza sativa
  unsure (1)..(765): unsure at all n locations
agggttttgaaatgagtaatgatngacacangccgaattcgagctcggtaccccttatgatcatgcttggggcatggtgtttcaataaataattgaaatcaaacttcagccacccaccattacccggatcaatgcacgagcattttgctaatagactttaaacaaacaaaagtagggtatctctcgttaattggacacctatattaattggacactctaagaaagctctcataaccaccgttgggtatctctcgttatcccagcctaaacaaaagtagggtatctctcattgacagaatttgaacctgtctcaaacacttgtctatgtacatccatccacttttagacttcgtgcgtagccctataaattattgccgatgtaaagcatcaatagggtcttagggttggaaggcaccaggaatatgacaagcccatttgtgttgtggttatatatatatatatatatatatatatatatatatatatatatatatatattcggattttttcggtcgtcacatatgtccttcatcgcgctttcctcatcgcgttttacggactaatttttcctcatccgattcatggcacacctcctctccaaatcccacatcccacatccaatccaacccaaaaacaaaatctcaatctcaatctcaatcccaatcccaatccaaatacaaatcggaatcatcacaaaatcctagagaaaacacttctaaaagatcacaagaacatatttcatcaacaacaacgataacacaagaa

SEQ ID NO: 99851 - DNA, 757 bp, Oryza sativa
acggtttgatgtcaatccctaacaccacaggccgaattccagctcggtacccagtagctaatgaatatataaactaagggcacctttgttatcatgcattttcctgaaaactgctatatctttactgttagagaaaaagagctagtggtggtggtggtgatggtaagtctgccataccaccaccatcaccatgggttctgtgcatacatgcacgtgtgtttcttttatctgaataattatatcatttgcacatgtggttcgtaataataggatcatttgtgaactgatgatcaatccgaagtctatatattgttcttgagttcagattttatatttatcctagatcgttgcaatgcatgagttggctagttcatttaataacctatttctcctctttctacttaaaatatgttaatttgattcaattaagcaactttcacatcttttccagtgactgaatggtgccctcaaccatttctcatataggtttggcatggatggagtaactttcattttgttgtgctgtttaatttgctactattccctgaacctttattccaactaatactccctccattccaaaatataaagcacagctacccttagcccaaagaccaagaaataattattatcaccttatagtttggattaatctaataaatgtaattcatgcacccaataaaattagagatcttgatggtggagaatttaaataataatattttagtagagaagatgggttagttaatggcatgct

SEQ ID NO: 99852 - DNA, 757 bp, Oryza sativa
  unsure (1)..(757): unsure at all n locations
aggctttgaatcagtnactganagtcnntggcgaannncagctcggnaccccagattctcagaagctgtggactgttttggcagcttctagcggaagcagcttttagaaaaagctgcagctgggacaagctcctccaaacagggccttagaggcataaatccttattttcatgtatgtaaggatatattcaaaaagatttttccttggttatccatagggcaaaagatagtctcaaaccccttaattatgttagaatagctagacaatctttgatttttttttacgtacatatgtaatttgtaatcttttttaaattttaatatatttgctcactgtaggagcctcttctaatttcttttttcaaaaaaacacaaagttgtgcatggactataggtgtactttgaacctgaaagcattcaacagagtctcgtatggtcggcagggatcagaaggcacatttgtagccaaagataattcagaagttacagaatttagtatatatgacttgtatcgttaaattttgtttgtacttaatttttaatttttttagagtgctcttctctgattatggtatctgaacataggaacatgattagcgcattgacaaaaagagcatgctaatatatgagtttggaatttggcttcgcgcctgttgataaaggccggagatgtaaaccattttcactatttatggctttccttagaaatttgaggcccatgtacgaaatgtaaaatgggatcctaaaattttcttag

SEQ ID NO: 99853 - DNA, 652 bp, Oryza sativa
ttctacgccaccgacctgctcttcatcaagcatcagcggcgtcggcgcacgcaggaggaggaggatggcgctactgttgatgatcatcatcttgttggtggcggggcgggggtgtcgttagggatgcaagtgggttgtcccgctacccgtataaaaacctgcttgctagtttatttctcgtatgatagtataaaatttagaagaaaaaatgaagtagaagtgggataagcgggaaaaaaaaagcccgctagcctaccccgcttgcatccctaggtgccgtcagtcacgtgaaaagaaggcggcggcagcggtggtgaggagcttaggatggtggtgaggcgccgtagccttgcggaggtcacggcttggttggaggagtacttcctcaaggccagcgtcaccggcgacgctgtgttgaaccacctcgaggccagcaacgacgggttcaagcgtaagacactagcaactctactacttaattcgcacattcacagagagcatgagttgcagaacagaaagttttcttgccactagtgaatgaattgaatttgctgcaagtggaccgcacagcatcttgggcgcactttgctgccttgtcgcgccatcggtgcgcacgaacgcgtcgacagcattcaatggcgagcagaagcat

SEQ ID NO: 99854 - DNA, 574 bp, Oryza sativa
gcgaatattttttttacctttgttggtcagaaaattgtaattgaacacaagattttatagatttcactgaccaaattgtcatcttaggataacctataaaattttgttctccattcgtaattgtttgttagttatatattgccaacatgtgccttgcacgtgcacgataactagtttcacactacaattgttgagtatagatagattttatttgcatcaatgggcctacattgatagttcaagatgaaataatgagtaattaaaaaaattactcaggacatttgtcataaacacctataaaaaaatgtattgtttaaaaatatatcacatttttttctcgcaaaaaaaagtcaggattttagccgttaatgactcaatctatgcttttgattgtgacatattttttaagtgtataagtaataaatgtaaggttgatttctaaagtacttattggattggtctcccaaccattaaactgttggtggtttacaaatactttctatacatatatatatatatatatatatatatatatatatatatatatatatatatatatatatatatatatatg

SEQ ID NO: 99855 - DNA, 623 bp, Oryza sativa
catcgagacagaaggcttggttaaagcgtgcaaaaagggtgcgtgtaaatcggttaagtcgggccagcagggtgatcagatcgacggaccagttagactgcagagtttggacggttagaccgggttcaacggacgtgtggttcgttacaggaacttgttaacagatccaaaagaaggacaagaaggttctacagatggatagtttgcaagtgtgaaggacgagtagactggtggcgacaggctggtcaggtcgcatataaaaatatctggcggaaacaagatatatctaggattcgacgaggagttgagatatatggagttaagccagaactgaagaaaagtcccgggcaacagcgggtcaaatatcgttgatggggtcgacaatactgtttggcagtacaggatatatccaggatatgcaggtcggcatgatggggatatatggaaatctgcgtcactgaagaggaagagcgaaggctatcgtggtaattcttcaagtgattcaaggaaacggtaaattttctcaatttatcatggagctcagtctacggatgcggaaaagcgtggatgttggatttattagctcggttcataagtcgacaaggaagaaagggttctcttca

SEQ ID NO: 99856 - DNA, 558 bp, Oryza sativa
tttgataggtcttttgaaagtttttacttggacttttatcacctgtgttgatttataaacctttggagtgcttctcactcgggtttttctttatatttctttggcacattaaagcagtcggcgggaggtttatcagatgctgcatatgcttggccttgggatatttggttaaaaaccactcgaatggacgttttgatgtactttgacaatatgtttagcttttagctactcacatagtcggaggctacacctaattaggtgcatctagtcgatgcacctaattatttactttcagcccttcacagtctttgattttggtactcgggagatcagtacgaaagaaattgaagcactcggattatcactttacgttccgagagaaggctgtttcgtcgactataaaagtctcaggggctactgtggagattatggataccctatacctacacggcatgtatagtccgactgggtatggggtgccatgtatggatagaatatctttaagaggactcgggttaagtaccaaacttgtatgtcaaggaaacacccgggatccta

SEQ ID NO: 99857 - DNA, 711 bp, Oryza sativa
  unsure (1)..(711): unsure at all n locations
gtggcccnttaattgcaattcgactcgtacccttcttctttttaacttctagttcattaattccattcaactcctggttgactgccaatgagttttgttgtctaaaaagacattgcccataataggtctcattgccaacttctattggttatatgagactctatgcgagtatccatggatatacaaggagatgcatttttcatatgcttcttctttctgcttaatgctttttgatgtgggcatgtactagcgttagtgtgcactccaactactggttttcttccttgatgggaagatgtggcacgcctgttctgaggtttcgtagcatttgccaggtgtcaacttgcctccacgatctacactccactactgcactaccacagcgagagcaatgaacgagtggaaggccactaggacctatagcaaaccgagcagttgcaccaacgaatgggattcaatgtcacgcccagaaattcccgaatagaattccaagcagaatgtgcatcaaaacccccgtccaggaccggccggggtacacaaacgacaaagttgacatacagatccacgtcttacaaacattataaaaggtcttacataaatgcagcggaaaattaaaagataaatggagctaagccttgacttgaactgcagcgggaacaacactccacaggcatcctcgacggcttggacgaagcctacttcttggagaag

SEQ ID NO: 99858 - DNA, 582 bp, Oryza sativa
  unsure (1)..(582): unsure at all n locations
caaattagtttcattgaatatattttgatagtatgtctcttntgtgttgaaatgttgatacatctttttataaacttaaaatgtttgactagaaaaaagtcaaagcatcttataacactcttttgtgtcgaaaatgttgctgaatcttttataaacttaaaatgtttgactagaaaaaaatcaaagcgtcttataacatgaaacggaaagaaatacataccccaaaagcccatgtatgtaaaaaaggaaaaaaactcttgggaaacgggggaaaaacattattaatatatcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatag

SEQ ID NO: 99859 - DNA, 766 bp, Oryza sativa
  unsure (1)..(766): unsure at all n locations
tggagttattttcgcggggtcggctgaaagattggccaatcaaatttcattgagattgtaagggggtgttatatgttatagcgattgatcatgacattagctaaaacggactattcataacaatattgaaatatgccagcagttctccaaatggctatttcctctttaatatctccagagcttctctgcaattgttttaacctctgctcgaaaactatcccgttgcgttccttccaaatgagccagcacaccatcatgaaaagcatatcgagcatgttcatgtagctcgctcgaaaacaagattgcgtttgctgtcaccattatgccacatagaagaccttgctgactaggtgggtcaaaggccacattgatccaatctcgtagcattgtccatactctgttggtgtacgacacttgatgaacatatggtcacaatcttccatctcagattggcacaacgaacagccatcctctcttgagaagattgttagccatcaagcatcatccttttacagccaaccacataaagaatctgaccctcgctagcactctaatcttccaaaatagttcaccataaggacatttcatcgtcgccataaagaataggttgtaagcagcgtagacaatgaactagccattacttgtcagcttccaaattattgaatcctccatcccctattggatgtgaacattctagagttcatcccaaaggggtaccgagctcgnattcggcntgtgntcatcaggaagctattatcaatgcgct

SEQ ID NO: 99860 - DNA, 686 bp, Oryza sativa
  unsure (1)..(686): unsure at all n locations
ctgcctgacatggcggcgatgaccctgtcaggaagttcagcgggaccatccttgactggtggctgctacattacttgagaaaaaatttccatgggtacatatactgctatgacagcatgggacccactaacctgcgatactcatatgcgacgttcaggggtacctgatggcacatatatcagatgtctacgatgagcctgatctgcagtcgcctgctcagttgaagaatctaaaagctgtcagacttagaagcctcgtgggaagtatgccatggaacatgatataactcatctgcatgatactgcaagatgaccaatgttacaatacataccggtgatgctgcatagacacagtgccttgagagatctatgctagtgccggacagatgtactctggaggcctaacgggacagctgctgatacactgacgtgacttaagagcaggcgtgctaagtttggcattctgaaacggaggtggtagttctccggccatcaatcatangctggtacgacatttacaagtgtacaactggcgacatgtataagattgcacgacagtgtgtatgtttaatgcacggataccgacatgttatggcatattgcctgacacgtaggtcatgggtgacactctatcttcagaagtcttctcagaaagtagtgtcatctcggcaagtaacttcgtgtgaa

SEQ ID NO: 99861 - DNA, 670 bp, Oryza sativa
atgtttaatattgctttattaaatatataatgaattactgatttcatcttatgatttataaatgctggttttactacaaatatcctatgagccactcctttgaatatctctgcctcagtatgacttgttgagtacggtggttggtacttaatcttgctttatttctcacccctcctcccaagaggcagaaaatgttttgaatggtgagttctatgaagattaggcttgtgccggacatcgaggttttgcctgtggatttggaggaagctacgctttgctaaaaagattaagtttagatggtctttaagttttccgctgattttctgagattattttatatttttgtaagttgtggaactatatcaaattatcatctgtgtactctggctggtcctggacagagattcaatatacattctgcttggaattcggttagcgaatttctgagcgtgacaaccaaacaccctccaaaagaaaatgctattggtgagaaaatgcgtgtatttttgggggatttaaaacaaaaatgtggtttttcagttcccatgataaagaagtgttcaaaagatttatgggtcacgattagagggttggctttcagcctataaatcattttttcttgtttactgatccatggggacaaagtgaacatttggtaattttgtgcata

SEQ ID NO: 99862 - DNA, 680 bp, Oryza sativa
agccacgtcggagggcctagggggagaacggttccatccttctctctcataatcccaaagaggtggctagagtggggcctggtgtcggttattagggttaagttttgaacgttctcggatgtagtttctttgttggcttagcggtgaccggtcacgcatagcggcggtcggttcggtgctagctttctcctaggtatgttgagttggagctatcggtgcgtgggtgggggttatttttcattttttttcctggttacgacttcccagggttataatcttggattttttttcctgctcaatcaaaaaaacttcgcactgtctggtgcgagtcattaaaaaaaaaaactctggattcaccagtgcggcagtgctacaaactgatcaataacattcgtcagacatatctctgttttacataaattaagcaacattaatctctgcacaacattgagaaacagccatctttaatttatttcacataaatagaacaacattaacttctctctttttttttcatacattaagcatgctcatctttatcaagaactaagctgtatcgatttattcaaagcgacagtagtactagtagtagtagcagcagcgacgtggtacaatatattccaccaaaagaacgcttgttactacgcaatagccctaacgtgttgcctgacttcttgaag

SEQ ID NO: 99863 - DNA, 676 bp, Oryza sativa
ttccagtaaaaatgtacagccagagcccatattttcttcatttttcctcttctttatctgctcatcttgattcattccacagaaattcctctgccaagggaggcttgagttagtgtgacatgaactacactacttgagttacacgaaacgatccaaaatgattatttgaggttgcacgatctactgctggtaaatgctttagttagagagagtcagtcacttgctaaaattgccaacaagttactagttcacttcacaagttcacatgggttccagccaaaatgtacagccagcccatgcatattttcttcctttttcctcttctttatcttctcatcttgattcattcgacagaaacatatcgaggaagacgaatgagcacaagcatttctattgctaaccccgtgcacgttgcagctgcacatctctgccaccagcaccactttgtttggaccggcccagatcaagaacgaatgaggagcaagtgcatatgctcctgcatcgaagctgtggcttgagatggccaaaaccaccaattataccacacattgacttgtgcattacatccagagataaaagtagaaaacagttgcttaccttatccggggttactgaaacagttctcatcaatgcaaaagacacaaaagttccctctccaatcttttctcccatcatg

SEQ ID NO: 99864 - DNA, 1529 bp, Oryza sativa
taattcgtcgagttatcatataccatacataatctctggcgatatcgatatctaacctacaatcggctaacatctgtcaatagaaggcagtcgattaggttaaataccgatgttgacttagattatataagatatccaccactctatgacacatccaacggcttgattgtctagatattgtccttcttttcatacttatagctgcattagttgagtttgatcttatgagtcgtgattagaatctcaatctctagcctgcttcttggttgccgattagggtagcatcggggtttcagccgatcttacctgatttcactatatttcccttatatacttcattgatatgttgaatctgccatttatattaagattttgttgcatttaagtatattaggcttttgtttagtatattctacttgctctaatatcttaatatagagtagtatcggagtattagccgatacatgctagatctatctgatcggctatgctatgaacatatatagtcttattattaatatatatttcgatctaagtgatttatactgtctcggcatggcgaccgatctatcccaatcacttgattttagtatatatcgatgtaaggactatatatcgttaatatctacagccgatcgaataagatttagttccttcaatcaacgtcaaccacctcgatctagcaaaaactagaccaagatgggttttgataactaaaccggctagcggagccgatttctagataactacctgtctcgtgggaaaacggaaggttttcatgacaaacctacaaagagatgtcgcactctcgcagcggcggcggacgatttacagcgcaaatcgacaaagatggacaaactaagagaaaactaaaagcaatatgaaaaacgattcgattgattgattgtagattgattagttataattgaactggccatgtcccttatataggggttggtcttgccctctacaggccctcctccacgtccaactcggggtagaaaccaaaggaaacccaaaacatgccttcccgagcaaggaaacctcgagacacgacgaaacacattcggactcggacctgccggtcagaccggccacatgccgccggtctgactggccctcgaccggcggtctaaccgcccaacacaaggcggtcagaccggcccactcggaggaaaccggcagacttccaaactttggcaatttttcctattttatccttaggtgccaaatttgggtgtaaacacatgccccctgcctttttgatgaacaacgtgaatctaaaagcatagaacatgtttttggtcttatagcgataatccaattaccggccatagcacctcctaagcattttgccaaacgctcgggaagcatttcttcaagtatttcccgttgattgctcgctgaaaacgctccccttgaagtgtctccaaaaaatatgcgttccctcgaacaatgccgcatactcgataaggaccttcccaattaggagaccacttactggattccctagatcgagtacccaaagg

SEQ ID NO: 99865 - DNA, 733 bp, Oryza sativa
ccacgttcacccggcgtcgcatcacgctgtacggcgtggatgagacggcggcgagggggagggcgctccacgtgttcgcgtgcggcgcgcgcaacggcgggttattgcaggtggcgttcagggagaacacggtggcgcacgccttcttcaagatgcatccgtcgccagccgtgcgcacgtttgggtttctctgatctcgagaggcggctgcgatgatcgtcgacggtgcacgagtggaattggtgtgtaatttattgcacatggaaaattgctggactcatttatattttttagactagatgtatgcatgcagttttaattttgtatgttttttaacatgcacaagtactatttattttcgttggaaatagtgcatacttagccattaatttagcatatacagcaagcataacctacttgcgacatgataggacaagaaaaactcataaattctatcatgctagatatcaaacaagacataaataaccaagccaagtaagttattaggctaatcacaatggtaatctagccgcaatattttaatctagatgaacagtaccatgcatatacaaaactcaggtacgaacaaaactagattagaaatgcaccggttcctttcctttgtaaacgaaagaattcactcactgaatggatcgacggagatcagcgagtcgaagcactgcagtcaatcgatgatgtcgagcggccgtgtagaaatacgctgcccagaaac

SEQ ID NO: 99866 - DNA, 714 bp, Oryza sativa
  unsure (1)..(714): unsure at all n locations
atggacttctaaacttagacgactccataaataaaacataataatgctaatttatccttttacatcttggcttttgacactacaaggaaagacaatgcaaatatatagatctaatattatgaatgatagcaatatcattgtgccaacaacacccacgggtggacctcatccagatgctgttacgagaaggaananagttatctatgtcctgagtgtgtaaaaccagcaagcttgatgaccatagtaatcaacagaggtatatatatatatatatanaaagaaacataagataatatgccacttggagttgtccatttcaatccatatattcaactcccagtcagtttcaatgccgagtcaaccttttcaatataatagggatgatagccgggggagatggggatttgtttgaaagcaagttattaccaaattaactggaatggaattaaagtaaggtgttttttatttttaactcggtgttcaatggaaatctttttttaagaaatttcgataaacttttattggccataaatggttttttaccaccccgtccattctctttttaattgattcatatatgtatatggaatatccaccggccatattaaaatattaggtattaaaattttgaatttgggattattaaattaccctttaaaaattaggtccaaatccaccccgatacgaaattaagtataaattaaaatccttaaa

SEQ ID NO: 99867 - DNA, 505 bp, Oryza sativa
aatagtgcatgctgccctagcaatgacatattttggttcagtaccaaatagggacacatgctcattgttaattactgcacatgttaaaattatcttcattttgtcccatatataatgaaaatttaatttaaatggatgaaacatagcaaaccatacaaaataatattctatttcatacaaagaagacagtggtgtttggtaaatactgtttagctaaacaaaactaggtcgttttgacgtgatgctagctaacttctcatgaatttcacctatatctatgaacgtgtgtacaaaactcggccgtcttgacgtgatgctagcttagtcctcatgaattcaacctatatctaggaatatgtgtacagactacgatcaaaatgatgcttcataatatttacaacttgatcaggaagactttactcacaaattgacattttagcacacatgttaatgagagcatcaccgcaatttatttgcttttctccaacatctcaaggaatacatg

SEQ ID NO: 99868 - DNA, 2284 bp, Oryza sativa
ttttaagactttgtgatgtatttggagatgatttgtttgaggatttgaggatttggagatgttctgtgatacgtgatgatttggatatgggaggggatggtgtgaaatcaatattcaatattaaaagcagaaaaaaagaaaaaatatcaaccgggactaaagatggagcaccaaccgggactaaagattgatatttagtcccggttatttgaaccgggactaaagatagcgatatttagtcccggattcgtagtcccggttggaaaaccgggactacaggggggttacgaaccgggacttaaaaagcatttctccaccagtgccaccggcatcattctatactgctttactagcgacacaaagttcccatcttgtgccgcacgacggcgagcctgctgctcaccaatcttgacatcactattacataaacctagatagatgccggttggaaacctgacatcccatccggcacctagaagacggcactgatgagagaaatcaaaggcacatttgaggtcctaagaataaaaaaaaactggctcgatgcattggctcggttcgagatgcatagagctctccaatcacccatgcatgagatcccagtcacccaagaatacaataacacaatcacgaataaaacaaacatccacacaaatcatgagcaaaatcaacgaggaagccgctgtcgccgcctgatggtggagtcgctgctgctgccggggagagtggagccgacgccaccggggcttctcctcagtgtctaccctcgccggatcaacattagccaacttctcctagtttgtgcagacgtgcaagttacctaagtggcacgcatatgcaagaaagtatacggaaactctttttcaccatccatttttaggcacgttttttttacgcgcatcgattgtcattctcaatctccatcatgtttttttctcctagggtttggtcggctcattgttagtgttttaaatgaattgaaaatttaaaaattcaattcaagacccataaaaaactgaaaccttcaagtaaatttttttaactttcaactcaaatttgaactttgaactcaaaatttgaacttttaagtcaagatttgaaaatattcaactcaggttttaaaatttttgaactcaaacattgaaaattttcaagccaaaatatgtcagtttttgaactcaaaatttgaaaactttcatgtcaaaacatgaaacttccaaccaaaatttgaaaactttcaactcaagatataaaaactttcaaatcaaatttaaaacattgaattcaaaatttaaaaatcttaactcaatttttgaaacttcctattcgaaatttaaaactttgaactcaaaattcgaaaactttcaactcatatattaaaactttcaactcaacatttttattattattattatacattatagaaaactacaaagcatgtgattgtcactgggcgtgtcgtactcggggcggttgtacggcttcccaccatggcgtatacgtgtgcgtggtagaaatcccctcggaccacacgccatatcaggaatttcgcgctccgcacaagcaaatatgtaattaatggctaggaaatgagctgcaattcagcaatttctgggccaagcaagacatgcataggagtgggaacacattgagaattgactggtgtgcaataccgtgtggttacgctttggttatcgcaaaaagcttgcacgataccatgtcagtttttgaaacttcctaatttttgggtgtaacttctcttttttttcacatgtggttgccacggtaaccgttacacgaagtagcagtaaccccactccaaatgtttagggaaaccctcaattgagaccacactaaaggaaacttcagacagatgtaacactgcgtgaacagaatggacaaagaacaagaaacaagcaacaagtcaaaacaataaaatatcatacaaactcctcaaatatgaaagacatggaattacataataaattgtaggaaccaaattggcgcaaccagatgttgtccgttatgaaagcatgaatgatggaaatatgtgaagagaaaacaaaatgaggtctcaatgagaaattttataggtaaatctctggtgtagctgttcaaagtaaaaaaaaaatgtcatcttttgataacttgttaaggaccaaaacaaagctcatcattccagttttttgtgcagttctccaagacggtgcatctttagtaatgccgcagattgatgggaagagagattattcagataaatgaggagataattaacctcccaatc

SEQ ID NO: 99869 - DNA, 522 bp, Oryza sativa
tgtcgtagaaaatattccacaccatgttcgcatctaccatttccatgccaagaacatggagctaaaatgggatactcattctccaagcgaaatgagggcgtgcgctgtgaggagagaggtgtgcggcgacattgtggaggatgtatcctctttgtgtctttcccaggtacttaacgctacacattaccgtgaaacttgtgtcctttcagattcctagatcgatctagctggtaagtgaggtcagcaaatatgtgtcctgtactgctagttgtcttttacgaatagatgaagtaatacgattttagccccttagaaaataaaattgttcacctcaaaacccgaatttcttatttataataaataataatccttgaattaaataaatagtaatttaattttcattttaaaaaataggttggatactgggacgaacaacgtctagtcttggatgctattacatatttcgtcccgctgtggacgttgttgtcgacggcgtccaccatatggcgggggtcagacttg

SEQ ID NO: 99870 - DNA, 575 bp, Oryza sativa
tctggtgcaatcgtgttgattctccgggcacattctatgtcccacttttctgccctcacgctcactggccgagtgctaagaagcttcaatgagtttgaaatctctctcagtcggtcactcaactttggggaggatagggtactgctggcaggagtcttctcaacaaggttatctgggagtgccagtcaggtgattatgtgatcatactttccattctcgtaatgaacttggcaaccaaataataaaagtgatgctataccagtgatagaagagcaggtcaatcccatgtcagtacatgaattctccggttccatatttgacaaggcatagtcctgaacaaagtgacaggggcacctaccgtatttttaattaacccccaaaggaactccaaacagataatgaggtattccttgaaaagagatacctcttcttgtatagtacttgctagcagttcttgtgtgctgcaatgtaccacttcttgcatttcagatgatttaacatctccggtgtttcctatttcagaacatccctgcattttgctccaaaattatatcaataggcattcactttggaac

SEQ ID NO: 99871 - DNA, 616 bp, Oryza sativa
ttccaaccagttcgatatccatcctcgtttgccctgaattccaacttgatcactcatgttgcgatcgagggcctgaactgcagaaaatggtgaaccctgtttttttatatcctagattgtgaaatgcccagcatatatacatgcaccattgtttccagtttgtaataaattgcatgtgataaatggttcaatgctgaacttattatgcactggattggaaaggtgaacctatatcactgtatcaaattgcaacctagctatctattggcttgtatccactacagcaaaatattctcctgtaacatagccatataaggtattgcaacaatgtttcacaacttagataactgtgcatcagcgttacaatcataattacaatataatgggtattagaccctatcgctagagttttgttactaattaatggtacagttcaacattacatagtttggctcaattttgaatctcacagacaaaagagaacaattacagattcagatcgtgcaaaaagctgattggatttgagagatgcactgaaaatatttcttatatatggtcaggtaaataatatgtctagtccttcatgttggacacatgtcaagcattagattttaga

SEQ ID NO: 99872 - DNA, 591 bp, Oryza sativa
attgcaatcaccatgtaatcgactcccttaccagttttgtacttttgtttagtttagattccactttatatatcagctaagagacagaaccagagatgggcatagggtagaaagcatacgctcgatcatttcaaaccaaatttccgtacttgtaggattgatcatgagaacacatctagtcaaatgtcttacgagaggatcgagcaataccatacaaatgccaatctctaacggtcaattaattaagtacagtaatctcgaacagttaaaccatcgttggagacataaggttaatgactagatagactaatcatttcttgcaacctaaaatatagctacctttagctatgaatatgaataagtcatattttggaattaatggctggagtataaccgtttaataaatcttttagtgatgatcgggagtgattttttaacctgtaatgattcataataacgaacagttatatatttgtaagccaaaaaatatatattcgaaaaaatatgcactctcactaggaactgtgccgcgaccaaataggttttctgcaaaccaatgcaacctaccttgtgactcaaatatattacata

SEQ ID NO: 99873 - DNA, 565 bp, Oryza sativa
gtgtacggtacggaggaaaagccacctcgccagcaacatgcccatcgcatcgcgtgaaacacggtgcatattgttcggtagcccctgcgagattttgtctgcaactgcaaagctccaaaagcgcactgggctgggcgagtgagtgtgccaaatgccagtgtgtgcttcgtccggtggctaatttagctgacctctgagactggccccagttatgcaactagccccgcaacttttttttttctttttcggtacaccgatgacaatcatgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctg

SEQ ID NO: 99874 - DNA, 2122 bp, Oryza sativa
atgccacgtggcaacttaggaccgatttaagtgaacgttgatggacaaatatttttttaaaaaaataatgcaaaataatgggtacataatattatataatataatggtggaaactttattttcaaatattgtagagctaatttatttatgtctacttgtagagatttatatgctgtatattctatatttgtaaagtaatttttattcaagatttattatcacttattattattattattatattattattattattattattattattattattattattattattattattattattattattattattattattattattattattatcatctcaattatatacctgaaataaagaaagaatagtaacgtacctagaaaaataaaagaaagtttatgtacgtacacaccttgaacgcatgcaagcagtaccgtacctatatggatcggatcaacacaagctccttgaacgaaagccagcaatacatacctatatatggaacggaacagaggagtacttttgagataaatctaatctaacggtttataatattggatccaccgatttaagtgaaaatcgagagatagatattttgcttttttttctcagattttctagaattttctaatttattagagcgccatgtggcggcttgagagcgttttgagaaaacttaatggacttttagtatataatagaagacagatagatagatagatagatagatagatagatagatagatgtaagagtgtcatgacccaaatttgttatgagatggtttaggaaatttgtgtgccgaattctcagctttggttgttttcccttgacaaaccacagcatgactaggtagctcattgagcttgtctcggatcacagttagaattgtgttatcccaatttggttctgtcgcattcaaaaaataaaagatatatagttcagtctattgaatgcaccatggagttgatagtgaactgcactagattaggagttttctatgactttgtttggttgataatgaggatttttattactgattcttccctttttgaataaatacaaatcaacctagtatctttctgtacatgggtttaactttgtgacaggaaaatattaaccttcgtgaatcatccaaagttactgcatgtaacaatttctactactccgaaattagagcaatactggcaaatttatctagcaatatctgaaacaatttctagcaatgtttaacaaatttatctattattctagttaaattattttgtaattgtttggtttgcattaacaaatattgtcatagcgttagcacgggtaaattactagtattgttgtcattcataatattagatctgtttgtctttccttgtagtgtcaaaagccaagacgtaaaaggataaattagcattattatgttttatttatggagtcgtctaagtttagaagtccatgttgcaggtcgacaatgaactgctcaaaaggaagggttgatgaccaaagcaatcaatagaggtatagcaaaaaaagaaagatgagataatatgccacatagagttgtctatttaaatccatatatacaactcactagtcagcttcaatgccgagtcaaaccttttcaatataagagtgtcatgacccaagagggaaatacccgacaatccttgatgacgaagaattatagtgttgaagttcctgcgcatgctccacttgaatgcttagcacatgctgcacaagtatagtcttgtagtttgtggtatcgatgactcctaaaatctccccatcatcattttccatctcaggatcattggtttcacctagaagcttagcaacaagagaatattcttcctcaacatcactagaacttacatatccaccatcatccgtagcgatgcacgcatactgacttgtacaatccttcatgacatgtcacatgcccttgcagtggtggcatatgatcctaattcttcgccccgtagaagccactgacgaggagcttttcatgggtacctgcactttaatagacttactcacctcggtagctcatggattcatgatggaacggggacgggtgtcgatggagcctggttggtggaaggcacaccagagcgtgcaagaggagataccgt

SEQ ID NO: 99875 - DNA, 689 bp, Oryza sativa
tttttagactatcatcctttgacccactcttttctgatttagaagagtcaaacagcatttatcaccttgaggtgttggatgtccaccagtgtcctaacattgattggcaaggtttggtggctttaccctcttctcttagaagggttacccttggcaactttggccattcgacagatcactttgtgagttgctttcgtggcctctccctcctgacacatctggaaatacattgctggttcttaacatctattcccctgcaagtttggatgagtaatcttccatccttggagaatttgcgtattgataattgtggctccctcacatccatctgtgtctctgaggcaagcaacatacacactgttggagtattttcatccctttcaacagtcaccatttcgttttgcaatgcactgttgagtcttgatgagttctttatgcccgcttatatgcctttcgtgaagaccattgatgtgttattttgcaaggaattagcattactgccagttcatgagctccaccttttttctcgcttggagaagctatgtattagaaactgtcccaagttgaatatgcagaggagaatgacattaccatcctctcttcggatgctcagcttattactttgtccaagcatagagtacatcgacaacagccatctggcgagtgcaatgaaactcagggacttagcc

SEQ ID NO: 99876 - DNA, 709 bp, Oryza sativa
agctagtaatggatcaagcattgtatttattgtttcacccttgccagcaattaagtttctatatggagtaaattgtaagctatagctactacactgggcgatattttcatccactatattgattattgatgattttctagctattcaattatttgtaccactccgtaagaaaaaaaaaaagaaaccatggcattgttctacttcatgttttagagacaagcatcttttaattacaaaaccacatggtagttattttttcttttatgaacatgctggttatgtattcaaatatgcgaccatagttaaaaacatatacattccaccgtattctccgtcccaaaataatggtaggctgttttcaaaataatggtaggctgttttagtgcacatttcttcagaatccagtttacttctaaattatcaattcaagtgcacaccctgaagttattttcccccatcaattacaccatgccccgtccacgttcttatgtatgcgccaagaaaatttaagaattatcctggggaagttcagcctacatgctggcaggttctgtagatatagatagttacacacaggcatgaggactgttcaatgttgcaagtaggggcggagctggtgtatattagggggtgcccaggaacccggttaagaaaattttttagctatcactcatctattttcaccatgtatgcacctctctcaatataa

SEQ ID NO: 99877 - DNA, 500 bp, Oryza sativa
accttataatgcgccgagcagctgatagaatgtgaatctccccttatatttcctccgacaaacgttggggctctttcctttggtagtaattggtcatttgatcagtcatttcaactttatatgggaagtggatttttatccccgatgagattaaaaaatttcccccccccttttcgccctttttcccccaaattttttcctaaattaaattaatgggcgtttcaaaatgttatcaaaattttttttaaaaaaatgttaaaatagatcaatatataatatatcttttcgcaaatatgcgagttaaaattcaacgtatacaattcaaaaaaataacaaatttgactgtgaattacgcgttctattcattgtcaaatttgttatttttgtttctacttgtataagttggatttgaatttgcatgtttgtgaagtgatatatcacatattgatatatcctactaattttttttcaaattttttatgacattttaagtaacatgc

SEQ ID NO: 99878 - DNA, 516 bp, Oryza sativa
atgcgaggagataaaagttaattcagaaatcaaaactaattgtaagattgcacttgttcacaaaaagagagagagagagagagagagagagagagagagagaagcttttcctatcagtacaggtccaagcatggatagatggctcagtgcacgcacaatgcaatctcgagtggaagttcagattattcagaaatgtaatgcacaaaggcgagcagaaacatcatctgtccaaaaactatttgcccaccttgagattaatctgtatacagagcttaatggtaaaacagttggctgaaagtttgaagtatttagcccttggcatcgatttcctataaatcgatatttaagctaactaacattttaaaagacctctctgcggtattgcagaggatccgaatccatctgcagggaattcggacactgttccctcacatatccccttgaaaagcattggcgcacgtgtagttgctctacccgaactgagctatagcccttgtcagagatatcttaatatat

SEQ ID NO: 99879 - DNA, 1750 bp, Oryza sativa
ttcaacctatatgtttgggtttcgagggttaggaggtgatgaaggtagtaggaagtaacaagggtggctttagaggatggcctaggacgtggtggacacaagtagacaacaaagtgaagccatgagtttggagaagggtagtagcaggggcatcatatctacaaaaggttaggaggcagagacgtctccacggcatgaactttatgttgctaagacaacgaagaacaacaggggctagggcaccttgccacttattagcttcaagagaaaggcgcctgggggggaggggtaagtcgagatcggtttggtaggcctcgctggtgccatttgcaggctcttgcactagctaggcagaaggaggcgatgcatgtggggaagagacaatggattacaagggaaaatgtgattacgtcgatcgacaacaatataggaaaataaggagatacagttagagaaacatgtgttacatgaatcttaaaatatcttcctatctaaaattggatgaatttaaaataggtatataaacattggacattctctagatttaatcattctcaaatgttggactgccgttttctttttactaatggaaatggcctactgtggtgtttgaatcttctgaagatgaagataaagattaagtatttcacgcaaaacgaggtggtaataatatgtgattaattgagttttaattattacaaacttgaaaaatgggttaatatgatattttaaaacaattttcatatagaaagttttcgcacgaaacacaccgtttagtcgtttgaaaagcgtgccacgagtatacaaaatttaatcctttacttgcagaagaaatgaacatggcctttggccaagatacataatagtggtattgttgcgctccttatgccctatttaattcagcttaggattattataatctggattattaggagtaagctgaaacaaacaagtaaattattatgctagattattataatctataagtcagattattataatctaataatctcctctagagaagctttttctagattattgagtggctaaagacccagtacccttagatgcctctaataatccagagaaacaaacaactcgtagtttattttatatcagcttattataatccagcttagagtaatctgatttaataatctagattacaataattttaagctgaaacaaacatggctttaatcacttctgtattaagagatgaaagctgtattaacaattttccactcgtacgtggcgtgcgcctgcctgtttgcccattgccatgagcccttgaggccttgacaggtgaaaattggttagcatgttcggactctgggtcgtggtggtgagctagcggccgacccgtttgcagcaattggatgcatcgatattaccaattcagtcaagggtcacgcgggtgctagtcgagtcaaaagaaagccggcctaataccgtgcagggcccaagctaacagcacagcactggaccatgcgtcaatcctaaccacgcagtcagatcagctcatcagcaccgtacaagtacgacctcaccaaaaccatctcgaaattcacgcacctctctctcgagcctgaattggctggcacaaaccatggcacttgagtcactctgccatactgataccgttttaagcgtaggagtagttagaatgcccaagctgtttcaagcctgaattcgcagtcacagtgttgtctcacacatgcccatagtcatggcaacagcatggcggatg

SEQ ID NO: 99880 - DNA, 657 bp, Oryza sativa
agataataaaaggctctattaagggagacagaaaaaatatatatatggttcgtaaaagggtactccttttgtaaaagaaaaaactcaacctagttaaaaatgagacacaatagtttaacgaatctggacatgattatttaaataataaaaagaaaaaatattggtaaaaaggtattccctctttttaaaaaaacagcatagttggggatgttatataatatggagtttagtccaaacgaatttgaacaggtacctttccatattcattgtaaacatagattgtgttcgaatcttataaagattcagattaaatatgggcatgcaaaaaaaaagctattagcatatgattaattaagttttaattattacaaacttgaaaaatggatacatttaatattttgaagcaactttaatataaaaagttttcactcaaaacaagtcgtttaatagtttaaaaagcgtgataataaaaactaaggtaaaatctttatctttacaagaaatgaactaggtcatagtgtctatctatttgtagctcgcattcaccatgcaaaatggatgagtcgtgtacctattttctcggttgtcttattgttgcaattgcttattaggcaaggcaaaataaacactgggtaccgagctcgaattcgccctata

SEQ ID NO: 99881 - DNA, 786 bp, Oryza sativa
aataacttccatataaataaagtaggtacgattttgatacaataaattaagaagttatgtgacaacttaattatttggagcattttttatataaatttaattttttaagtatttattttgacaatatagtagcgtggatttgtataagcatatttatatttttatcctaataactaataactaaaagttaataaaactggatgtaggaattattacattttggttgatatttgagaaggtgaagaaaacaaaaaattcttaaaggtaattggatgcaaattttatgtgcactataattcttaaagattaagttcaatattataaggtaatatctgattgatatttgagaaggtgaagaaaacaaaaaattcttaaaggtaattggatgcaaattttatgtgcagtataattcttaaagattaagttcaatattataaggtaatatccgtaggaatactgtgtaatggcatattaacatcgtgaaaaaaactcacctagcatatgcttcgccaagttgatgcaccaaaatactaaattgttaagttcttgtactagaatgcacccacttgtcaagttgttgtactcggacgtccaattctcaagttcttgcactatatcgttgttataccgtgggtgcaatttactaaaaaaacaaaagcgcccgggaggcgcgcagtgaacacatcggaataaaaaaaagacgaaaataaccaaaagccttagcgtgtgggcaaaaaaaaaagtctttcgcgtgcaaaacaaagtcgggaaaaaaccggtgaaaaa

SEQ ID NO: 99882 - DNA, 726 bp, Oryza sativa
  unsure (1)..(726): unsure at all n locations
tctgcggtgcgtcnccgatccgatgtcctgctaccgccaagcccttcctttgcagctatagccaagcccttcctttggagccgagcccttcctttggagctacagccaagcccttcggagccgagccgatgtgttttttaaagtatgacagtacaaagccattggtattatgaggaagaagagggcatatgattattttttaaaagttttagttttgacttatattttaatcgacgcggtgcaaacagacaagatgaataggagattgaaacaaaataggtaatcggtttgatgactgtctcgagattttttaagccacaactcaacgatacaaacttattaaagaaaacaattgagttttctaatccacatattaataaaaaaaaatatttgttttcatacataattaattgtatatataagcaattcagcttcttagtctaattatttcaattatttatatagtaatcaaaataaagatgttgttgagcataatagatcacatcattccagatgggtgcataaactgttaaaaatatctttttttaatcttatttaattagattgtgatgaattatatttaaaattaaacctaaaactaaaggttgctacaactagttcagtcgtatagaaaaaaatgaaacatatttagctgtcaaaattagatctaaagagtattatctaagacaaaagattgaatcgtataatataagtattcagactttt

SEQ ID NO: 99883 - DNA, 588 bp, Oryza sativa
cggcctaaagtcctgatttaggaaaccgataccgtattggttaaggtttctatcttgtaatcctgccccccatcctatataaggtgggcaggaggccctctatggggcatatatgagacaacctgatcgtcagatcaatacacactcggcggattcaaatccccaaacaggagtagggtattacctctcattgagagggcctgaacctgtctaaatcctttgtctacacatacatccacttttaggtctcgtgcgctaccccgtgttattattgccgaattcatgtttcgacagttggcgcgccaggtaggggttgcgtcgagtttcctatcaacgagcgcgatggaatcaatttcatgagtcgccgacttcgctttcgctttgggagttttcacttactttccgtcgaccacttcttcaagctcctcttctctgacttgatccaaatcagtcagggggaaactcaatctgatttttatcattatttatcatattgatttttaatctcagattaatttcttgctattttttgttggtggtcgcatataactacgcggcactattgaggcgattgatgctggtcatgga

SEQ ID NO: 99884 - DNA, 761 bp, Oryza sativa
ctatatcgagagaaacaagtgtgttgcgaagctcaagttgccacttaagattaaaattttcatgtggtacctgcttaaagggtgtgtgttaactaaggataatttggtaggcgtaactggaatggtagctagaggtgttctttatggttgaagaaagagtctattcacacatctctttatggatagacattttgcgaagttgttatggacagcaaatctattgtcttttgggattaatgttgcatctagtatatctcatattattaatgagaggcttttgagagttgataacaaaatgagtaaactgatacttgttggagcttctgccatttgatgggcaatatggctgagtatgaacgatatggtttttgacaaatcaccatcattttcctatatgcaggtcatatttcagggcaactcattggctccggttttgggcacaactacaaaggtgtgatgaagatgaacagtttctgaaagttgcgtgctgaaagttggagaccacggttatgcaactatttgccaattatggttggagatttacaaatagacttcaataattgtgatctccttacgctaggctggattatttgtattctcattcggtgcgttctattcatttagatctacactatgttcatgaaaactactatataataaacggctgtagctctttggaataagggccggatattatattccattatctaaaaaacttgatcaatcataggcataaaaatggtgagatcgatagagataca

SEQ ID NO: 99885 - DNA, 656 bp, Oryza sativa
tagggcgaattcgagctcggtacccaacttgaaagatatattaatatgatttttaggagaactttcctatagaagttttttttttgccaaaaaaaggttaacatttagcaattttaaaaatgtgcgtgcgaaaaacgagggaggagatgttggtaacctacacaacctataaatgatttgggatgtgagaacgataaatattttttcaaaaaaataatgctgaaataacagttaatatgaaacaaagggagtacatactaatgtaggaaacatgcatgctgtagtgatatgacgtgcggggctcttttggattgaaggaattttaatggactttatggaggattcaaatccttgggaatttttttgttgaaccctttattgcaaaggaataggatgttggaattcctataaattgccctcctttgccccccccccaaccccaacccaacccaattccatagaaaaatacacatgagtcaaacttcatgttttattttccttcgtgaactctcttcctttacctctttagtttccgtctctatcacaagcaagttcctttgaaattcatatatttatttcttgacaactatctataggaacaaactttagtattcacatgttttagaataccataggatttcacagtgtcacattct

SEQ ID NO: 99886 - DNA, 781 bp, Oryza sativa
  unsure (1)..(781): unsure at all n locations
ccggcttgatgtctctctgaccccaaggaaangaggccaggtatccaaaggcccatgtctctatttaccaggaaatgctatgggtccccatccatgcccccctaaaacaatcactgcttttctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctagaagataccaaccttgtgaactatttcgtctcatgtgctgctaatatgctatatacgagctacgtgttgagtaccctgggtattaatttttttnaacaaaaccaaacacncccaaaaattaatttccccctttttcccttttttaaaaggggggttttacctcactgcataaatcgcaaaccaccaagaacaccctaatacggctggaactaccaacataaacatttggccatatgttaaaacaaacgtcaccaaatcacaagg

SEQ ID NO: 99887 - DNA, 731 bp, Oryza sativa
  unsure (1)..(731): unsure at all n locations
aggcctgaatgcaatcccatgagaacccattctgacagccgcagnngactctagaggatcccctgttgaataatataaccaaactgaacatatatatatgtccacaggctaatttaccacaatgatatatatatatataatatgagatgataaataatacggtgacactgccaatgttgcaagatcgatcgatcgatattacgtacattacatatggctggcccataaaacaaacttgctatacattcgatcagcgtgggactgaaacgggaacattaacgaactacgtaccgatccatcgatcgatcaacattgcatagtactctctcgttcgtttctaaatatttgacgcctttgatttttttaaatatgtttaactgatcgtcttatttaaaaaaattaaataattattaattattttttatacaattgatttattgttaaatataattttatggatatatatattattttataaaagtttttaaataagacaaacggttaaatatgtttaaaaaaattgaacgcgtcggatttttagaaccagaggaactattaattattcatggtgcagtgcatgtagatgtaacttacctatatatatattcccttcgttccaaaatatttggaggcggtgattttttttaaaaatttttgaccattttgtttattaaaaagaaattaagtaaatagttaaattttttgtattatttggaatatggtaaaaatag

SEQ ID NO: 99888 - DNA, 598 bp, Oryza sativa
  unsure (1)..(598): unsure at all n locations
ccggcaggatgacaactccttatgcccgcacgncgactctagaggatcccctgtccgtgcatcttcttcctgcagctgacgacaccattgcaagctcggtgggagtagcagtagctctgttgttcgggtgttctgctcaatggccgctcgagcactgtctgctgctgccgccgccgccggtcgccggatggcggacagactggcttccctcttcttgcctcctgcaggtaactggctataactgaaagaatgggagctctgattcatgtatttctcctgatttttttttttttttgcttcttcattggattgtttctgctatggtttatcagcgtccagtacgttagtttagtgtaggccgtgaatcgtgatgagctgatggcgaccccagtatcttgccttcgaacttctctttggactatttttttttcctctttggtttgcaaccctcaatcgatgataaacatgccacctttttatgtggaactctgaatgaacgttcatttgggctgatgaactctgataaactctgatggagaaagaaatgagccaagcaaggtcaagttcctttggagatgtttctctcttgtggtttttt

SEQ ID NO: 99889 - DNA, 801 bp, Oryza sativa
  unsure (1)..(801): unsure at all n locations
ttcgcataaccctcccctacccatccacncngngttaaggtttcaccccccacccctcaaaagacagtgggcggtcccctcttgcgcccggtaaatacgacagctgaacaccggaccaaaaacccaccccccccccccgcggggggtcccccggaaaccccccaaaattttccccattcaaacggcccccaccccttcgcccaccggtgcctaggaaagggtcgagctatacttcagatcaagcagttacccactcccgcttgtggtaagcactgtaagtcttccagggtttctcgtgaaccggtccttaattgccatgggtgcgactcgcaaaaccatgcacccacagcccaccattcagtcgtattttagttggataattacgaccatgaaacatggccagacgtctcgagcacgcagctcaacaagatactagaatgtctaatactgcaattatcccatcgactgagctagtggtaattaagcatggctaagcatatagttctagctaggtcacataagtaacacgagctagtcaatttatcacccaaggttgacaaaggatagatatcaagtaaccatggcacaagcgagcagataggtaaaccctgaccccgtgtaattagcaaaacatgcatatttatttgtaaacggtaaaacatttataaattaggatcaacatgctcaaggggaatgtgtgacttgccttgcttcttcacttggatcttctaaactcttttcctcgcgaccgcggacttccgaaacgacggattctacacgctggcacgcaaaacgaggaaa

SEQ ID NO: 99890 - DNA, 533 bp, Oryza sativa
gaattggaatcgggatcgaaaactcggatacggaaatgaaatcgttattatcgaatacagatacggagcgaatatgagacggaacgaatacggtagcgaatatttaccggtatataaaaaacccctcaaattgagtttcttgatcaaggaagagatatcgcttattattttagttcaaaatctccaacatttatatcgtcaattttatagacggtcccacaaccatatgtgaaaattgattttcatggctgttcctctaagagatccatatgcaaatatgatttatcatttcctattcccaagaccttttactagatgtataacttacttaccattgtataaattggagattttatttattttacttcacatcttcgaaacttgtaatgtctgtattatactttaaatgctttcaaatacaaatgttataagctacaaagtggtagatcccgttgagctctttaactttgatatggaacacatctccatcagatgtccttgaattgtaggggctgtatggcacagatccagct

SEQ ID NO: 99891 - DNA, 624 bp, Oryza sativa
tgtcgtcacggatgggcgcgctgctggcggcctgccgggagctggccagcctggatgagccgcgggagcacctgagtcactgccggcggatagcctgtctgctcgcgttgaggtcaccgagtcatgggagcgccttactcgtgacgtcgtcgagtgggatgggtgagagcgcactggggagacagccagactggagaggagttagggttttctttgtttctgtgtgctaggctttctttcgcggccctaaagaagaagacctgtggttctctgtgccacactctatgtgagcatataattatgctatggaagattcgcataacacaggtgcgaatgatcgcgcaaaggcactcactcgtgtggaacttgtgatcggatcgctgacatatgggtactactgacacattcgcgctaccatagcatgccatattatctcacggtgtgagttggagcccatttagacctatatgacacccaggacatggttaggctgccacaagtgcattatgagagttcatggacctaagtgacacacctctacacgtttaggggccgctcgtgcactggactctattctgaaaatgcaggacattatatccatatcaagtgtaaactatgagtggt

SEQ ID NO: 99892 - DNA, 530 bp, Oryza sativa
aatgccataagcccccttacatgactaccacattctagttgaaagtagaggggctattattggaacaaacatgctttgatcagaccagagaaaaagtataaagtgcaaaggataacgagtactaatgtactatggatgaaacagtaaaatggtaccatattaagttccttatcatgtccacagccggttgcatttttacctgcaagaagatagatacctcaatctgagattgtgagacatgaacagtgacaacattctgtgaggtgatagtgaccaggagaataatagcatattgtttttcgaaagttcagcatcaaagccatactgaacttgttggaacaaaatccaacagaactaataactagtcatggcataacttcgagactgctttgcctacttccatccccaacttgcatggctagatatgcgtagacatgtgtgtcactcttctaatgcatttactattttacttgcattcgttgtaacacccaatagcatgttgctagttaatagtaggaaaaaactgaaat

SEQ ID NO: 99893 - DNA, 503 bp, Oryza sativa
aaaaggtagtcctcaaacatgttcaattgtgcattgatatccttcaatatgcactacactgtgtttttataatatttcctcacaaaaaaagatttaaagaaatccaatatgtacagcgtaccacaggatcagtgaaacctatatcatatgtatagtttggtagtatatgtgtgtacacggatcaaacatacttttatgattcgatcaaatatatacttttatggcatgcagtttttgctgatgattgtagttgcaatttacagttatctgctgcctggtgaatggtctggtgattgcattgaactcacatggctctgtcgtttggaaggtgcaacagctttatacagtacagttttgcaattgaatgacacatcatggatgtagttgttgatcatctgtaaaatactagtggaaattcattattcgtatttggtcaaacttataagcaggtgtcattagagcacatataaactgagtacctcttatgatagctatggcagtat

SEQ ID NO: 99894 - DNA, 508 bp, Oryza sativa
gcatttccatactggcaggaaggcaaattctttataagctcacactactttcccaaatatgatgattacttgttcatgtcctttgctcagttaatagtatatgtataactagaatgatggccgtgtagattgcgtggctaacattattgtatttttctcacataataacacatatattcacattttattagggacgcgctaaagcgcccctggggtgtgtgctagctaaaacgcactctcacaggtacaccccctccctcccccttaactcctctgcccctccctcccacacctttcccaccactcttgtttgcacattttctcactcctgatttttcttctcacatccttctatcagtaattgatttactcttgatttttcttcccacttccttctctcggtaattgatttactatcaattggtattcttccctcggtaaatgaattactcccaattggttcttagcccttctctcattataaatatacttcctctgttttataatg

SEQ ID NO: 99895 - DNA, 508 bp, Oryza sativa
  unsure (1)..(508): unsure at all n locations
atgggccttgaaatgantatcgattgcacttgtacccgatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataa

SEQ ID NO: 99896 - DNA, 629 bp, Oryza sativa
atattaaattttttaataaaatgaatggccaaacattattataaaattaatggtgttatccattaaaacatgaaggtagtatatatataagtcattgattaattgttgtgttttgtttagaaattgttgtgtaattgaaatcacagagctatacgtacgtactgtatatcacgaaaattgaagcagcaacagcaagtagtagcataatatagagaaaccggctatgtacttcgtatatacttatgtatgggatgggttgtgttggaattagtctcaagactaaattaagtgcagtactagcgaaaggtggtgatgattaattcaatgggtggacacgatacgtgtacgtacgtactttaggctagtaataaataagattagcttatgttccggctattcgcgcccgacgatataaaaacgatgaacgcggtggagaccaagtctaaatatggttgaccacgtaaaaatcatagaaatgaaatgggcatacatattttttttttgaaactagaacacgaagggcccctctttccattactggaacggaataaaccaagtcattacaaggcggaactggagaagagaaaacaaaagatgttaagagaggggaaaaatgtccagccaaagct

SEQ ID NO: 99897 - DNA, 862 bp, Oryza sativa
ctactggtgcccgacgctgttggaattttatagtgggcagtaacatgcccagtcactggcttgactggtcagcagcattttgtattggcactggtgaagtggtgcagtagtgatggaagcacaagctgcctgttgattgtgtgtgtcaattgcatgcgatgtgtgaagagagaaaagcctgggatgccaaaaggaaggtaactgacagcctgccaggcccatgcaaccagtacatattatctgctgatgctggcatttggattgcaactgagattcgtggtcaaagttaaatgtgacgttatatcttggatcttggaaggtagcggaggcatttcacaaatcctactacagctaaccatgctgaaaattgcctgactgtaatacggagtatgtcgaatgaatgagaacatggcagatcatgacacaaccaaagatagcatctgcagacatgcagtccagtaaagcacgttttagtgacaaccagagtgtagtttccagtacaatgagtaaagaacaaagattgtagtttccagtacaatgaaatcgattgattttattgcaagtaactttgctacagtcccagattggccacaaaaaaacagtaggatggcaacaagggaagaaacttacacgagtcaattcatacaccctgtcaaggactcaagggtgtagaatcaaacaaatgtcaaacttatcaagcgatccatatacaattgcaagttccaacattccaaggaaagaacatgaggaaaatgacatgaaggaaagatctacacgagtccattaaacaccatacaatcttggatcatactctgcaagaaaaaaagggggggggggggggggggcagaggttcacatctaa

SEQ ID NO: 99898 - DNA, 1166 bp, Oryza sativa
atatctagtgcgccgtccccatccccaacctccgcctcaccgtgtggccctgcccttgcccccaacctctgtcgtgtcgcccttgcccccaatctccaccgtgccatccctgcccccaatctccagtgcgccattcctgtcccccaacctgtgccccacccatgtgcccaatcttcaccacgctatccccccccccaatctccactacgccatccccacctctgatctccagtgtgccatcctcgtccccaacctttgccttgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaagggtaatttgatcgaccgctatagtttaggaggataattcatattttttttcttttttttccattacacaaaagacgtgtatgcaccagcacaattataactatacatggtagtaaatgtttccactaacaaacgtttaaaaaaaaaggtgaaggccaaactacatgtccttgttctaactaaactttattaataatacaccgcatgtattccaatgactctacacactaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttgg

SEQ ID NO: 99899 - DNA, 894 bp, Oryza sativa
ctaaacggtgtgtttttttgcaaaaaatttctatacgaaagttactttaaaaaaatcaaattaaccctttctaaaaatagctaatacttaattaatcacgtgctaatggaccgtgccgttttctatgattactgttccggatgggagcaagaatgcccgaacacagcctaattgctctagtctagtgagatacagtatatatataactagataagcttggaacagatcttgtttgcaatttggagcaagtgagatatgcaactattcactaactgaattgtggtcctagcgagctcgggggtaaaccacaaagaaatcagaaaccacgcgaagttctatccaggcagcaaatggcgtgcatgtaatggcgatctggccagtggacagtggtcctctccaagatttctctattatatactgcacatcgatacaaatatttccttactcattgaattatttctgtaacaccggactgcgcacgatcacatgagtgacaattttgtaggctccctcgtagtgggatggcaagatcggatcagtaagacagtaatgattccaaacatagcaagtaaggcatggcattttcttgtagagaagtggtagtagggattttattagattttttttggaaattattatttattttatttgtgacttactttattatatatataactttaagcacaacttttcgttttttatatttgcaaaaaaaaattgaataagacgagtggtcaaacattgcaatcaaaaacttaaaatcccttatattatgggacggaaggagtagtttttttaaaaggtacgaattaccctcttgaactatagtagacaaccgaattaccctaaactcgtaaactcgaataccagccatttacacctcgactattaatc

SEQ ID NO: 99900 - DNA, 1331 bp, Oryza sativa
taaacaatcgatttacctattaactattaaggtttaaatcgatggacaagattcacgcatttattcttagtctttgtctctttgtcatataaacgtgtattaaagagtgtgtatttgtggacatgtggccaccatgatatgcacatatatgtgttttgtccgattgaccaaataggtaaaaaacttttatgtatgtagtttgcatgaccttggtcatgtatatatcacacgttggtagtatggctatatctacgaattagaggcccggccggtgccttaaatattgtaaaaatagaattaaaagtacagttcaccgctgtacgttgctctttatactcgatgcctattatgggtggtgtgccatgtatccgcatcagaaaagtagctagcgattaatctaatgttcttctctttagctataccttgttattagacgaacatatttcaggcttttagcataatcgccgaaggagaaaggacagcttaaaagaaattgagtgaggaagttctaaaacttgaacaaattggtttggtgtggacttaacaaaaattttagaagccctcactcattctgcacaccatactgtacaggcttgtttggtagcaacagacgcgcgtcgtggattacttgactagcgaagctagcagcatcagggacaaggttacaatacaagcgtcaaggttaagcaaacccgagaattttttttaataaaccttatgactaagctactcgacataatagaagatacatcataattcaaagtatatgtatcaattttaaacttctaaacttctcacatatgacggttgatctcagagtagagtggaactatggaccgaaacacagaagacacgtgcatacgtacaaagtaagacgagaggagagaagagcgagacctagcttgtcacacagcacgagcactaccaccagtagtatgctattacgcacgggagcatgcaactaggccagcggagcagcgcaaagacgctactcgtgtgttactaaaataccttagagtatatttattaattttggacatctaaacttgtcacacgggggttgatcttatagtagtgtggagcatggagtaaaacacatataaaatgtgtacaaacgtatgaagtatgtgcggtaagacgagacgagaggagagcagatcctgcaagtcacacgacacgagcgttaccaccagtagtacattgtacacacgcgagcagacggctaggccaacgcagaggagaggcgccactcgcgtgtcgttccctataggaaaaccctctttatcaattttggacctctaaactttcacatatatcagtttatcttacag

SEQ ID NO: 99901 - DNA, 761 bp, Oryza sativa
acaagaatcatctattttgcactttgaattatcagaattcaaactgtattgcgtcataactttatcgctatcgttcttaggccactcgggagttctgattgaatgtaacattgaattgtggtgctgaacttctgagccctcaggtgattttgcagcactagtactgccggtcatattacatggagggagaggatccaacaaataagctctcttcatatcggcatgcccatcactattctcgggttgagtctgattctcgttttctcgtccatcaactacaagtgatccatgcactatatcattctcttcacaatttatttccttcccaattttatcagctgtcttacctgcagctccagctggcttaggaacatcatcataagattgcaaaggtttgtcttcaaaagatgcctgtaaatctcaaggggtcacattttcatgttcttgcttcttaaaatcctctaaacttctccttatagcttcctgaacaagggcatcttcttctagatctcctttcggtactttagattgatcgttttcattactggaaggacctccaggaacatcacaaccaccttcttcccattttatctcatcatcagtacagaaattgtccatcagtgatgcttggtgatcctttcatcaacttgcataggaggtgtttcactttcaagtacgccttcttttgtaatgcaatcagagccatcagtctgttctgtagtgaataagttggatgaagctccagaagctaaatgcaagaa

SEQ ID NO: 99902 - DNA, 650 bp, Oryza sativa
gtctgaaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatggggtatacagtaccgaaaagaaaattatctccaccatgctcggttgcacttgcacacgagtgcagaaccgccagatcgaaagctagcgaacgtatgctgctgcgatggcaaacggccgtagtacactaggctagcaggctagcactactactctactaggcgtgccacggcctttgctacatttttctaccctggggcacacgaacatatagtagtaccctggtggtggttagattccaactttttttttcaaattttcaatttttttatcacatcaaactttgctacacacacaaactttcaacttttccgtcacatcggttcaatttctttaaacttccaattttaacatggaactaaacacaacccgaatagaatttgggatatg

SEQ ID NO: 99903 - DNA, 602 bp, Oryza sativa
ggattgctgacattccggttaaatcactcttagttaaatgaaatccaagcagaaaagcatgcctattctattttcaaaaggcagcgatttcctaaatgaaaataacttaaagacaatgaaacgaattgtcaaaaacttgctttttacagatgcctaaaatgcaaatgttgcagaacatggcaaaccagcaccagccgatccaaaaaaaatgtaaaatagaggtgaaatgctgacatcttaacaattgatgttctcaaaccgtaaaactaacttactagtaactcatttttttagggaacagaattcaatggtatccataaacatattatcacatcaaaccattctataataggataaataatagttacagtcttccagagactaacctcgtgcttattatactctctcaaaacaggaattagcagttcatcagccttttccttgctccacccaaacctttcccaacataacctgaaggaactcaacattagatcttctgttgttgcgccaaagaaaagaaatagagcatgtgtgttttttcataatcataatccttagttttgaaacagaactaacttgtgaagaaaaagatcagaacaaat

SEQ ID NO: 99904 - DNA, 570 bp, Oryza sativa
  unsure (1)..(570): unsure at all n locations
agaacacttggatttggtaagaactgtcattgagcgtgctcccaaattaaagtcagtttttttggaagatagagaaccctgtgaaggctgtgaagcaatggacaacccaatttatctttcaatatccatgtttccncagaataatgatgaaaagatcacaattgtaaagcatctcaaagccgggatgaatcgccctgttgaaataattttctgctaacaaagaatgtatttctatgctattgtgttcctgtaaaaatgataatttttttttcgttatgcgtaatgggctagtcagatacctagcttgattggtagagttatcattggcatagaccactgagcatgttctactgttcttcagtgctgaactggtcgtgatagtagttcattagccgatgaacttctcacgtagtagtagttcattagccgatctccctgatgtacaatgatacaagttgcagatccctttcaataaattatataattgtgagcatcgttcagaatctgtatataccatcctggttttgccaaatcacaagcagatactatgcaaatactttacaacatcac

SEQ ID NO: 99905 - DNA, 712 bp, Oryza sativa
gggcttccatgctaaaggagattctagcctgtgctgattcctggggtatcagccaatctaacaagagccacggttcagaatttcagaatgacaaattaaccgaaggaacaaggatcaaataacaatctcttcaggcttcactagttggaaacaagtgggtttaattccctaatgtattcttcatcactaggattctattcaacatttcaggtgctaattccagtaaaatagtgtttaaaaggcttatgataattcatctgataagaaagtgttttctagtttctgactaaagatggaagctcttgaaggaatattttgatatcatagataagaatgggcattaacttcgtaagttttgtattggattaggtatctaagtagatatcagtaaagtgaagtatgccaccactgaacctgcaagtcccagtttaagttttggtttagcagacttcacaactcttcagaagcatgcaggagtacgaattcaatgcattgatgcttgctaatatcaagaaaaggaggaactcatcactcactagagatcagtttccataaaattaatgtgatttaattttcacgtaatctgagaaatgtgaagattaccaaacaaaagaatctgatgcaaaacaacaaaagaatatgtgatagtgtgaagtcttacatgctcacatattcataatgcacatttatgcagtgtgaagatttttccatg

SEQ ID NO: 99906 - DNA, 539 bp, Oryza sativa
atacccaacaaaccccgatagaaacatacatccttatatggtttattaggcatctccatgcaagtgaatatattatttagttgcaacagaaccgaacaatagagtagtttgctaaaaatgtactagtgatcatcatacccagctcaacggaagctatcttaatccttgtttgcttaacaacacatcttagttaagtttgagatgtaaagcttaagaaaatgaacgaggcaaaccgaaaacaaataatctgaagatgcccctagctttgttctcaaacaaaagttgggattaagctagagaacaatgtaaaaatatctgaatgtaattatttgggtcgatggtactgtcaagtgtcaactgtcaagtactccagtataccaacttgtgagttggataccatctggtgtactactagtaaaaccggaagatgcttttgcagaattcaaattcaaattctccgtatttttgacttgaaacttgcagcgttgacttaccgatctactaaataaataaatggatcagatcgagaaaacagagag

SEQ ID NO: 99907 - DNA, 613 bp, Oryza sativa
tttcaccctgtcacatcgaacgtttaggcacatgcatgaagtattaaatatagaaaaaaaaactaattacacagtatgcgtgtaaattgcgagacgaatcttttaagcctaattactccatgatttgacaatgtggtgctacattaaatatttgctaatgatggataaattgggcttaataaattcgtttcacagtttataggcttattatgtaattagtttttttattagtctatatttaatattttaaattagtgtccgtatatatgttgtgacccgctaaaactttacaccactggatctaaacaccctgatatttatcttttagtaaagatgcatctaacataccaagtttttatttggatagatagaatcggagttatttgttgcaaaaatgaccaaaacaaacatccctataaactgacagtggtatattacttggttgctgatttgcatctagcatatccactgatgtgatcacttatttatcactaatcacttagaatttattttggggtaaaataaaaaagatgctctaacttcaaaattaaaatatactaactacaccttgatgtgatctcctcctggcctggtcctctcgctctctctctct

SEQ ID NO: 99908 - DNA, 662 bp, Oryza sativa
ccgccgccggtgcatgctatttcgctcaagatgcggaggtggtgcggtggttgttcgctctttggtcaatccggcaaaatatataggatcatggtggatgggtttcctctttgatttgttacgttacatatctatataaatatttaatttataatagggacgcctaatttattggcaagagcggaaatgtttgaattggcatattttggtagtgatcaatttatgtttagttaaacttgaagttgacactttatgcatagttgtagtacgtgtacacgtatttgtaagtatgtctagattttttttttatttattagctggtgtgtgtggtaactgagagtgcactcaaaacttgtgggtacaatacatgtttttttttttttacaaaaagactagcggcccggcttatattgaaagcgcccacgcaggggggggggggtgggggacgaactccttacatggatggagggagacagaaaagagcttcaagctcgatgtggggaaatgatggggtattgccggctatttataggcggcgaagggcggtggtcaatggcggtttgcagacgggaagagggagttggccttggtggcggcgacgtgagaaggaaaacgaccgcgccggctgtggcctgtgattgatcggcgacggcggcgcatac

SEQ ID NO: 99909 - DNA, 554 bp, Oryza sativa
caatttgaaataggaaatccaattggtacactagttaattcttctcgctttaaaagtataggcagatctgtgcaatcaaaaaatgtacagtcaccagaaacctgaatcacaagcgcaacattttattagctaaagaagaaatatcaccactgccatttcagctccttgcatgaggagaacaggaccaatatagcataaatgaaacatgctagtttcaagatcacagttcgatggccttcatataccaagtaatgataagtacgctatattgctacacgagttacctaacaccgtaacacgtgtttcagaatggaacactaactgtaccttttcaattttcatatcataattcaagaccaatttaaattatcatgaagcaaatatcaagtttgattcatgctgaataaaaaggtgtaagagaatttaactactcaacccttatggcacatgtgctcttcatcataactcccttaaagttttagtataacaggaatcagtaaaatgatggttaggaaatgatgtgcaaccaaaccatgaattaccactcatggtca

SEQ ID NO: 99910 - DNA, 639 bp, Oryza sativa
tatggttgcacttataatgggacggagggagttctttctattacatgtacatagcattgccttctggccattgtcgtatccgtttaatgtaatgggcagctcgtgtggctcaagtaagcgcgtacgcgcactgcatattctctcctcttgtgaactctcgccatcctcatgcacctcatcttcaaactgtactgaaaccttcattcaactcacgcacatgtactggctggctggtaaaacgtggtacaaaaaccagagaaaaacttgacattgtccgtgagaaaacaccgatctgtcgaacacgtacacgatccggccggcccgtctcgcggcggcgcgcgcacgacacgagatacgtatccgtcgttaacttccacacgcgcacgcagccgctccacgtacaggcgtacagtacgcacaaaaccaacaggtagatacccttgactatactaccttgggggtgcatgcaccggtgtagcgaccgtacgtacgtacatgcaggcgatcggagaagcaaccgcatgtgttgacgcctgcacggcacactcttcctcggctataattactcgtgttgtaccttggttgcctggccttaatcgggctttggccttaattggggttgctagtttcatcggatcc

SEQ ID NO: 99911 - DNA, 536 bp, Oryza sativa
aatatgtatctgttggggccatattttctaactttgcatgtcattcgagcaattataaaaattacgaaaaaaatacctatatagattttgtcatcgtacttgacatcacaataattaattagatctccaatgataaaaatattcatgtttcttattgtaggaaaagataagtattaatcaatcaataatttttttattctatttgtagttaataagtgtaatagttattacaaccccttaaacatgtaaaactcttacaattatatgcacacatactatctcccgttcgacaattcccttccctcctctccttgttaatttcttcctctcctaactttgaattaacagtctaataaaaaacaatatatcaataactataaagctaaatgattataattcttaagttatctccaagttttgtttgtttgaactgttgttttatgtataattaaataaataatttgagacctatattaccatgtttcactatataaaaataaaaatacatcatttcaaaacccctatcctttgcatgg

SEQ ID NO: 99912 - DNA, 620 bp, Oryza sativa
aaatgttgtgtgaaaataattgccatgtcccccacaaatcatatgattacaaaagatccctgaaatgtcaaacagtcagtgcactgcataaagttaatctaattaatccaaatcacagtctgtcatagtgtccttcaactaaattaaggttaattataactctagatatgttttcatttacttgtcattcttaacccatgttaatatttttagaagaaattttcatattttgttgaacacacatactttgttaatatgctgtattttcaaatattttatgaatcgcattgctcaaataaaattgtccaaaaagttgaatgcgaatagtgtctgctgacaagtatttaaaaaggagcatttcaacaacgatcttgctaaagccttgaaattaagtgtgacacaagtactataacatcaaccaaccatgtaagaagcacggtttacaaattaaactgtacggttgttgtcgtggttatcacgtgcggtgatcttctcagtttttgaaatatacctcgcgattaccgcggtaactgtcaaaccatggggtgacggtacccacgtcctacatggtttggtaaatcctgaccaaatttaagagtaatgttctttaaaaaaaaagg

SEQ ID NO: 99913 - DNA, 1790 bp, Oryza sativa
  unsure (1)..(1790): unsure at all n locations
ggcgaattcgagctcggtacccgataaatcaaatcacaataaaataaatgataattacataaattttttaaataagacgaaatgttaaatgtttgttaaaaagtcaacggcgtcatacattaaaatacggagggagtagtttgcatcatcaacatcacaatcagatataaggagtattgtaagcccagtagtgttaactttgcgatatttttgtctcgttttttgtcactaataacctgacttattacccaagtttacagtgtttatggaccattgtgttaggccttgatcgaggagtaatttagcgagggcgacagccactagcaaactatccggcccagcccattagaccgcaattccagggatggatttcgaactcggggacaagttgagggatcgaaagttaacttattccaaaccgtaatactcgcacgggctttaacgctgtttgggccacggcccaaacatatcccctggtgggtgcgactaccacccatttcagcagcaactccggcgatcgatgccggttgccctagccgccgccgccgtcgcccgctgtaatttccctctccatcctggctctacgttcgccggatcgatgctctagcggcttagcggacaggtattagttcgttttttttttgtcctttcctgggcgtgttttaaattcatcttttgctgctggttttcattttttagaatatatgcatcgatgctctctgcgagttctgcaagaaaacacaagagagaagaagcaacgatcttcttctgtattcaaagcgatagaagtcaatggaatctcccttcttttcttggtttccgaggataaatttcataggttttcataagcgactgcatgcaaagagcttagcggatttctttaatatatctccgagtctgtcatgttgcctcacaaaactctttctatctacgacaatgttttttgaagcagatctgtgtcaactactaatcagctgtgaccagttgcagcaactaattctgcatctttgtaaacttccggattcgtcaaagctgaagttggatatgccaaattcaaaactccgcctcgttgactctattcgtgcagtatcaagactgtagaggttctctgcctccctaaactagagcatctattatgtgaatcttggttcttttcaagttgcccctttatcttttggtgtgattccatgtcttgaggggttaaagcttgtttgtgctgcgtatagtaatcaatcagggttcaattgactngatcttatgtgcggtgcttcaaatgtaaaggatcttactttggatttccaaggagaggaggcaagttattttattacatgcanaatcatcgtatttactgtcatgtggtggtggctgatagccacatgtttatatgcaatttagactgaaactgaaagagcattttaaaagcaccttttatgtgattagatgttgatggcaactactgtttaacttctttctcttgatcaaatttcaaatatgtaatacatgctctcagattatcttttagagtatatttgtgttattactatcgcgactagggttattgagtacataatgattggactgattaagagatttttgtgcttacaattaattccttgtttattttgttaattttgcatagatttggattaaatttcaaggaaaagaactacgcaccgccttgaacaagataacaaagttgcttctgcatggcatctatgtgaaattttttgacgactcacacgagacggtgcgaagttctattgatagagcaggaaaaaaaagtataagat

SEQ ID NO: 99914 - DNA, 673 bp, Oryza sativa
catgtgtagagataagaaggcttgtagggcccgggagggatacgacatatgtggagcacgagccagcgttgtgcattgccctcgcccccgggatctttctcctttacctcccgatcgattcggtcggcaagccgtgtggctgaaggtgtaaatcagtcaaaagcttttggcatatggtgtgtgtgtgtgtatatgttctttgcaaatattgggtaaaaattcctgtgcccacgggcttactctaacctcaccggaaaagaagaagaagaaaacaaattgacgacgacaacaatagacataccataacccatgatatgggtttggaagtacaaaatttggacaatgcgattgcaagatccaaacaggaacttcaatcaaattgatctaaacaaaacgaaatcgtgatgacgatatcgtagttttgtttgctagcactgacgattgacgaacaatttgcctattggttcttaagattaaacaaaaaaaaaagggggccacctagttggggtttggaaggtagcactagctgggcaaagcttggagaagcatcagcacgcgaagctacacgccaatacatgatgatcgatcagaaggacttcggttggatcacagaaacaaatatttttggcttatctttggatgaagctgtgtgaaggtgcgacccagcaacaaa

SEQ ID NO: 99915 - DNA, 837 bp, Oryza sativa
agcccattagccggtcttcctgaatccacagcaataatctgatcgatgatctgaatcaaacatgactcttgtttctctcatagcccattagctggtctacctgcatccaccgcaataatctgcttgataatctgaatcaaacagggcacatgttgccttgatttaccttataaacttgcacttcgtttacagtttaaatttggcttgagagagagcttatcttgaggttctgtacagattttttgtgatactacatatgccaaaaaactcgtgtcttgagactctgcacagatatgtccatgcattatattcccaaaatcgacgtcgaggcaccttgtttaagccatggcacaatattttccaggactatgattacccaaaattttgacaaactaacccttttaaaagaattgtattttaaaaaaatgaatcgtgccaaaaactaattgaagaaatgaatcgttgtcttgatggtgcttaactataacgttttagcgctacaaatataggcactgaatggcacggttcattattaaaaataactttttataaggatcattgtggcaaaatttcagctaagactacctttgtcactacaagattcatgcggtcatagtttcatgcagggcggatccaggaacaaaaaaattggaggggctcagttacatagtatcttcaatctctagccatttaagaacctttactttatcattcacggtgaaaaaatcgaggggggagtgttccgggggtatccatagattttatgggtgcaggggggaccacgttggatccgcccctggtttcatgtcaatatgccatgctttcaagctatgcaca

SEQ ID NO: 99916 - DNA, 692 bp, Oryza sativa
ttaatagatgtcactatactaaaatttttaaaaacatttataaaaccatttcaatttaagagaaaaattgtttacgtgtctataaatttttctcagtccttatgtatactgaatttttccacattccctacatgcccttgcatttatattttatattttgatcccctctatatagaacttaactttgttagttcactgtgtgttgacaattttaatttttttttttcaaaaggctgtatcgccccatatctcgtgctcacgtacttagcttacttaagaaacataaatctaaatgtgagaaacataattcatgaaaaaccaaagatttaaatgaattgggacaattatttggtaccaaatttgaaaaatacttttaaattttcgagctacttttttcaaaaaaaattaaaagattaaatccataaaatattttcacatagaaagtgaaaaccaaaaaatattttttattttggtttaaattttgttgaaaatgatgtacaaatttcatttagtttttgttctaaaaattaaattttcatttaatttatggtgaaagtattctatccccatgctttattacaaatatattttttacgacatgtaagcgatgaggtaaaatttagagacataaaatgggctgacgggaaaatattctatccctatgctttattacaaggtaccgagctcgaatt

SEQ ID NO: 99917 - DNA, 629 bp, Oryza sativa
taatgatagcaagaaaaaactagaatatacacattaaatgagatttggttatgggtgattggataatatattggtggttaaaataggtagaaatttgaattagtgtttatggatgtgacaaatagtacaccaaaattatttatattataaaataaataaaagaaagaaaatcttttatattacggtacagaggccacgattacttatcttaggcaccatgtcaattaatctttggtctacctctcatgtttagagttactttacatatgccatttcttctgtgtgtgatagtcgagaatgttggcgttcgtgcacatatgcaacaatccttttatttgatctggaaatttagctgggtgccctagctatatatgtgcaaaggtcggagttgaaatatatttttcattacaggaaatgcaaaaatcttgcacagtacacactgtatagaggaagttccatttatgtaaacattggcgatgccaagttcaaaaccaactatactaccaaataatacactgcctgtccatttaaatgccttggaacaaactcaagtacatcacatgtggctgcatgcgctcccctcttcagtcctatacgtatatttgaagggttcagtgctacgtttatat

SEQ ID NO: 99918 - DNA, 565 bp, Oryza sativa
tctttggctgagatccctccggtgaccgatgccggccgatacccgattcgattgccctggccgcgcgcggccgctattgaaaaccgatacgtcacgtcacctaacacgtggggtacaccgtacacccagaaaaccgatgcactgtccgtctatatggcggatgcgggcacacggtgcgcggcgaccttagcggagggtttttccggcagaacgtcgcactgcttctgcggcgtctggggtaccgcgtagctatataggctggcccatctggatcattagcacagcattagtcacatggcttcgagtacctttagcaccgggcctcttagctgacgcaaatgattaatgatttataactattcttcaccacaagaaactagagcaacacagatttaactttcatttatgagattcaaactttgtattctgtccgaagctacaagaaatatgatcatcaatagtttgattccacatgctatgggtaaaatatacgagtagtaatcataaggatgcttcaaggcatcgtatgctttggccgagtctagaccacgtcaaaaaaaaatac

SEQ ID NO: 99919 - DNA, 933 bp, Oryza sativa
atattagaatgtgtcacattcatccacaattctttatatttttggaatgaagagaggagtaatttctacagtagtactgtacttctgagcaatattattgtcactgaaatacttcgaactcccttttctttctctctttctctctctctcttgtttttcttgagcaatctgttcgatctggtacgattgcaaatcctgtccatcacgatcacatgtttgatttcaggtcccatatcccgtcaagatcgaaccatttcagccctcagggactttggaatctcagagtatctttaatatttattacaaaactactaactccgtcctttgagtttttatttgtaacttttagccattcgtcttattcaaaaatatggaattattttttttgacttactttattattaaaaaatactttaagtatgtcttatcttttttatatttgcactaatttctaaataaaatgaatggtcaaatgttgtaagaaaaagttaaagcgaccactaacttaagacggaggtagcatatagtaaaacgaagccttgttgattaagtagtaatagtagtttagagagacacgtaccataatgtatttatgttagataataagttgggattcatctaaaattttctttcaaacatgaatcataccacaattaaaatgatagatgagacccaccatatataaaaatgctaatacctgatagtagtagtttataccatttttataatgtatcttaccttatactccctctgtttcacaatataatgtattttgagtttttgcttacaatgtttaactactcatcctatttaaattttttttgcaaatataaaaaacgaaaagttgtgcttaaagtactatagataataaagtaagtctcaaataaaataaataataatttaaaaaaatttgaataagacaagtggtcaaac

SEQ ID NO: 99920 - DNA, 848 bp, Oryza sativa
  unsure (1)..(848): unsure at all n locations
ccagcaattttattaacatttgcaggattggcgggataagaaatgtgacgcaataggtcgtttaaatttcaactcaaccgtaggcagtggccgcccttaaattagaaagatttctaaagcatgcgcaaattgatcctattatattatatcaatgtgtttttggttatgaaaattttctttgtgattcatcaaaacaagtcaaatttctattgtgcatccagctagctagtctaagtttgtcgggtggtggatccgccttgatacgaggttttgtgaacctgagaactcatatactctaagaggttttatttgaagtttttatggttccgtgacaagatgatttttcggctctgataaggtttacctcttctagtgccatacttacttttggttggcacataacacattaatctatacattgtgtttccataaatcatgtgcaattgatagttcaattcgatcttattatttttgtaaagatatccctatctatcaaaatagcaacataattaccaccataagcatagtttggtgacccactacttcaagagtatggacaaaatattttgtcatattacttctaaaatccacacaactatcattgttcaaaaaaaaatcgctatatgtaataaactttatatcaaagtggttatttttcattaatgaagtgcacgttttctaaataaagcccattaaacaatggacactcagtaatgacttaaaactattagaacatattttgatactttaggaatcaaaatctaacaaaaacaagttcaaattcagttcaaacttgctttaaacgggtaccgagctnggattggtgctatntggtagtaggtgataat

SEQ ID NO: 99921 - DNA, 833 bp, Oryza sativa
  unsure (1)..(833): unsure at all n locations
agcccaccttctgcctttacaaaaagtggtccaacatattaaaaatatcatcaatatcccacccacccaatttaaattttaagttaacccaagtgaatacatgtccggtgctcaattaccggagcacggctattcaataatttggtttactcccctgcagtgaatgtcactttaccacaactcaggaattgccaacacatgagcttggtcccaacacatgagacgcgtcacggcaaagcttttcgataacctcgcattgtcagtaccagctccatgaacttacatccttcatgcactctaggcgtacacggtttctagcagtaagaggagttctggcgcacccggaaagaaaagactcacacatgcattaagttataattaggtttaaattctcacatggcagtcctaccgatggcgacaccactgtagacacccgcctcgcggttctaccaatggctgccccaccgtagagcccctgtctcacacatcaagaaaccactatgcatggatactgcctccgctcagctatctattccgctaggtctatacccatacaagaagtgcggttgtacgagggtcatttcatgcttaacttcatggctcggtccttaattgaccggggacggtactagccttttccgaataccacccaaatcctccgtccgccccagtcaaaaacagttgttacattttatttctcctttcacaaattatgtcatcaacatcatggcaatgtggcgctcatgtctccacatgccgcatctcaattaccttcccaaaggtaatgggtaccgagctcganttcgccgttggttagtagatgtcagccacct

SEQ ID NO: 99922 - DNA, 1737 bp, Oryza sativa
tgaagggatccccgtgacaaatcttaaaatattataaaattataatggactcaatataaataggcgaattataggatatattcccaccattctaaaaagagctaaccttttgttcagattcattgtactaggaggggtcatattttctcttagattgtttttttttggacggagggagtatttttaaactagagaatttataatgttggtatggatccttaaagtttttctaaagcaaacgcacatactacaaactgccaccgcttttgtatccgatatctgtctgtattcacgtacaagccaactctgaaatctggactatcgcaattctcaatgcttacataataaggactataattccttttcttctgaatacaaacgccatgtttgttagctgcggctatattgccatccatcatcaacaagctagtccaaaacatacgcaccattgttttgttttcttattgacgggactgattcctcttctcgtcaatcgtgtactgacgccaagactttcatacgttggcacggtgaagttcctttgctacggcggcgcgcgacgccggaaggaaaacggaatcgccctaatctaaacggctgtcccgccacctgatccaacgaggctacgacgtgcacggtacatggaaccaattgcctgctagcccctgtcctccgcgagggtggagagtgggacaacttcgcggctgcagtttcctcgccgttgccgtaaaaagaacttccatggaggaatagctccctagctcgccgcagggacgagaggtgaacgaacgagggaagaacacgggttgttgcacgccacgattccccggatttccagactacaaagtcggatactcgccggggtcaggcccggagccccggactgatggtgttgggcttctgacgtattgctgaggcccatcttatgtcgctgcgtcgaagactgcttcacatgaggaataagttcactttacctcccttaattcgctgcgtcgaagacaaatgggcccacatgtttttttaattgtaatgtcacctaagcgtcatgtccatgccatgtggcataaagaacaggtcaacacagacgcggcttgcctgctcccctacagtgctcccatccgtgctcccgatgcatcggacggctttgtttctccagcggtgggtcctgcagcttcttctgtagtcttccgaatcagcgatgatgtttttccaaaagaaaaaaaaaatcttcaacgaaaagagaaggctatgaggtattggggtatggcagacgataagattagtgtatgctataactattccttaatgatccattccattcttttcctaccaaagaaaccaaaggtaatgacctcagatatgaggggaaggcatctctacgacctgttctatctaatactattggaatctggagtcatattgaacatgcatgacgtacaaaatatcctaataatctgttgcacaatgttaattacaacaataatcaaggtcaaatcaacaatcaacacttgatcctcagcgttgatgatatgatctatcgctttgccgaagaaaataagaaatcttgccgctgctgatctccattctgactcctcatgacacacgtcacacacctccgtagtctattccaagtttccaacaaatttcttcattcctcgctgaattgtctgtgattcctttgattcagttattttgatgaaagaggccgaacgtgataaaaaggtaaagatgcaatgc

SEQ ID NO: 99923 - DNA, 512 bp, Oryza sativa
attttgagtatttgaccgtactgttgtgcatagttcgaatatataactgtttgtatttgtaaatgatttcatgacttattctttacttaaaatttaagtatgatcctctctttctttattcagtcctaatggatgaatgaagacagtgatatcacattttttatgatatattttgtaatttgtgactttcttatacgattgacaaattatcaatttcacaaatatttttagctgattttataattaaggtacacaatttctgtcctttttctcaacactttcttttagtataatgccctcaatgggagaatcgatgtttaggatacacaataatctgcataatactagtgttagctcaccagccgatctcattagagatgagagtgacaaatccttaattgacacttataagagtggcaattagtaaaatatccccacgcttagaagcatcgggtaggccatcgaatcaattcttttttccaaaaagttgatttgtatgaatgttaatttcg

SEQ ID NO: 99924 - DNA, 843 bp, Oryza sativa
  unsure (1)..(843): unsure at all n locations
cgggattaaacttcatagcacaggccaattcnagctcggtacccttacaatgaacgtaatgttgtagctggatcatagatcaaataaataatttaagagaattttctaagaagaaaaaaagcacgcataacctaatagaaaaaaaaacttgcatgtctgtagacgtgtagtagtacttctctcacatatggctggcgtcgctcgttaagcctaaatcgagaggcccctcgaagtagattttgtgaaattaataaccatgtgtttggtttggaatgggataagttaggtcatcataggttgcccatatttcctaataagacaaaaacggtttattaggaaataaaaattaatttgcagttaaaacttttatgtgtttttagtgataagtcaatgctgaaaaagaagctatgtgataatatcctaaaatcaacttgaaattaaatttgaaattcaaattttgccttttttttttcctttggtttattagagcaaccaatggggtatttaggtaaggatgaattttttatggcgtttgattcgggacagataaggtgggatgatcactaaaaggaaaatattattccctcaaaatctangttagctccatacgactaatcaatttaacacacttgctctttatcattagcatacaaaccacactcttntaacagcattcttaagaaatatgacaattntattctttcattgcaaaaaacacatgaatactacgatctttctctactctcactgtgggattttcttctttctttttggtgcccatcctttaatttattattgcctttttgggtggntgnggaaggaaaaaaagatgatgagtgggtt

SEQ ID NO: 99925 - DNA, 1218 bp, Oryza sativa
  unsure (1)..(1218): unsure at all n locations
atagagcagagtagagtatctttgatatgatatatacaataagatcatgtttggcttgttgacatcaaacatgctaanagtccagaaaacacaaacacacattcagcaacatgtcaatacttagctatgtgtttgtttaaagtttaaactgtccaatgttgttgatctgttaacacatctatcaaacagaccatgtcataggagggtatataaaaacataaaacatatacaataaaaaaaataatcaggcagctaaagctaaactgccaaacttacaatggtcatctaaagcctgcaaatttgctcttttggggagaagacttggcaataaagatctaaatatcatcattcagcacagtttaactaagaaacctactgaagtggagatgtgcaatgaatcaaccattttcagaatgcatataagacaacttagagcatgaaggtcaaggcaggaagctcaacactcagggtgtagatttaggatgttttggttatgacagagtagcttctgcaattaagataatccaggggttaagataatccagtagataccctcgctcctccctactcccacactcagtacgctgcactcagcactaaaattacaaattttacgacactttgtagaactatctttcttcaatactggctctagtacatggatgcctctagtacattgctcatggatgactgcagtacattgccatatactgtttccattcctcaaaactgcggtaaaataaagatgtctttgttttgtagtgagcatgacaagaataaatggctaattgtccttttgtggagacacatacaatctacaaacttatgagcatgcataagtaaaatagcaaaaaacatttccgtcactttgtacttatcaaaaacagtccgatgataacattacgaacccatttcagacacagaaaaaatcatgtgtgaaatgaattaatctacggtgaaattgatataaaattcatgcattcgaacaaaacactaaattattgttcttgttgacattataagatatgctagcaacaaccattttgatgtgactctatcgagaagagatggtatgtatagctttgctttgtacaatgcatccgagtattgtactactgaagcaaagccgcagatcaagctaagaatcatggtattgaaacagtcatagtaataataatacaaggcgcacataaaaattatcttgagaaaacgtatatt

SEQ ID NO: 99926 - DNA, 829 bp, Oryza sativa
  unsure (1)..(829): unsure at all n locations
gtgatctancctgttaggaccaacgcgagctcggtacccggcctcacctcggatggcgcgaagcgaacgctcgatcgccgctccatttctcgccgccggcgaggtcttcgtcgccggaagaacggggaagacgccctgctcgcaacttgcagcaaagagtagaaaagaaaatgaaaaggaaaaagaaaaaaaaattaaaagagaagtaggggaagtggttgagtgggccccaccagataatggccaaagaagggactggttggtgggcccaggaatcatcctgccatgccagacactgacaggtttctcaggacagattggaagcctgtttggaattctggccctctttagggtgtgtttagttaaagtttagttgaaattggaacgatacgatggaaaaattaaagtttatgaccgagtttagttcaattggaagtttgaagaaaaaaattggaactaaactcggcctaagatttcaacttttttcttcaaacttctaaattttccgtcacatcaaactttcttacccacacgaacttctaantttttcgtcacattggttccaatttctttaaacttttcaatttagcgtggaattaaacacagccaaaattgggagtttgatttatattggatctatgccactataaatttgtttgtttagaaaaatacactacaattcaccctatatgaaaagggaaatgctgaacactggtataacgtcccgacgggatggatagacacaaccaatccactcttttctactagctatttttctacaacattttttacacgtgctgttgactaagtaacaccagctccgcggggt

SEQ ID NO: 99927 - DNA, 819 bp, Oryza sativa
ctcggtaccccctttaactggcataactgcatttttcgatcaatcacaaataaagatataaaattataattgttgtggtagctagagtcaaaagctgaccttaaccaaatgtgtcattttggatatgtattgggagtgaaaacataaagtaaacatcgattgtgccaatatatagcccgaggggcattgtatgtatgtacatacgtacaccatcggccaacatccacccacctgcgcctcattcatcccctctcccaatgtactgtctctcatgttttcatcatatattagtcaggaaccctaatttattataatgttttaaaataaatagctattttttatcgacttatgttgttggaccattattaactatattcgaacttcttaaataaatatgttattttttattacattctgactattttcatatcatttaaataattattagaaaatatgaaaaaaaaccaatgatatatactttacctgttgaaaatatttttggtgaattttttttacatctatgtaaaatgtacgaattattactattgaaataccaacccaaacagtttcaaaaatttcaaaaatgattggagaatgttaatatcacacaaattaaaaatttaaattgggtctacttaaaaaacacaactaaaatacatggtttgcatttttacatagtcaaaataccgtggttatttgttaagtaaaatttgatcccttaaggatatacgttgatgcgggttttttttgtgaaaaattggtatggagtaaattaaatcatgtctatgttattttgccgcaatgtattttaaatacaat

SEQ ID NO: 99928 - DNA, 703 bp, Oryza sativa
gctcggtacccctctgccttcgccactggtcgctcgtacgggtggatgcattgcatggtggccacttgtacatgtcagtttcagcacacgcacccatgccaataatgccgacaattagcctctcaacgttcgaaaaccagccgagtcgagtcgagcccactttggcaccttgcttccaccacacacacacacacacacacaaacaaccaaacaaacccaaaaaaaaaaaacagagagagagagagagagagaccatggtaacacagccaaacaggccacgttactactagtagtaggtaccaaccggcccagcagaaatatctcccggaatccaccggcggagaacgtgacactccctcggcgtctactgaaattcaccgcgaaaaactaggcaaaaatccggtcgccgctcgctaggcgcttggctccggctctggcgccgatcgatcgagagctccgatcctagccaatgcgaggccacgtcagccgcctcatcattcacaaaaaaaaaaaaagaaaaaaaaagaaaagaagagtaaaccgtactttgcacaggcagattgtgtcttgtttcactttgcatcaggtttaccatataattttactttacatcaggctggattgaaataagttcataaaattgaaggaaaatcttgtgaaatccaaatgaaacctgggtaccgagctcgaattcgccgtatag

SEQ ID NO: 99929 - DNA, 507 bp, Oryza sativa
ccttcgtatttctaccaccattctcatcccttcttctcttgttacacattttagcaaaggggcagtgactccgctcttgtacagctgcccttctatcaccttgtacttccttgacattaactgtattcttcttgcttcttcttccttttctggaagttgttcactaaccagatacttcagaattggctctctccaatctatctcgccttgtatgtttgccacttctcttttctcataacttggttgaattaacacatcaaagaatgaattctccaatggttggcttgtggcagctgcttttgcaagctcatcggcttccccattttattctcttgttatagcttttactgtatcccaaggaagtgtttttcattcagccttgcttcttccaagtactttgtcattgctcttcttttgcttcaaatgtcttggaaaagtgacctgccaccagctttgaatcgttttgattatcaatcgtcgagcccctagtgctcttgcctttctcat

SEQ ID NO: 99930 - DNA, 3785 bp, Oryza sativa
cgtcgtagcaatcggtcgtgggggcgcatggatccagctcccccgcccttgggatcagcagcggcttaaggggtgtgctggcacgcagattctagagggggattctgacgcccccgccttcgggagcggcggaggtgccgtcggccgcggatccaacaccactgccagcagcagcagcagcccgtgcggtggcccactgccatcgccacgccagtcgcctctcctaccctctccatccagccgtgtggcttgggaagaaaagagaagaaataagaggtcgactgtcatgtgggtcccacattcttttttttttactagatgccacggcagtgaaaccaaacatctatactgccaggtgaagatttctagtatagggacgacaggtgaacttatttcccccaaatggcatcaagatgatattgcaaagtccagcccatcacagatgggcttactttcctggctcactagattctctccgtttcccgcatcttgcagatagcatccgaccaagtttaaggtcatgttaactagttgcacggccctttgggccggaaatttgcataggcttaacatcctaagaaatacaaaataggcactagcatagtttccttctcattgctaacgctaaacgtatacttgttcgaaaaaaaaatgctaaatatatacaatgaacttaaacaaatcctttttggcaccggatcagggcacatgagctgtggagtcatgacacccaaaaccggattcttcttgtgtcagaagcctgcctagagcatctacattgcaggataatatgcggcgtcggacactgatgtgatttctgtccacttctttttctccaagctccaatagctttacagtacaaagctcacaatctttctttcaggattcagaaaagtagcagctatcttctctcagaagtagttctgcagagcaatcgcattcttaaaccagtagattgccgtggcacaagaactgatttgttcgctgccaggaccattttctgtaatgcagcagtaaccaagcaagtggtgcacttccggaacaaaaggctctctgtctctgtaacatcgacagggatgtccatgtacgtttttacacaattgttctataccatcttactaccactactagtacctaccattacccattgcagttggtgttgtgtatgaatcacgagtcgttttctttcggctaaagtatttggcagtacgagtcacaagtgctactttgattccacctatctaatgagaccagcaaagcaaagattcttgggggatgtcaggtactcttttatgggcatcctttgagttggatctccaaaagaaagccctgcacactgcagtgctgtgcatttcgcatgcaagtacaacagcggcggctgagctgagagggggcggaaattggcacgaggagcgcctttcgcgcgcaaaacattctcgaagtgacgctggtgcacgacgaacatgcaatccactcgtggcggtgcctgccctaacctcacgcaacggcagccagccggccacagaaagatacttctcctcgttcatgagatgtcagatggataaattagattaggccaatcaatcatggtacgagtactaaaataacaatggccagcaaagtacatagttgcagggatttcaggcaggctgccggcactgctaactctcaggtcatggtggaggcatgggccctttttatattcactcatctgatccagtgatcgaccacaccaccggccaccaccgtgatcgatctgcagccgcagctgctgcctgcctgcgccgtgtcgtcccttcatgctttatacccctactctctctcccggtccctggctccctgccgtggttgttcgtctggacgggatggcccagatagcccctgaggcagctgatcagcaagagatcgatgaatcatcaatcgaacagagaacgtatcgtactatcgccacagttagtcgctcataggcgccagcagaattgaaagagccttccatgtcacgcacgcagatgcatgggaacgtgggacgaggtgtcaaatcaggcaggtagttggattaattccacttgggaaacctggctgtcagatctggatgcagcccggcggtgattggatttagtctcgctgtgctcgtacatatatacagctgctactgcatagccatctggtccccgtgtacgtacgcgcacaggctaagtaaccttcccgtggtgcccggtagaacgccgcctaccacgtaccggctgagatgagatagttcgacgcggcggtaaagcaaggccgcggcaataaatggcacgtaaatagccgcaacacggcagcacgagccgcgattgctgaattccggcgagatttcacgtgccccgcgctagcgatcgagctgtcgacccaggcacgcgtggccggtggccggcatctctagctagctgagtcgggtacaaactaggaaaagtcccgcgcgcgtggggggcgccggatgccggacgggcgcagttctaattcgtcggcgcggccgtaagacacaataaaagcgcgcggttagttcatcccggttgcgcgtgtgatgggtagccgatcgctcgagcggattacgcatgatgggttacgctacgagctagtagtatatatgagcatattcgccagtgtttgtgtgggaggggttgattactgcggcggcggcgcagcgtcgtgcgacggcaaataatgaacgtgtcacgctttatgtggagcttgacagttgcaaccaactaaccaactggtggccttagctcgtgggcaggaggagatgggggcgtagtggtgccgtataactccacacacacacatccgtatatatgtacatcaatacagtacatacgtatctctcatccatgtccgatacagcttgcagacgcgaaatacaggtgagcagtacttactactctagctgctagtaggatcgatcgagtatcgtggtaatcataatgcacaacgtggcgtctttacacacgggatgggcacatggttatattccccccgggtggatcaatcgatccctcctccatctcttttgtgcgcaacgctgctgctcctcttcgatcatgagcttagcttgtgacggatcgatcgatgatgtgattgtgttaaggtattaattccccgttggattcccccccggatgtgtatgctgcacagtgcgcgtggtgatgctcgcgccctagctatagctcaagcgttttggcgcgcgctgcagggccgagggaccaccgcgcgcgcggccggcgtcatgtgacgctacttgcgtgaacagtagctccaccccagctcatctgtcctggagatgttggggtgaatggccgaggcggcgacgcaccacattttggtagagtagtgattgtgcgacgaccactacacgcgcgcgtaacgtcgtacgtatacaaccggtaactccgtgttttacgtcctcgcggcgtcaccgatcggttagcgcggccgggccacgccgaacgtgtgtactcacgatttcacgtcacgtcacatgccactgcctgcctaccaggagcccaggacgagtactgacgaacgaacgggtgactggatcagtgccgatcggagcagtgcctcagtggggcgtacgtgcatatgcgttcgatcgatccggccggtgacttcgatcgaatcgccagtaatcaagcaagggagccaacgacgacggcgacagtgtcgtcgatcgccccgcgctgtagggatacagtttgttcggatcgcagctccgtgatatacgtgtgtacgtgccgtcaactcgg

SEQ ID NO: 99931 - DNA, 823 bp, Oryza sativa
  unsure (1)..(823): unsure at all n locations
acgcacggaagatncgttncanacannatgcgaccaancccagctcggtaccctaagaccatcaactcacatgaataagttcttatcgatttgcatgcctacaaagaacaccgatcttgcaattgaattatactgcatgcagattgtgcacactggattctgcagtgcacgctagactctacagattgaattaaccatgatactaaaattataccatatgtaggctgtagaaatgcagggctagaaaagaattatgtgatgaaacagatatattttatattggtatagatgcagataagttaatccattgaggatctgccttgtataggaagagaccattgattcccatgccatattaacattatcaagtactccctccgttttataatgtaagtcattctagccctgcgctttttctgtactcctctagagtaacttttggataaatggtgaaaccaacagttgcgtcttgcgtgccctgtggatacttgagtgcacaatcgggttccggataaaagataaacatgttcgagggtcttagtggctaacaaaacgttggaccacaactaaagggaagatggtctcggtgacagtgcgcgaattgcccatagtgagacgtatacaaaaccctggtcgttgtatcacacaaccacaccgtttacacatttttttaagaattattctttattgtttctgcgcaaaaaaaaggaacctcaattttcttaactttacatggggatgatatgcctctttattaggacccgtcataatataaaatgaacttcaagcgtgttggatatgaaaaaaaaacatgcgggcaact

SEQ ID NO: 99932 - DNA, 2882 bp, Oryza sativa
tgtctctgaaggttgacatttaccgaatggtaccgtagcgtcagcgcacgggtaagttactagtgtgaacaattcgatgggaatacgggattgaccatgtgtcatcatctgcattactgcagggagaatcaacatacgtgtccgatctgcgttcgtcgtcttcaaggtgatgggtcgaatgcgcatgcttcagccgttcaccgccagggaatatgccgcgcgcgttctgatacgattcattttcttgtggacagatgagttctcaacgtataaaccttcgcccccctcaggccttccagtaggacgtaactacacagcgctaccacttcatctataaatctataagagcacaccatctacctatatttcaaatacaattttcttttaaactactcatccaatctacgatccgattgcaccgttgtattcgtaacaattaaatctttacaacaagatctcacatgattatattttgataaaaatcacaaattacttttatgatatgtctaaattacttttaaatatcactaagttacttcttagatatataaaagtaaattcagtaaaacctaaaagtaatttacatatatattatagaagtaacttagaacaaaacgaaaataactttggtatgtcatttgaagtaaatccgttgtaaagataaaaacatgactatatctagaaattaaattaatcagcacaaattatatatacgcataatccgttgatccgaggtttaaatctgcatcttggactcttgataccgtgcattcatttgttcattcagccattcagaccctagtcagagcctgctattctggttggcgcggcaggcggagcatgtggcgcgtgtcctttcctttcagcccctctcacgcagcgactagtcaaacaacagtgggtccaaactccaaaaaggctgcatgccttcatgggccccaggccggtatgtgggaataagtttattttatgttcctccgtttgttgtccccgagtctgaaaattatccctggacagcaaaacaacataaagtatccccaacttacaaaagcaggccaacaagatccctcggcagcattgtccttagttttaactgacgtggcacctgcgttggtccttttactaggttttcgtcccatgtggcattgatatggcgtttacgtggtaattcgatccagaaaaataataaaaccatcgaccctatcaattacacataaaataattaaaaatggtggggccatatggtccctctccctcatgtcatccttactcctcctctcttctctctatcctctctctctctctctctctctcccatgctaggagcgaagcggagcaggcggggcggtgccgggcgaagcgggcaggcctctaaggaggttgagcgcagaggatgtccccgtcgtcgtcaactgctgtcgcacctgccatagctgcacactcgtcggtggccgctcgagctcctccatcattgctaccccctcctccgctcgctgcccaccccgcacaagggagaggagcaccacgcggggcaacaacgggggagaggaacgctgcaccacggccagtgggagagaggagtggttgctctcctttccctaccagatccccgtccccttagctctagctccaccaagctccaccagaagccgcccgacaaaggggcagagaggaaggaggctcaacggcctctccgctcccctcaacctccccgtctcctcctgtccctagctattgcctcaccgacctccccgcctctccctctctgccattagatgaagacatgaggagataaggtagagagtgtgagttggaggaagtgggttccactgacatgtgggtcctacttttttttactgacatacgggtcctgtttgttttgtttaatttttttgggcctgtttagattgtagccaaaataaaccttaccaaattttggtaatgccaaaatttaggcaagataccaatatgccaaattttaatgtatttaccaaatttggcaacaaactaaacgcatacattttttggcaactttgtccagaaatggtatggttgaaaatggcatcaatctgaacagccccttggttttcaatttttcttttttttttatcaaactaccacgtaaccgtcatgttaataccatgtgggacgaagttctaatcaaataagccacgtagacgtcacgtcaaccaaactcggggacaatactatcgagttgcccggattttgtaagctggaggacgggttgtatttttttttgtttgaggacgaaaatcagatagaacaacaaatttgagggacctaaagtgaactcatttggtgtgtggacatgtggcttgttttgccgtggtgggctgatgcgatcatgcgaaggaataaggttaatctgaacaatactagatatcttcaccacttaactattaaaaccggtgtaatgtgacttcctcaatggtttttaaatggtggttttgctgacgtggtgtctatgtggtggtgttgaccggacgcggcttgcctgctcccctacagtgctcccatccgtgctcccgatgcatcggacggctttgtttctccagcggtgggtcctgcagcttcttttgtagccttccaaatcagcgatgatgtttttccaaaagaaaaaaaatcttcaacgaaaagagaaggctatgaggtattggggtatggcggacgacaagattagtgtatgctataactattccttaatgatccatttcattcttttcctaccaaagaaaccaaaggtaatgacctcagatatgaggggaaggcatctctacgacctgttctatctaatactattggaatctggagtcatattgaacatgcatgacgtacaaaatatcctaataatctgttgcaca

SEQ ID NO: 99933 - DNA, 846 bp, Oryza sativa
  unsure (1)..(846): unsure at all n locations
ccgcgtgatgactgacnatccctgccaannnncacctcnagctctgtaccctcataatgaaaccacgcgcagatggaagttcgtatctgctgaggacatcttattcagacccagactaccattctcatgtcaccacaggtcatctagtggtgattcaacactctgaacaacttcaccatcatcaagtatatgtaatgctcggaccatctcgaccagacatcattggagcgctatccctgagcaagcccaactgcaaacttttggtcataaccgctggccctcaccaccacatgctggccttatgtgacctggagctgctcgacaaggatgccaccccattctggtcaccaaggataagaagagcgctacagcgtacaaaggcaaaattaccgagcaatgtgtgggtctagagtctagaccaaatgattgaaaaaaagactggaaagggcaaaaatagaatagatcctctcttcacaagggcattagaatgattatatatagttgagtggccttttgggcatgtcagcctctgcaatggtaaatgtcaaagttttacctacaataaaaagggttagaacaccctgtagggttgtacactgtgggactcacttaaattcttctgcgagcttccggcagaaaatttcattcagacttgttctttttatgtgtaacacacttcttcattctttgcaatttgaccaggaagtatttagggtaccttggaagatgcaaactagcataagacaaaattgctagcttgtttaaccctgataattccgcatgcagagggaaaagactgtgtactatcctagtggttacttaggtgcaaggggtgggatcatttgt

SEQ ID NO: 99934 - DNA, 831 bp, Oryza sativa
  unsure (1)..(831): unsure at all n locations
ccgcgtgacctattgaagctacnttccnaagancaacccnagctctgtacccgtccttaaaaaaaacttaacctattaagagaatatgagtcatgtgatcccttcttagacaacaaatctggctaccctttatctagaatctagatcacaggccctcctatgttgagtttttttttgacggaggaagtatgctcttcttaccatgtccaaaatttagacatcaaggacctcacaaacagcaattcaaatgggaatttgcccaagtgagtgggttgaaatgtaccatcacatggggttactcatgagttcataaaacattttagaccctaactatcggattgaggggctgtttgggttgcttctaaagattgccatgccaaaccttaagcatgccacaatttgttagtacagtgtttggttggttgctacacttgtatcatgccttactttacaaaatcattgggcctacacgttatagacttaaattcttaccaaacttagccacacttgtgggcaacaaattgttagccttactttttgtgggataacacacttgtgacaaagtgagatatggtaaacttagcaattaccaaacacccccataaagtaaggtgtggtaaacttaggcattcaccaaacaacttttagtgcttttaatttaacattggcgcataatggaagaggcacacgttttttcacaggttgccccaagccatagagtggtttggcgttggaacaatttttaggttaccttttcttgccccagaaagaaaaaaacataagtttttatgctcaacttaatttgttgggtggggagctggcaactaccct

SEQ ID NO: 99935 - DNA, 852 bp, Oryza sativa
  unsure (1)..(852): unsure at all n locations
agcgatggattaacttgcaannacagctcgaaaacnacctcggnacccagttcatccctttccccaatctccaatccaaatccctagcgaaatcctgattcaactaggcgagatgccggaagagtcgtcgaattcttgacagtatttctgaaaatattgatgaggtggcaagttaatcttccaccattcccacggtgtttttcctagggttaattttagagataatccattatatgccactgactttgtcgcacgtctatgatttgccaccgactttgtcacgttctacaatataccatcaacttttgcttaacttctacgattnannattgncgtncnnntnnnncttnttttgtccgttcatatctttcccttctgtctgtctaccactttaattcagacaaactttaaccgggatttttattctcgatcaaagtaatgtattcatcttctactggccaatccacaaacgtgcaatatctaaaaatgtatgaacgtcatcgttgagtccctcctacagcgttagtgcttccaaggaaatatgggtaacccgtataaacgtttttagcttattgcgcaacatcctcatccggcatgagtaccatatacattatacgttcaggaaaacataacctttcaattacacctgttctcatgatgtatcaaaggttaagccctgtacaggcgtataatgagccaatggcattatcttggtctatagggattaaaacgctatacctccctaaactcgcaatatctccaaaactcccgttcaggtcgtaaacgcgtatatatggcttccaaaggctagcaaagtcatttaaagctctatatgattttataaacgtagcg

SEQ ID NO: 99936 - DNA, 1009 bp, Oryza sativa
ttagtttaaatgaaaattgagggctagatgtttcccgtctattataacgccacgtgacggtttaggagtgtttgtagaaagtttaacggactttagtatataataatagatagatttaactaaatttatttatatttgtgaagttataaattttattttttatattgtagaaatcatattttaaagaccattaatttttatggatgtatgttttttttgtctttttctatgacaaaatttctctcggtttagcgttaaccagcgatgaaccaatttgtgagaaggattgctacacgtgctgatgtgcatgcttgtttttcctcttaaacatgcatgtctttttcttccttcttataaagttttatctcaaattacttatccgatctataatccgattacaccattgggttcgttacaattaaatctttcacaataagatcttacatgattatattacgatgaaaaaatatttatatttgtaaattacttttattatatgcataagttacttttatcatatatataagttacttttaagatttgactaagttaattcttagacatataaaagtaaattcaataaagtctaaaagtaatttacatatattataaaagtatcttaaaacaaaacggaaacatactattgcatttttcaagttgaaaggaaacactagatggagtacaaaacagctaccactagttgtgtagtcacgtccaatgaaaaaaagtcatgcattaaagtaactttctttttgttataaatcacttctataatatatgtaaattacttttaagctttattgaatttacttttatatgtcgaagaagtaatttagtaaaatctaaaagtatttacatatattataaaagtaatttataatttttcatcaaaatataatcatgtgagatcttcttataaagatttaattgttacgaacacaacggtgtaatcggatcgtagattggataaccagtttaatagaaaattttatttaaagtataggtagat

SEQ ID NO: 99937 - DNA, 639 bp, Oryza sativa
ggtaccctttcaaaaatagatctttaatttgtacggtgcgaacaattataaaatgcaataacgagattcatgtgatcagacctaagaagaaaacgaatatgttatcattgaagactctccaaaatccatgtggttcaaacttaagatcaagctgaagcgcatggaaacgttattattaaagagtctaaaatttttagtagtataaagaaaggtccggaattttgaatcaaagacttcttgggagaaaggcagcatacaattagtaacataggggtctgagacattctaaaattcagggcagtgcacaaatacttctgaggaaaaaaaaaaagaacacatgacatatgctagcaagccgataaataaactatcagctgaagagacataaatgcaaacatatcctacaacatcaattattctacttacaaattcaccagaacttaactttctgtatgctaagaaagtggcgatatcatacctgcatagcacagaaaatcatgtgatgactatggcattagtgttggcttgccaaagttaagaaacaaaacaacataagaaaacttgaaattagtcagtacatgtacaaacattaaactaccagtttcatacagcagtactaagtactaagaacactgcaca

SEQ ID NO: 99938 - DNA, 834 bp, Oryza sativa
gtggtcgatgacgtccactatcggcgaatccgagctcggtaccctaatatttagctacttacaattaatactcacaaaacctcttggttcttgtgtccaagttgaccgtaagattacagcccggttgtcctatctctcctgtgttgtatcctccaactcaacatttaaccgacttacaccctcctgttatacttgctcttaaagttatagccaattggtggctctaaatcatttatagtcaacttaatcgccaatttatattataggtacatataaacatatactacacaatcaatatctggtcccacctgttatacacatatgtgtcttaaagtacatgctgcagctggctattaatctgtagtccgctactcttatatctcatcgtttatctccttaaaatatgtttatatctggcttacagtgtgctattgtggctgcatttatctagcagttacatgctaacattaacggatgtgtgatttcctttctgagataatgttaacgaccaaatttgttgcactagagtagcagatctttcaggccaatgcgtgttcttcgcgcaagagatcccacgcgaaaccccactacgtgctgcgggagttcagtatgctcacaactaaaaaaaataatatgtggcttagcgtgaccatataaccttacttgaggcctgtgaacaattgttgttatatgactaaattggggaagaaagaattacctttaccaattgatgtggaacttcttaggttcctaagaaattataagaaaaaatgaaggtttatttgaattttaatgaatttgggggaaatgaataaatgctttttttaaagctct

SEQ ID NO: 99939 - DNA, 843 bp, Oryza sativa
  unsure (1)..(843): unsure at all n locations
catgatgatcgactgtcaccatacggcgaattcnagctcggtacccttcccattgacctaagggagtccttcaatagttgagcaaagaagttcaggtacgtgttttaatgctttatggaagaaccaacaaggagatctagacatcgcttctgattgggattaaggtaatgagccctatctgatgtcagtggggattgtttacagtaccgcagcaaacactgacgtatgggtctggacccatatgttagccaccgctactgcatcagcagtattgcagagaatttgcatcagcagtactgcatcagcagtattacagatgggggtgcacaaagccgggtcagtttacccaactaccttcctcctcttaactataacttatattcaatttatgtctctcgaaaatagatatgaacatacttttttaaaaaataatactacatattgtgaatntgtgatccttacctttacatttgagttatgacgaacaactttatcgattatataaaagaaaggatgacttcttatccaaacaaatcctatagtaatgtctttttaactttcagtgactaacatataaaccatcaaacgagtccatattaaaggataatactacgaagaattgtcatcccacatttttacactggcactatcagttaaaactgaaaaccagcttaccccaagctcaccaagaatctttgagaaacttataaaactcgccgaaaaatccggacaaacccgggnttacacggctncacgcacccaaaccccaccctagaatatcctttctttggcaccgggccngcacattaagcttcccaatttncncgtcctacgcgcgagcgc

SEQ ID NO: 99940 - DNA, 854 bp, Oryza sativa
  unsure (1)..(854): unsure at all n locations
agctgagtgtgtacaacanttacgagcgaaccgagctcggtacccgtatgccatgtaggacaaaaccgctctggattgggtcgagagggggtaatttgtctggtattgaaagttcatggtaaacgatgtccggtttcgtggttcgttggggggggggagggagggagggaggggcaaattcagatagtttangggagtaactcaaaccttttcctattcataaattaattatgtattgaaagtatttttttgaaagtcacacacattaaactttataggctttgaaaccttgccgctatttcgttgtacacaaaataacatgtgttttgggtctcaaagagtttcatactacaatgcgccgcacgtttcacgggaactccaactgatttttattaaagaacaatgccaaacttctaaacactgcggggttactttaggtgtacctcaccaactttttctcatgcgggccccaacacaaaatagttcaatcttattattttcaccctagaccttttccaccaccggtaattcattccctttacttgcgcattacctaaactaagaggttctcatgctcctcaactttcccggacctttcttatacttacaactgttggcgcggtttgcaaaaagacactagttgcagctgatgtacacatgcgacaacaattgntgagactccttatgtcccaattacttcttcctgatccaatgacgctaccaggtgcctcatttcactgatacctcgagattgtgtgtaaacaagaaccaacctcgggccagtgctcctatgccgtttcacctggacctcagcgggtagctcgaacttaacgtcttgaaccgacaaattgcct

SEQ ID NO: 99941 - DNA, 849 bp, Oryza sativa
  unsure (1)..(849): unsure at all n locations
gagagttgggtacgaccanttagccacgaaccnagctcggtacccgtcagcattccttggtgctagaatttgtggtgtctgcttttagacaaccgtatgtgtaatctaaatttctgttctcttgaatgagagaagggaagggaaggttctttttctttctggaaagcagtagagtgactaatgaatatgatgggggtgaggagggaaatgttcacatatcgcgttacggctatcttcttgttgaaccttctcatctctattatgagcaaattttgtcccaattgtggttctttgtgagtcacagtgctagttttgtttattaggatgtagctatgccagcagataccagtaggacacaacataccacacaataagctactttgtaaaatgcatcacattaaacacctaatgccatgccatacttatttgatgtgcttaatgatctaaaagttcgccctaggcacggggcatgttttaagagctattgtcctatgtctcggctgtgatattgcattcggcggtgcacctgccttggtagctctagtgctgatatttaaattgctatattttatgtgatatcgttggtaattgctaggaaaccccttgccaagttatcctaagcggggttaagggccttgagctgctaaccttgctgaccaccttagagtgtttataaccttatttgagcattggtttcccctttgacacaccgtcattgtggtgacatggctcgtgtgccccctgtagtataatgtaccactcacctgcttggctgcacagcctgactcatttgttcatggccacattccccacaactgattgttttactcttcctaaacgcctaaatcg

SEQ ID NO: 99942 - DNA, 754 bp, Oryza sativa
ctcggtacccgatttatttttattaagcggaaaaatataatcctaaatgcttggaacgtacatttatatcgtcaatatgagccatatctattaccattaaacatgtatcataagctaatacaacaagctcgaaaaatctttaaacatactgaaatgcattgacatgaactaaatatatactcctacctccgtgcgagaatcggaggtataaaaaatccgaggccttaattttttagggaggctgtttagtgacccctgtcaaatagtacttgacttgtttctgacactcataggttaagcatgcatgaattcagaactagtaatccttccgttctaaaatacttatatttttcgaatattgccaagtcaaatattattaactttaactattattagaaaaaaataaaaaacaatcatgtaaaatgatgttactagatttatcattgaacaaactatcaaaatatgtaactattttttaaaaaatattttacttttatagatattgttggtcaaagtggtatctcaaaaaccgtgtccaaattcaaaaatgcttatatttttagacggagggagtagcctggatctacaggatagtgggagtgcaagcccgtagttaatcttgaaaaatagaggttattgggtatcccatatacatatgcctaacatatctaacgagctactccctccgttgtttaatatatcacgtcgttaactttttaaaatatattggaccattaattatattaaaaataat

SEQ ID NO: 99943 - DNA, 531 bp, Oryza sativa
aatagtataactatcactttgtcggatgaagaagtgaccaaaataaaagttgtagatcttgatgagaggatcaactttgttattgaccatatttccatttgaaatcatgtcgtatttacaaatgttgtatagatttgtcatattgtcaaaatcaatttcaagctgttggaaacaaagttatatagacaaatgaccaaaataaaagatgtagatcctgatgagaggatcaactttgtttttgaccatatttccatttgaaatcatttagtatttacaaatactgtttagatttatcatattgtcaaagtcaatttcaagctgttggaaacaaagttatatagacaagtgaccaaaataaaagttgtaaatcttgataaccactacaattttgttattgaccatatttcgatttgaaatcatttactatctgaaaatgtattatgactaataaaataaattattatacagcagctatatattttgtactcacaaatataaagacttatctggaaaaatagaaaaatagtcatc

SEQ ID NO: 99944 - DNA, 548 bp, Oryza sativa
aacaatttacaaaaggagaaaaaaacagaagagaattacagagggaagggaaataattaatcaaaaggctgaatccatgattgccagagggtttgttcagatttctttactctatgcatatgtagagtaaactcttccttgaaatcagatctccacctttgaaaattgactggaacattattaaaaataaaatcatttcttctgcttcaaatgttccaacagcagattgcaaaagtctccatgaagaaaggaaattgaaaattctcttttgcttctattatcatgtccatgaaggttgtgtgaaaattcccattaatgccaatgttgtgccacattgctgagcaaagctgcaggtgaaaaacagatggaatgagtcttctgtggtcaaggagttgcaagttacacatctatcatttccttgggtattgaaatgttttctttgtaggaggtccttgctgtttaatctatccatcaaaagtaaccagaggaatactttcagctttagggtgcatttgttttccatatccaagagatgggtgcagcatgct

SEQ ID NO: 99945 - DNA, 591 bp, Oryza sativa
caggcgaggccagcgaggcccgcgaggcggcgggcggccgggcaggcggccgacggggccggcgaggcggcgctccccaggtgggcggcggtgctcccggggcagcggcgcttccggggcggcggcggagcccgaggcggccgggcgggaggccggtgaggcggcggacggccggcgctgatctctgtgatgttttttttcttgatctgtgtgatatgtgcggccgatttgtgcgatgtcgatttttttttcgatctgtgtgatgtgtgatgtgtgaatgaatttgtggagatgtttttgtgattttgtgaatgatttgcgatgtatttggggataaaaatacagcttgatgtatttggagattttgtgaatgatctgtgatgtatttggggataaaaatgcagcttgatgtatttgggaaacgagggaaggatccgtggtgttaaaatgatttgtggataatatgaatggtggtgctcgaaaacatgaaagcaggaaaaaaaagaaaaaagaacattacccccggttgttaactctaaccgggactaaatctttagtcccggtttttaacactaaccgggactaaagatc

SEQ ID NO: 99946 - DNA, 656 bp, Oryza sativa
gatttaatatctatttaaccaccaaagaatggttcaatcaatatttcacaaacacctgccattctcactccgaaaacctgtaaactactccaggaaaccataaaataagcatgacaacaatcaacagtgccaccacaaatccaaagaacaaatatagactttagctttcctgcaagagacattctgagtaaacccatagaaattccaactcttaacatcagcaaaacaaattcagtaaccacaaattaagcatgatgccaacagcattgccaatcgaaagaacaaaacctaggcaagatgactgcgttcttacaaggaaaattctacataaaaccctagtagaaaggatcatccttctacttcaaatctgtctctccacagtacacaccactagcactacaatcagccctcattcctaaaacaacaaattagcatcatcacaataataaaagtaaagcttgattatcctagaaaatcacaaacaaacctggaggagcggtgtcgtgcaggcagacataaaccgggaggcctccctgcgcaaaaaataataataaaaaatcataaaaatcagagggcttttcacaagaacccttctaacatgccaagaaaaaggctggtccattttaggggtgggggggaacgaacgcaccatgctg

SEQ ID NO: 99947 - DNA, 537 bp, Oryza sativa
aaaatcaagtttagaaggacgtacagagttaatttggaggaattaaatctgaaacctggatcgtcctttcggcggtacacgaaagtgtaaaatcactattggagaaagcgttttttctctcggttgataacccctatactctcagttttgcaatcgggagtatccgggaaatctttagtaccgggtaaaataatcgggattaaaaattcatctttagtcccggttggtggcaacgccaatcccggttagtcactattttttttattattttttcccaaatcaagttgtaaccgcacaaatcgagttgctccctgtatccccaatcatatcctcaaatcaaaatcaaagtatcatcacaaacatagattcacatcacaaattctcaaaaaaaatacatacaaattctaaaagaaatacatcacatatccaatggatgacaacttctaaaaattctcagatccaatgtatcaaaaattcaaaaaaaaaaacaaaatcgagttgccgctgccggctgcttcctcccgcctcccctttggt

SEQ ID NO: 99948 - DNA, 930 bp, Oryza sativa
  unsure (1)..(930): unsure at all n locations
aggaagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcgggcggacccgcccgtcagcggcacgctcgcggggaggaggccgaatgggccacggggaagaggagagagagggggagggatgggccnagccggcccaagagggggagggggaaaaaaggactttttaggatttttctttttataaaatcattttaactttgttaatttcttaataattattatttgtgctctgaaaattccactaaaatttgagggctctttttagactaaggagaatttaacaaaaattctccgggccacatttgaatttttcttgtacgtattttagtgtttgccaatttcttttcgaattttaattaattctattattccttttagaaaatgatttttaatttcgggatgaatttatcaggacgtgacaaatccaccccgcttacaagaatctcgtctccgagattcgaggaggttagcaagaagataggttgggcggtcttctcttcttgtctgacttcttccgctccgtcttctataacaaacttgcctaacaaaacttctccactctggactgcttggctcgatctcctgttgcaggtggaatcttcttttcacctgactcgaaccagggtgcaccttttagctgactcagactaggttgcggtagtttaatgatgcttccgttccagaacttctcacgattcatatcttcggcgtcaacctcacacaagttaccaacttcacgtcatgtgtcgataccagcttgtcattactaggataccatgcttgtcatcatgagaataccatgcttg

SEQ ID NO: 99949 - DNA, 674 bp, Oryza sativa
agatttacctggggtatgacatcagggaatagatctgtcataaacatcgaagccgattgatgaaacaagtgcagcttccattcaccccaccatcagttgaagtttctgctgttaaatcctaccaactcaatattgtcaatgctgcccagaggggctcctgggaggttaagtagtcgatccaccattagagttgatgtgatttctcctcggcactagatcttgtcggcaaagaataagccgattgggagttggcctagtccaaattgtctagctgagctcattgggtggtagaactcataagaaacttggatatttcttccctgatgaatgccgacaggaaggatgcatgggctgattgcagctgtaagaacttccctggatttttgatacttttcgtgattgatatcttcaaatctaaagtctgatggaagttcaagatctgctgagtcctcataagggaaccaaacccgggcgtctttctgaaagccttcatagaagctgcagaaccaatccttgagtagctcagccgatagctttgctccaggatcggttggtgaggatgcatattctccgtatgatgtgcatctgcgatgagtgcgttcttttccatcaactcctacaatcggctctgggaatgggaactcagcttctgtcacagatggccgattgacaac

SEQ ID NO: 99950 - DNA, 686 bp, Oryza sativa
gcatctccctctgtaatgtttgttacctgcagcctgtttttcccttgctctttcaatgaccgcaaaacctaggagccttcttttcagggccgcgcggagcctgtgttctgcctgtgttaattaggtgtcggccctcttgggccacgtcaaatcggtggattacgtccaatgccatgtgatatttgagcaaacgccctttacacatctttttaaagcaatcataggacgtctcattttgtttgctagctaggcgggtagaggttcgtggtgtgtcgtttgttgagtccaagcatgcaggaccacctccttgaatcatgatagtcttacccagaagttctcaaatttgaaggttctcggctccgtggcctgcccgggttggagataagcaaggggtagtgatcagatattccaaaagacaacgcatggaggatgtgatgcccaaggtgaggtcccattcctcgttgcagaagaatctgtccatcttaacaagtgtcagctaaactctctcatttctccaagtgattttcctattttgaaggtggatctctttgagctcacagtggttaagagcagcacggaaccggctcattcacctcaagttgaggttcgtgttattttttatcgtttgccttataaatcatgttgaaaccaattaatagccacagctcgtcatcctccggctttgg

SEQ ID NO: 99951 - DNA, 888 bp, Oryza sativa
tagctgcttctcataattctaggaatcaagactttttgcatttagtgtataaaagttatagcaagtttttctaaaatgctatctaggccagggtttacgattccgacaggcccttccgtttcgggcaccggcggaattcgggatttcgcgaaatccggtgaaaaaccggtaaatttcgaacaaatttcataaccaaaatttgaatacaaattccctgagtttgccgataagttctcaaaaccagtcggttttggcgaaattcagatcgaaatcatcgaaatttcgatcagtaactgggcctagtacatgtattctggcccatgtaagtgttttcctttttttttaaattctttattcttttattttctgagctaagttttagtaaacacataatacatcattttttaaaaaatttatatcctaataggttatatgaatatcatagtatttataagattttttttcttttttttcttttttatcaattcaaatttgaatttggatgaaactcttcgaaatcttatatggtttctacttttgagcctcatcgaaacgtcgaaatttcgcgaaatccaaccagatttcgtcggaatcgtaaaccctgatataggcaatattagatgttggggttggttttcataacaaaaacatgaggtaggagttaggccccatttgtttggtccattggcttcagcaactctcttgttattcgttagcatcttttttcgaagagcgtgttttatgaaaataaattgtatatataattttttaaaaaaaaatcgaacaaatccatcttttaagtttattataattaatattcatttagttatacgctagtgatttatcccatttttcaagtcttcaaccgtttgtacacctaatttaaac

SEQ ID NO: 99952 - DNA, 759 bp, Oryza sativa
ctattcgaatattaattctttggaaaatcacaaaagcccacctcatgggatggcatacatgtggagtttagtaccactttgcttattctaggagaggggacctccttaaaagggaggatgccctcctagccacttgaagcatgtgtggtggagagaagagggggaacacgcgcttgcttgctcgccttgcctagcagggcagaattgactcctcacccttacacagatgcagccttcttttgcagttttgttttgctgcaggaaaattcggatttgttttgttgttggaaacattccggaaaatccggtgcatgaaaacggcgtggagtccggatcagatacgcacgacttatccggtttggttacgcggagtggagatcgtgcgggcgccctgatcaagcgacctatctctatataaaccgagccgctgccttcacgcaacacacgtgaaatcaatctagggtttgcctcctcctctgtgctgcgccgtcgctcgtagactactccagttttgttttgctgcaggaaaattcggatttgttttgttgttggaaacattccggaaaatccggtgcgtgaaaacggcatggagtccggattagttacgcacgacttatccggttcggttacgcggagcggagatcgtgcgggcgccttgatcaagcgacctatctctatgtaaaccgagccgctggcttcacgcaacacacgcgaaatcaatctagggtttgcctcctcctctatgctgcgcgtcgctcg

SEQ ID NO: 99953 - DNA, 560 bp, Oryza sativa
caactcattggctccggttttaggtacaattacaaaggtgtgatgaagatggagaatttctgaaagttgcatgtcgtaagttggagacgtcggttatgcaactttttgccaactatagatggagattcacaaataggcttgaataaatgtgatcttcttattttggattttcctatttaaatgtttggtgtgttctattttatttgaactacacttttatctcgagtgctactttataataattggttgtagctcttcttgagcaaaggttgagatattatattgcattatctaaaaaaatataatatttgtagtaataaattatatttactatatgccttaaccttcctctatattgaatgcttttatatgctagttgaactaattaattatattgtttatagatacactaataaggaggtggatttgtgatctatttagtataaattgaggattcatttgtttttaacactaaaccaatatccattcacttgctcatgattcatcttaattcttacttatgtttagttagttaacctataaaattttgtaagttttgt

SEQ ID NO: 99954 - DNA, 537 bp, Oryza sativa
ccggccatataacaccttgtgacccctgcatattataatatttttaagtaataagagaagtgcatcatgtaaacaagaggagaaaaaacccttatagtagattttattgtttgtgagataaatgcaaaattgccagatcaattggagaacaatgaaatactttagcatgtacattacataaccttagtatttgagactaattcttctttgaagagtccatatgggtgttactgttactgttccataattcaagtaggggaaaatttgagaaatatcatcacaaagatatgtgagcctggaccctctcgtgtcaatgacacatccgatggtatttttcaactcagtgatttttgcggtggtaataggcaaattggcccataaagtggaggggatgttcagcgtgaatttgctagagaatagtgttctggttggtacaatacagtatcagcttattcatacatgtccatcaacaggccttttgttgaatcgtactgaaatatcgaagactactatcatcttcttttgcgtatattctat

SEQ ID NO: 99955 - DNA, 633 bp, Oryza sativa
actagataagcgtgtagtgtctatatatggtatgccgggccttccagattttgtattctgaacatgacgcagatcattaacactgtttactacatatattcttcagagcattggttgtatctgttatctcatcgcctgcagtcttcgtaatgcatttatgtcatgttccaaaggtttatggtcttctagcaggtgctgtcaataacttagcacatgtcttcttgcatgttgtatctgtttttgttgccatattgatgttcttctatttgcccttttagttcggatagtgttgggtagtattatcctgatgactttgagacttctccgagttcaggtattccttttcacttcttgttctgtttaaaagggtttattgcaagtatgcactgtttctcagttctcctaggtactaccaatattctgaaaacgctgtttccctgaaaaggggtaaacctcaatccttttacctgtataaccttctcctggccttgaagtgcagcaactcatagaatggccaccattttttttaaaaaaaaggaaccttgcttatcaaatttggtttttgttttgatgcgtctgtgaatttgccaagggcctaagatgcatggtcgtcttgcctgtggcatacctgct

SEQ ID NO: 99956 - DNA, 766 bp, Oryza sativa
cttttgaacatttacttatgaaccaaaaaagaatagcactcatttattttgagatcactcatctaattccttttcttgctaaatcaaacttttgtcccttgttgcaggatgaactgatcgcccgcttaattgagtcctcggagtgatctgaactgcgatcggaacctcattttgttggatgttgtaccgtagtgacgatcatacaccatgcaagtgaacttctatcgcagacctcatgtaagcatatatttcatacagtgccgaaatgaaagatctggctgatagtttccacattgcaccttgttcgatggagctccttcaacgtttgcacgacgtgttgtgtttaacactagtgttacccagggcaccaagtctgtctacgtccgattccctcttggtgaatctgaatctcctattctgacacttcgtttcgcatcgtgtcggtgcctgggtacacctgtgcaccctcacctcgtttgtactccgtagctttctgggtgagaaaggctatttagaccattcccaacccaagacactagacatagtttttataaactccgcgtcattatcatcaagaaactagtactaggcactattcttccaatgcaaacacaactattccatacatacttatcccacacaatgtcttggatgttgtgtagaaattatgtctcatgcaagatatggttttcttctctttcttcattattcgccacatcatttttcgtcctaggtggcagcttatataatgctatggacatcatcc

SEQ ID NO: 99957 - DNA, 626 bp, Oryza sativa
cccccgaatccctcctcgaaaatgatgccaatgcattcgtcgaggagctaggacgatcatagagagatgatcgagttacccaaaactgatccacattcatgacctccagatgagctcaaatctcttctttcaggctttccttataccttcttgcatggtgatacggagtcacccgtcaccatcagcgacaggctgtctactgacgagacctccaacctcaaagatgtgttagaaaagcatcgctctgttctaggctactcacttcaagacctgaaggggattggactggaccaacggtcaacaataaccggagcctctttgttggtctggctggtcgaggccccaattcaattctcaaggcgcatatgcctaaccattgggattcatcgtcaggtcgcaggggctgagagatgcgcgctagctaacccaccgtctcatcgcttctgttggtagcaaatattttattaccgactatctaaccacttgaccagctaacagagagcttgtttagtttattcatcaatccggacttaataactatgatatcataaaaaacataacagtatgccacctggtgtgtatattttttagtgacagaacggtacgtggtaccaaaacggaattaa

SEQ ID NO: 99958 - DNA, 638 bp, Oryza sativa
tctatgataaacatactatgttacattgagataacaagaaacacatgagtttttgacgccattaaatttgataatgccctacaactacctacatgggctaatgttatattaggttgaatcatgtacaaagattaaagaaacatactattctaatcatctatagttgttgaaggatatagaaactattagaaatgagtcaatcaatattggaccttggctatttaccatgcattactatgtactaagaagatctcttagattatggttctaatccagtgcttccattgattttttgaagaaaaaaatcgtttcatttagcctgtctgtactgctattatctgaggggtatgcaattgcttatttgttaagttgtgaagagaaaattagtttactaaattgtaaagagaacttggagaattgctaatttaatatgccatgttaataaatttgaattatctcaaaagcagagcagaattttgcaggtagaaaaattatttcacgagaaatgaaatatatgctttttcaatatattgaaaaggtggcaaggatattttttaaaaaaaaatcatattctattacttggaaacaaataattttaccaatgtttcccatacacaggtaagcttaccaactacaaa

SEQ ID NO: 99959 - DNA, 2184 bp, Oryza sativa
aatcaattaaagtttaatatgttcaaggaataatatgtatctatattcacctacattggttcatgttttcatctatatcctataaacgacccttgtaaaaaaaattggaacacacaaaaaaatagtgtctagctaggctaaaggaggaaatcaaaagtataggaagtttgaataaatagaaaaaaaaaggcaaattacatgtcaattacaatgagtttacagaggtttcatggtacccctttttctctataagctagaatcacactggactattggatgctacaaacagaagaccatgccaactggtggttctattaaatgcatgtaaagctaaaatgaacagatagaaaatgaccttttctcaagtgtagcatgccgatgccctagtcaacaacaatcctccgttatgtgcgattagtgacatcagtacacctgaaaaaaagtatactacctatgtcctaaaatatattgcaattttgagctgtatacctaaacattcctttcaagatatagggccagaagttattacattttgggacaaaggtaatagaaagttttaataacgttagtacagctaaaatagtatagtatcaaccatttatatatagagagataatattttcagcctggcatcacagttctaaacacatgaaaccaatttttctaccagaagttctatctattttcgaagcagaggtagtacaaagtgctactaccacatggcaaagtttacgagcgaaagcatgcatgatcacttaaccaaagtatggatgcaataacataagccttatagttctacatggcatacttcttcaggtatgtcccatttttttcttctctggcccttttgtaagtagctggcataatataaaatgtggaaacaatgagctttgtagagcacagcagcagcaggttacactatagtttgacgaaacagatcggctccacaacttttaggatttaaaagtatggtttcacaattaatgaaaaaaacatgtgtaaaaaagaccggtgaactaaacagtgaaataatctctctctgagcatagacatgtaaaagcaaaccaactgaaagacagaatattaaaaagattgactcatgatattgctttaccattggatcgtaatggttaggacatgtctaggaaaacattcccattgaaccagttgatgcacaaactaaattgaaatgtaccttcaaaagaaatttgtgtctgtttccatgatggacccaatccatatccatttctttttgcgacctaataaaaaagaaaatagaggcatgtcatgaagcatgaataaataaaggtcattctagtgactgataatgttttcatcactcaaaaatggaatcatctttcttttcatcactcaaaggaatgttatcagtcacccttcgtgttttgtacagaaatatggcatgaaggattggctctaatctctctaaattttgctaagatattctataaaatctaaaagaatatgatgccttactacttaaataaatgggcattctcttttgtacagagaaattcctttcaccatctaagcatttatatagttggaacaaaaaacctgagcagcaaaaatggtggacataatgaatgacttcactgagttaaatgctgctaccatatattagatgatcatacatgaacattgatgtgaagctgaagcatgcatgcagtgtatgcacttcaagcagatgcaaacaacacatcaataccaatcgagaagataagattacagaatgaaagaactgtacaaaggtaatggcaaataacggtacagatttctttcgagctaacataaatatttatgcatggaaattttaggaaatatagtagataaacaaaaataaaccatatggaaattggtgtggagcatacctgtaatgaatgtgcttcgagcatatagcatacatcactgaaaatgaggaacacagtacagcagcatatgaaaaactcttttgatgtacattcaagaggtaagccatgtgtacttgcagcttccaaaactgtctgaatatgaaaatacaacctgcagcacaaatgggaacaaataaacctatcaacattatcgttttgccccccatagctgtatatgcaattcctgactgaataaataataatcatagcatatagaaattttagtagcagtgtgcattgcttcaagctaaaaaag

SEQ ID NO: 99960 - DNA, 569 bp, Oryza sativa
cttgtatccccttgcacgtctgcatcgttggtgtggcttgctaagtacggtggttgtactcagccttgctattattcccccttttcagaagtgtagtgcttctgaactgaagacgaagttagaagaccaaggctcagaccccagttgagttttgcctatggagtggagctgaagccctctaggatcgcctttttccgctgctgctgcttttgtttcggtgtgaggactaagtgccgatcttctgtaagtattttacgctttatttacgtttggaactgtatattacttgtcgttttgtgtaccttggctggtcctggacagggatttaatacacaaaatagtctggaaatttgggctaaatttctgggcgtgacatgtgtagaccattatattgtttaagttgattaaacaagcaacctagtatagttacacgctcatcactgaactacatcaatgatggaaatgcaaccatacctacacacaagcaagcaacaaacattctaccctactaactattctgcaaagtcccttggtggtttacgttctagggtcagatccaaacttcatcc

SEQ ID NO: 99961 - DNA, 713 bp, Oryza sativa
ttctggttaaaacctagacaattccctgtagcaatttcagtaccatacagaagttcagacttcagagtaaactgaagttaaaagcaaataatcatagtttaaggacataaatctggtagcaattagactatcacagcctttatcatagcaaaactgcatctgtattgcctacagttcagactgaatattgttttgctgccaattcaaaatatacacatgtcccaaaaaatatcacaaacttacatcaaaggttttagcacataactagaggattccatttgaaggaaatgaagaacagaaatacaaacaaataggccagaaaattaaggggattttatttgttttcttttttttaattgattaaatgaactttgtgctattaaaattatttcttgagctccgaaaattcacaggaaatttcagagagtattttagggcaaaagaatattgcaaaatattcccggccaatgatttttaagggaaaattttaattctcccattaattcactcgaataaattgctttaacttttaatataatttcttgaaatgcattattaaatgattttaaaacccgaacgaaaatcggggcgttacaacacacactagatcaatggcaacctggttaacgtctttgtctttagtataaccactctccttctatcttctctaatttgcaacagatggtgaaccctcgtgccagtggaagtggaaa

SEQ ID NO: 99962 - DNA, 965 bp, Oryza sativa
catgcatttaatagaaccaccagttggcatggtcttctgtttgtagcatccaatagtccagtgtgattctagcttatagagaaaaaggggtaccatgaaacctctgtaaactcattgtaattgacatgtaatttgcctttttttttctatttattcaaacttcctatacttttgatttcctcctttagcctagctagacactatttttttgtgtgttccaattttttttacaagggtcgtttataggatatagatgaaaacatgaaccaatgtaggtgaatatagatacatattattccttgaacatattagacttcaattgattcgggcggcgcggcgtagcgcgcttctattattgctgtatcatgaaacatcatcaggatggaaggtatcatgagcatcagcaatgttttgaatatagcccatggcagatccataattttatgatccaatcgatcaaacaatggtcatgtactgttgatgagctaggcttctgtatgttttactccctccgtttcaaaatacatggcctcgttgattttttaataatgtttgaccaattatcttattcaatattttattataactatataaatataaaagtataagttaagattatgtttctttaatcataaaacgtcacaacaataaatgataatttttatataattttataataagacgaatggacatagatgttgtggaactttaattgatttgctggtcggtgttgtgtcctcaattaggatttaggataaacaaataatgcgccattaagtcatcttaaagtataggataggaaatatgctctttttttagaaaataaattatggaagtagcaaatggacagacacatccctcaaacaaatgagaatgtagtaaaaaagttagtagttcggaaataaactagtattatagttgatatatatatatactccctccatttcaaaatgtttgacaccgtt

SEQ ID NO: 99963 - DNA, 749 bp, Oryza sativa
acggcgcgcatgggggaggaaaaggacgggcggctagggtttggacgggttggcgaaatccacaccgtccgttaaagatccaacgattccacgggtgtggaagggccgccaaagggggaacgtggacggccagatcgagcctatctcaagatcggacggtggacatagcaaggaccggcgcgtaattaatcaaaagcatggggtttattttgcaaaagacggttgaggtggcacgctaatcttcagccattcccacggcgtttaagtaaactaatattcttgtagaatagtggtagataccaatggtatctactgttatgattcatagacaacctctatgatatcccaataaagttacggtaatactcatgatagtaaaatgcagttaattaaacatgtgcatcggttttatttaggtccataaacttgaaaatcacatctttagacccccctgccccctaaaaaaatcttgtaagtatatcatccctgtccaagatcaaacatggcatatcacacaaataccaatatggtgtcaacttcaatcctacatttattaacaaatggggccactatccatatttcctttttttccttctcttcttccaattaacatagcaagccaacccctaagtgaggtcatagaactaaccgagatggagggacctgacaagggctgtaggaaccgacgagatggaaggacccagctagggggtgcagatctcaacgggaatagttgatgggctagaggt

SEQ ID NO: 99964 - DNA, 786 bp, Oryza sativa
gggcgtgtatggatgtggtgtatgtacatatatatgccgtatgcatgcattttccatacaatcgcaaaaaaagtcagtcatgtaaactagtgatactttttgatgaagtacttggtacagctacatatgtaggcaaatctatactttctataaagttaaaccccactaaatctaaagcttaatatgtaaccatgccacatcatcatctgctagtaataattacatatttaatttcatgcaagaatacaacatcatcttaaaaaaattgatacaatagtagtgcttgattgccaaattttttttttttgagaattgcttagtaatttcctacagtaaagcgcggggaatcacatagtggatacaatagttactgctgtaactaatttaggactcctctgatatacatgttttcttaaaaaaaaattccataggaactagttcatttcctttaaaattctcgtaagtttcctcagttccaaaatgaggccttatcatttactaccttcatgctaaaaaaatatctttctagacagtttatcaggttcatagttaaaaagataactgtagtatttatttacggggtagtaattaataatttggctcctctctccattctcaaatatctgacttcgttcactctccccatcttactttgactataaattaccttttattgattatattatgatttatatagtcaaatttatgactccagacacaccttaataatatagtagcatattttcaagcacaagtatatatagggaatttggtaccgagctcgaa

SEQ ID NO: 99965 - DNA, 821 bp, Oryza sativa
aatttgaacaaatattggttgcatttaaataaatatttgtaaaatgtttttatttctgtaatttgagacaatttttgaattttgcaaaatatgtttagatccagtcaatatttgttcaaaattacatcttgcaaggtgacctaacgataaaatcatcttttcttcatttaaagatgatatattgaaataatggtccaaatgtctcttactacctcccaagaaaggtattaggactgagagagtagtaaacaatcgtaaaagtgtgtgctatataataaagtacacaactaaagtattcttaagcaaatgtcgtggatttagagtctcctagagcaaattttacctcagatattggtgtgtgcctttaatacacagttgaatagtacaccatacacccaaagtgcgatttaatgcatatatatacccacaagatatgcacacatatttatactcataaaattggatagcattagtacacaatttaagatttgaacacaagtgagcggaatgcacaacttcaagcaccaggactagcttacatggccacttatatatcaagatcttatttatggaagggagtagtccttaattaagaatttcctcatcagattatatataaaaaaagattttacgctcctttcaagatgcttaagttgaacagattgctgagaggggaggtcatatttcaatttcgaaatgtccatctgaatacctgtgttaatttgtacgaacacgtacatggccgttaattccacgcacccgacgaaagaaaatgactcggcaaccatcaagttttctgctcattgccttttttgaagagc

SEQ ID NO: 99966 - DNA, 1659 bp, Oryza sativa
tgaatttttatgtaatactatctccgtcccaaaataagcgcagtcatacgtttccgcgtccaactttgatcgtccgtcttatttgaaatttttttataattagtatttttgttgttatgagataataaaatatgaatagtactttactcgtgacttatgtttttaattttttttaaaaaaaattcaaataagacgaacggttaaagttggacgcggaaaactatagctccacttattttgagacggatggagtagctagctctacacatggtttaatatggatatattaatttcatagtgagataaagagagaaaacaataaaactaatctattatatatatattagctatagtataaatttatacggggtagttgttctgctattaaacttgctactacgagaggattaggctgctgcagtttaccacctgacttcacacagagtacatactttcttcgtctaaaacaaaccaacctcgtattaggatgtgacagcgaatctgaatatactctatatccaaatttattgtattaggatgtgtcatatcttactactagatttttttgggcggatggagtacatacgtacatggtatcgacaagggtttaccatccaccctaaggccccgtttgttttctccattgggaaagatttttcagcgcatacgtagtgagaaaacttattagtacatgattaattaaatattaactattactaacttaattggattttaataaccacttttatataaaaattattgaattctagttaatttatgacatattgattagtatattagtgagtaattagataattagtgtgtattagacgcagatgttttttttgttgtggattcccgctacgttcatccttgtttcttttatgatatctaatgttttctattaacaagatgttatcatgacagtactaacgcagtatgaatctgtgatatatacacttaaattaacatgaaactaattaatcgctgatactcgagatggaaatgaagttcaagcagaaactaattagatcaaagttctgacgtggactctcctctcgcactagtgttgtcacattccaattcggtggttggagattaaaagagatggttagagtggatggccgcatgcaccggttgctgaatatctatatgcttaattagtgagaaaaaacgtggttttccttttgatttgtgcagtcgtttgttgttgctttgccgcttccatctagtgatggtcagcacatatatgctctgcacgtatgtagctgttcttttctcccgaagacttaaggaagattatgttttttacgtaaaacgagatggtattaacgtatgattaattgagttttaattattacaaacttgaaaaataaattaataggatattttagagcaacttttatatagaaagttttcgcacgaaacacaccgtttagtagtttgaaaagcgtctcacgaaaatcttaaacttaatccaactcttgttagagtagtcataatcttgcattaggtgaaaagttggaggctaatccatataaaaaaagtttgtagttctttgattttgccaaagtgtcaatgcgtcataagtttgatatatttcagtgaacggcatcatatataagttgatatttattgaggtcagtggcgattaacaaa

SEQ ID NO: 99967 - DNA, 1403 bp, Oryza sativa
cgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattacataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctagctttaccaaattgagatatcgcactctcgagcgagtccctccattttagaccacacctaataacatcaagatcatgaatcctcccagatgtgaacctggaatactggaaacacgtgtatttcgtgcacaatgagcaaagttagttttacatccagaaacctgtttcgcggcgatcatttcacaatgatgttcgctgagatttttttatataatggataaaaatccggtctctatatccacaagtgtatatacaaccaaacatttcagaaaaatattattttactataatattctatagcaatagtcaagattcctttggaatataggaattttacaggacttgaggtatgttcttttctcttacagatgggtaccgagctcgaa

SEQ ID NO: 99968 - DNA, 501 bp, Oryza sativa
gggaaccgaatcccacttcccctcatagtgccgccacccctctccctggccggcacctccttcctttccttctgctgtgttcgcatctctcccttctacagcaaattgctctctctatatctccgccttcatagcttggatcaagaagcaaagtagaaaaacgaaacgaggaggggagagaagtaaaaggaggggttagatcggagtctcccctattgtctccttacaagttctctaaagaaaccctaggtgaggcttattcttttgttgtatcagttgttctagcatggctttagtgctttaattcgtggtcagggaaggctagagaaggagtttgggtagttgcggttcggtttgttgcagttctgcatgtgggcagatttacagtgcttcagttttttgatattttggggctctaaatgttattttctgcaaacgtgtataactaggaagttgtagataatgtttggatctatcttctaaccaaagggcgcgatttta

SEQ ID NO: 99969 - DNA, 647 bp, Oryza sativa
tgaggttgccgaccgtgcccacgggcaccgctcctctcaggctcttcccggggagccggagctcggtgacgcgtttcgccggaggcggagcacccgacgccgcgccacgcgccgccgcacggcgtgggcgccgaggggtcccacggcaggtgccgcccccccaccgcgtccgcagcgccagcagcgccgcgcggtcgcccgccatgtcggccgccgccgcgcgcgcgacgagcaccagcagcagcagcagcagcaggacgtcgcggcgtcgcccggacgacgccatggcgaagcgagagcgcgcgaggaaggcggaggatgctgtgctgggtaagggatttatgggcgggcgaagaaggcggcgcgcgcgcgcgcgcggcggcgagagagcttaggtttctccatttggaagagctcggtttttgtccagctcgattgatcgccatgcgcgcagctggcatgcacacgcatagcatcgtggacgacgacgtcgtcgggtggtgaggtgaaagaactgaggcggggggtttggaaggcagcgagcgaacggcggcgaggaagagcgacgccgtcaatggcgccggcgacagccggccggccggcgagcagatgggcccgacatagcatgctgaaaaagcccattgatt

SEQ ID NO: 99970 - DNA, 733 bp, Oryza sativa
tttttattttgttttcttccccttgatgaaatgaaatgcagttctctcgttttcgagaaaaaaaaaggtatttgcataagcatgtttcataatagcgcttaactcattgttgagcatgtctcattataatgcactcaatgttatggaaagtagtgtaatgatcaagagtagaattgttatattcatgtatatgctagaggtagtgatggtattatagtctctaggttcctgtactctcttgcgtaacaagaactaacagggaaaattgctcagtaacactaatcactcgagttagaaaataacatcgatgtgtcactgtcatgtaggcctagggccaaagctaattctcctagtttcatcaggtacatacaaagctagctctatagttggtctaacttactcctacgctttctgccaggcatatgcagaacaagaggaacggagacaagccgaggagaggaagcaggaggaagctcaggctcttattaggtggtatcagctgctgtgttccgtcgtaaccacacagcggttgaaggactcttacaaagcaccctcatcagagcacggaccagaaggaccatcccaagatgttagtcagcagaagggcacacgcaaaagtcgaagctcggaaacgaagactcgctcaagcagactacaggcggaccgaccatttgattctccttttcctgtccatgaccatgagcatgagtatccagaggaagatcagagcttc

SEQ ID NO: 99971 - DNA, 1398 bp, Oryza sativa
ttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcattttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctcctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactag

SEQ ID NO: 99972 - DNA, 541 bp, Oryza sativa
ctataccacccactagctctctctccagtcaagccctagctagttgatcttaaccacaaccatacatcttatgaagccggtcctacatactttgcggtgtagataaattaaagatgaaagcatgcctaagaacgaatatgcaaaacaaataatagcaaaacctgagcaatttactgcgagccattctttttacgattacatagtagatggacatgcacacaaccatgtgtacctccttacaacacggtcaaagagaagtcgacaacaaatatttaagcttaccaaatttctattgaaacacacctaataaatgcgagtaatatttatgatcactggaatttacctatactgtaactccactaccacacatttaatttggttcttggttcttcaattttgccaaaaatgcattggcaatatttcctgcagaactataactagttacctccgatcctccttatgtcgtataaaactttccggagatattagaatctgatcactagcgtggctccccggcatagatgacctagaccatcatcac

SEQ ID NO: 99973 - DNA, 1890 bp, Oryza sativa
tcggtacccataagtttaggacatagacatagatgtctccgaaatacagaccttaatccttaatgtcaatcgtaaaacatttaaaaacctgataaagtataatattgtgaaagttgttttcgaggtaaatcaacatgtatatatgattttcgcacattgaatctaaatgtgttaacaaatatattgatatgatttttaaaagtttgatcatttgaaaaacctttacgaggtaatcaacacacataaacatgattttcacacatctaatctacatatttaaaaatatattgttgcaatttttaaaagttttatcacttgaaacaccactgacattaatacacgttatcatgcatgatgggtctaattaaattagaagctagcttgactatattatttagaaaaccaatttaggtgttctcatatcatgatcgatcttcccactaggctttagatgaacaacaccgacatcccttcaaacctcagaccaggtcccattttgtattattatattatatatccaattggatctagcttttatactacttcattagagacccgtacgtatctaacttattgaccaccgtgtgcataattgtatgacaacctcttaacgatagtaacacttacttgcacaagccctaattgaaaaggaataaaatagcaataatatatatgtgaaaaactagttaattaaatggctgcccaactacacacatatttattgtgagggggcaaaaatcttgcctttgctaatcttgacctcatataaagttagaacccaccagacatctcaatctcaacatgcaagcattatttattagtacttttaaaacttaccatgtaagcatgccacatcaatctactaaacacctaaagctcaacatgcaagcatagtaattatatttacaattttattacattctaaactcaaatgtatacacacacgctaaatcatcatcctcaaatcatttttcaaattatttcaatccaaattcaccaatcatttatacaacattcaacacactttcattcatatatcccacgacaaagcgcaaggtgtcatctagttatatatatgtaccctgtcaataataacagttggatgtggcttacgttttgttatgtgtgccacaccattccaactaatcttaaattaaggacataattaaagactagaaatatagatctggatttggtggcaataatccgagttgtcacatgacaatatatatagactagttatagcgcagtatggccccatttgaatcttctatagatgaagattaaaagcgggcacgcaaaacgagaaagtcattaacgcatgattaattaagttttaattattacaaacttggaaaatggatttatttgatattttagagtaacttatatatgtaaagttttcgcataaaatacaccgtttagtagtttgaaaagcgtactaacggaaaacgaggaaaaatctatatctttatgaagttagaacgggccgtacatagtccttgttgctctgctaaattatgatcaacatatatcggtttttatgatgcagtcacttacattctaaatctgttacatatgtttggcaactatgggcatacaccacctttttttttaaataataggcatcaatatttgaaccctgatatatgaagtaattcttacaactttaccaccacatgtatttgaaaaaaaaaaccagaacacgtataatcggctaggtggaacaagtagagagttgaagctaggtagagactggagaagacacatacttatatatatgcatcacaagaagaatataatcattgtcaggttagatattttctctgtttttttttcatgtgcaaatgatacattacaccggtcaccaagtcgcaaagaggcattaca

SEQ ID NO: 99974 - DNA, 652 bp, Oryza sativa
gccctatatctttgcagtaagtctttcttcctcctctctttcactctatgacacataaactcaaaggcgacgacccacagggaataaagccaaccgtgcggcgggaggtgggaagaaaggggtgacgccgggcaagaaaggagtcaacggcctccgcatgttcgtccctagcctgcgcgccacatgcttgccttcttccactccgtcaggcggaggggaggagcacacacgggctgtcgtgcttcctattcgaggagtccacaggcggggccatctgcctcctcttccacctccatacgccaccggaggagtggaacaccgccgtcctagtggcacccattgtgctcactgttgatgctcctaaagttcgtagtggcgccggcgctggacgcaatggcagggacaaggtgagggaggaggctgggggctcgtcacatcggtgtgggtcgtcggtgggtgtagtgcgtctccggcacagctacaccctctcgtgtgggaggaggttggcagcgcctgggacgagcgggaggaggaggtgcttcgccacaataaacacgctcgccaatgccatcttggttgaggataaattaagcagcagcaacctagttaatcgtggcggccaccatggccgccatgaagccagagctcatgc

SEQ ID NO: 99975 - DNA, 717 bp, Oryza sativa
gctcggtacccaaaccatactaagttgatactgttgtggtgtcacctaaccatatctgctctgattgtagagctatgctgtggggtctggtttaacagacaaaatacacaaggtgtgtttttgtgtaaaacagcaggcagcattcaaacaatgctagcggagcaggtgggcatggatgagttgtgctggaaaaagttgtgcagtgctcgttgcatttccaacacaaaacaaatactatatcataaaaatatttccgatgatagattcactttgagttttttgttgcaccacatgttactatgtttgtctataaggttaatcaaacttaaataaatttgagttacgaaaagcccaaaacgtcttataatatgaaaggtggggagtactactgaacgtgtatagaacctgtgtggcttcaattacggacttgcaatcgccagtattaacaacacagaatctcagttcaatgaaattgcatggccagtaaattaagagatgactggctgggatgggccggcgattctcagtagcgggctgacttctagttgggcctatatgggcttgtccgctcgtgagaatattgggccgactgagtgaccggccatacgcttgggctggaggaactgaagatttatagtgcagtaagttttttttttctttgagtaacaagtttatagggcagtattacttgcactgggccaaaactggcctttcttt

SEQ ID NO: 99976 - DNA, 599 bp, Oryza sativa
agctcggtacccattattaatgcactatttaaatttgaattttgattccctatgttttcaaaataaattataatgcttgaaaaaaaatgtcatgttaacaaagtgtgcattgtcataaatatagtgagctagaataattagttaggctccttatagtggacgtatccacacgtgttcaagttgaaggcctaatatcggaggtgttcacatgagaatgctaattcgcacagacacgctaactaaatatctggcgcgcgtttatggcccagttccagtccatgccgccaaaccctcacgcgggcgtttcctttttttcgcaacttccacacgcgcttcttttttcttttttctttttttttgtgcaattgccacacatgttctttttttttccttttttttgttgcgcaatagccgcatttatttttttttcctccacgtttcttttttttcttttccccgttgattactacacgtgtgtagaaatagatgtcaagatttaaaactttcaaatcaagatttttttttgaaatgttaactcagatttgaaaactttcaagtcgagatttaaaaacttttaactcggatttaaaaactttcaa

SEQ ID NO: 99977 - DNA, 739 bp, Oryza sativa
catactaaaaagaaccatgataaataggagcaattgcgaatttaccccgttctaaatcgttatggcaaaattcccactataaaattgaaaagaaaaaaaactaccaacagaactatcattcaaatagtattcttacaataagaaaatccggtggcaaatttgtaaatgccactatacttgtgaaaacataagaataggaaaaacgtaggaagagtgtcatgcccattgattttctataggaattaagaacacgtggaagttcaaaaattattgttttggatggtacatagaaaaaacagaggaaccttgtggctgtgccatggaagagataaacatgcggtagaaccttatgctagattgccctccaaattcctatgaaaatagtccattactgaatttcaaaataatctgagagagctattcctttattccaaaagactacatagaaatttttccatatgaatcaaatcctccacaatttccgtagttctctttgttccaaaagagttcacgatcatggcatcatatttgttcaaaggttaattcagttgcagaaaaatatttaggtataattttacaattcaactaattacattcccatctgttccaataggattgggagataaagttatgatttagtttctttctatgccggttttcatgatgggctgggtctttggagcttttattggaagctaggggatcgacatagcaggattttgtttttgggaaggatgga

SEQ ID NO: 99978 - DNA, 579 bp, Oryza sativa
atttttttttcattcctgcgattcaaagggctcttattatttcactcaatagagagcatatataaaccagaaaaataagtagtaaacaataactaataaccctaacacaaaataaagacaaacatttattcaaatctatttgtaaatctgcacatgaagttgataaatatccatatggccgctgtctttatgctccgtcacatagtatttagtactccatccgttccagaatataagaagttttaaggttggacacggttattaagaaagtaggtataagtaagtggtggagggttgtgattggatgagtagttgaggtaggtgagaaaaatgaatggtggagggttgtgattggttgtgaagaaaatgttggtagaaaagttgttataaattttagaataaattctgaaggctaaaaattattatattttatgatggagggagtattttttttcatgtcacacttttgtagttgtgtttaaagttggagtcaatacgtttcctgaatagtaacttcatataagatttgattgatgtttatgtaggcaacggcgagaagctggacttcgcggcgcgggc

SEQ ID NO: 99979 - DNA, 767 bp, Oryza sativa
agggaagagaagctcctcgtctacgagttcgtcgtcggcgcaggcagcctcgccgccctcctccacggttcgttcatcacatcacctcgccttctcacttctcttcgtgcagcgaaagaaacacggtcttttgcttataaagagattatgggtttggcggaaaaacataagaattttggaggattttaattctataaaaaaaatttccatgaaggtatttgaaataaatgattgaaccctatcttattctttgaaacttctatggaatggacaatcttatatggattttggaggaaatttagtaagagctctaacctcttaaaaatttttcttttgagtctatatctctcatcccattcctgtattttttatgagtccaatcaaacggttattcctatatttttcttatattttgcaatcatttgttttgtatttaccttcctattaaaatcatgcacatttcctatttttttttcattcctgcgattcaaagggctcttattatttcactcaatagagagcatatataaaccagaaaaataagtagtaaacaataactaataaccctaacacaaaataaagacaaacatttattcaaatctatttgtaaatctgcacatgaagttgataaatatccatatggccgctgtctttatgctccgtcacatagtatttagtactccatccgttccagaatataagaagttttaaggttggacacggttattaagaaagtaggtataagtaagtggtggagggttgtgatt

SEQ ID NO: 99980 - DNA, 615 bp, Oryza sativa
tgctagtcgtggcccaagtgcccgcgaatctagcgggcatttcgattgttctgccacgtcataatggtcccgtttgagttcactgaatataaagatttttttacgaacacataaaacgagaaaatcgttaatgtacgactaattaacttctagttattatagaattaaagatagatttaactgatattttgaaaagtaacttctacataaattttttatatgaaatataccgtgtagtagttcaaatatcgtgacagcaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaattttcgtatataaacttttagaaaaacatattgtttaacaaattggaaaacgtgtacaaggaaaacgagagaagtgagttgaaaaaagaggggaagaacatagcctaaagactattagaccctgacttgttaacccaaaaatcatgcaaaggaatagcaagtacggcctcgg

SEQ ID NO: 99981 - DNA, 632 bp, Oryza sativa
gcgttctgctgttggctgcttcattgttttgcggtataactcagtatggagcaaatttgcacttattatattcagatatattgttaatttatttttcatttgttgcagtacattgccaatattaaatgataaattgagttctctacatatatacagttgcagcattcatttttcacatcattgttgttagaaattagtttgatactttgattcttgctgtagaaattcaagatttgagaagctcgccatgtaggacaaataacttcaaagttccaaatacagcatactaaaatgtatgtgtcaaaaagcaagtttccccagcagtatggtacataaacactgggctatgtagagtcccgctcttcagggctatatatataacaaaattaaattggactgtccatttaaacatgaataaaaaaaatcctaaaataaactaattattgaacgcacgcatacaaaaagggttcatgtcccaaaataaactattttatcacatcacgcgaaaaaaggtgatgtgacatgaatcacattatagtgctttataatgggcggcttcaacatgaatacaaacaaatcctaaaataaaatatttatcaaacgcgtggcaaaaaacaaaagatatgtgtggg

SEQ ID NO: 99982 - DNA, 2739 bp, Oryza sativa
ccttgttgttgactgatgatcaaccgaaagtttaatgaattttgcgaagattaattaaactggcatgcagtagttgtagcgaggtgtggtgtgcatgtgctgtgtgttgcatcaacctgcagcagtgtagcgtgccattccatgtgttcagtattcgctgggttttcctggcgtcgtacacgtgcaggttggcatctgacactgccatgcatgcagcgatgcccgttccaatgcctcaggtacggcgtgtcggctgtcaggctgaccactgggccccctcctgtatccttgggctatcgcccatctatacatacactagcaaaatagtagtacgcagacaatcagctggctaaatgcatgctgagatgggggagagtagagaagagagtagaagtggacttaaaacttgcagctaatttagacacaagaattaaaaaaaactttgtaagagagacaagtggacctgtattaattgtaaagagctaactattatatgggtaggttgaaaaaatgctacaaagaacctataactaacagatcggctgtattataagccttgctctcaatagtaccggttgagccatctttagtctcggttgatgttaccaaccgggactaaagattgatctttagtcccggttatttcacccgggactaaagatagcgatttttagttccggattggtagtccaaaccgggactacaaacgctttctccaccagtgacatctcgtagaaaacctacccgtcctataaaaaatgaatctacgaccgaatatgacagatgttggttttcatgggaaggaggtactcttttaaaaggaattatgtttgtttttgcaggatggagggtatacacttcggctatcataacctaaaataacttttaaataggagataaatgcattcagagttaacgaagggagaggaatacttacgtcaggatttgataaagttaatgtatttaatctttttatttttattagtacgtgtatgatagataaaaataaatttattttggaacataggagtactctcagtccctaatccatactagtaacttttttttagagcaatccatactagtaacttagtacccctgcgctctgagctgcaaaatgtttggaaaaaaaatgcgctgatattgtgtgtgtcattggatctgaaatggacggataaactgactgcagtatgacccaacatcatcaacaattaatagtaaatatttttttcgtataactagctcctaccttcatccgaaaatatagttatttactccctccggtttcattttaattaacgttttgggcaatgacacggtctccaaaatatatttttaacattattttttctattataacatatagaataaataaatgcatgtttacttttattatagtgcattgaaagacaaatctatatatgttgttctagtttctttaaaccaaatatttttaaagttattgatggttaaagttataaaagtttgatcttataatcttgtccaaaacgtcaattattatagaagtggagggagtactaataatacattttaaatatagtaatagagaataagacaccacatagtaacaaaccactaggtacctacattaattttaacaaacgctaaaggtagctatattcatagaatgtttctgcgtttgctatgaataaaatggtagttttcctaaaaaaaataaagtgcatataaacgtccttaaatatttagccaaaacaaatagacttggttctcgtagaatatgtaattcaattatatattgtgcatgggattgtttagacattttgacatgctacacgtgaatatgtgactaaatgaaactagcgtccgtaccgtgcatagcgcaggtggtaaggtacagccggtgtgcttctcgggacccgtgtccgactccctgctcaccccgtgtctagttcatactgaaagtttagaagtttggttgaaattggaacgatgtgactgaaaagttgtatgtgtatgaaaggtttgatgtgatggaaagttaaaagtttggaaaaaaaactttgaaactaaacagtacttaaagattgatattgggtcccttctcattatccgacgcctttttacatgtgtatatgtagtaatttcaccgttttatactatattaatttgaatcactggtggagaaaggggctttactcccggttggggacccccctatagtcccggttatacaatcgggactacgaatccgggactaaaaatgggtatctttagtcccgggtgaaataaccgggactaaacatccaaccgggactaaagatggtaggagcagtcccggttaatttttttttcttaaatcgatttgctccctaaatatccccgatcgtattcccaaatcatccccaaatcaaagtagcatcacagatctggaaagaaatacatcacatattgaaaaaaatacatcacagatcataatacatcacatcacagaatcttaaacaaaaaatacatcacaaatcctaaaagaaatacatcacaactcccagatcagatccaatatcacatacatcacagatcaaatccaatgaatcacaaattcaaaaaaaaaatggcaacaaagaggatggcgccgccggcctcccggccaccgtcctcgcgagctcggccggccggccgccacgcccgcccgcctggccggccgccacgcccacccgcccggccaaccgccgcgccaggtcgcacggcggcggcctgccc

SEQ ID NO: 99983 - DNA, 518 bp, Oryza sativa
acccagcctttttacttagacaaaaaaaaaagaccctattgttttgtttctttgttacgattggatggaaagacaaatacacacacctctccacacataggacacacatagggtgtgtttaatttcatgtcaaaattgaaagtttgattgaaattgaaacgatataacagaaaagttagaaatttgtatgcaggaaagtttcgatgtgatgaaaaagttgaaagtttgaagaaaaagttgggaactaaaccatgccatactcccttagaaaatctctacccttagaaaatcccacaattgaatgttcacgcatttattatttactcgtttcgagcgattaagacattcaaacgttcagatttcaggccacatctgggagctgggagggacaacaccgtgacggccggtgtgtgtgggcggcggcgaacaaagcacgcagcatctgatgtgccgcgacccgcacatttaactcagagaccgcgaacgaacggcgcgaagccttcgggccacgccacgcc

SEQ ID NO: 99984 - DNA, 594 bp, Oryza sativa
aggaaattatcttaggacagtcaaacatttttggaacgtactgaattttgatttttcgtcccaagaactgtcgatgaactacctgaagtaacctaccaaaagtacgatttggttgcaaattatttgagaaaacgcacagtttacaaatgtatttcctatagtacaaaagatggaatgttggaggaaaaacatacttcaaccgtcctaaaatgtagctacctagtacaggatggaacattatctagtactacgaatctggacaggtcctgtactatgtagctacattttgggacggaggaagtagtaattttagagaatttcaatcctataggaaaattttctatgaagccatttgaaacaaaggattaaatcatatccaatcctttgaaatttctatggaatggacgatcctatagagattttagagaaaatttagcgagaacttcaacctcttggtaacttttctctgagtcactctctcatccaaattctgcgtttttcctacggttcaatctaacggtcattcctatgttttttctgcgttttgcaatcctctattttacacttatattcctatcaaaattctacgttttt

SEQ ID NO: 99985 - DNA, 541 bp, Oryza sativa
ccgcgcccgtcccccggtgacgccttcgacggcgctgccgccatgaagcaggttcgcctcgcctccgacctccccgtcgcccacgtcgtgtccctcccatggtagattctaacggtctgagctgtgtgcagcggcagtttggattcaacggccggcagcagtacgccgccgcggcgcagcacggccaccgggagcagggcgtggactcctacggcgtcgcggcgccgcaccatttcccgtcgccgtcgccgtcgccgcgccaccccgtgccgttcggccacgcgaaccccatgctccgggttcatagcctccccaacgtcgccggcgggagcccctacaggaaccaatccttctccgtcggcaactcggtggccggctccaccgtcggcgtctacggcggcccaaggtggataatctctactctgctctaatagaaatcatttctgaattttgagtgcaaagctaagaaaaaaaaatgagaaaggcattgagctgaccattggatcgttgacttgcaaaagggaccttccaaatccgaagg

SEQ ID NO: 99986 - DNA, 699 bp, Oryza sativa
tcgagctcggtaccctagacagtaggacgtttcagtacgtcacacgatgcccaaaagcaaagataaaccagcgttagtttttttttttttcttcttattaccaaacaccccgtttgatagatacttgttcgtaataaattaaattatattccatgaagaaaagagtgttccatccatggaaataatcctccctcagtttcttttctttttctccaatgaaatgaccattagtaccagaattcaatatccattaattacgcttgtagtccacttaatcaaattctccatccgtttctaaatattttacgccgttgtcttttttaaatatgtttgactattcgtcttatttaaaaaaataagtaattattaattctttatctatcgtttgattcattgttaaatatactttcatgtatacatatagttttacatatttcacaaaatttttaaataagacgaatggtcaaacatgtgctaaaaagtcaacggtgtcaaacatttagaaacggatggagtactgaagtagagcgaaagcagcaaattttgctatagtacgagtctgttcaaattgatgacatttttaaccatactattatttggtaaaattaataattatgtggctacatttagtttgttaccaaatattggcaatgtgtatggaattttggcaacattattaagccaatcctaccaaaattt

SEQ ID NO: 99987 - DNA, 644 bp, Oryza sativa
ctcggtaccctctgtaccatactaccatcttgaaaactgtttgttgcgttctaatgagtcatgtatttggtggttccattccaatacatgtacttcattattttaaattacaatgttcctacaacggaaaattgagaaagtcctcatggttgacaacacatcagttacaccagatgaagttattctacacaggcttggtttgattccactggatgcaaatggatcctttttattatatctcaggtcaataacttaaaattttctaattccacattcatatatttgattgctatgtatgaatacttgtgtatgaataatagctgtattattctttcgttgggttctgtagagaacgatgcctcattattgtgtacaaactgcgtgtttcatgttagaaaggcccccagcttacagttatcttcgctgtcctgcaacctaaccctttcacagtttccaatcatcttatttctaagtacgaatttcctcccttccaatttgaattgtgcaaaactgcaaaagtgatttatttctaaatattcttctccaggttattctttggagtcatttttattcactgctttttaacttttaagactaaatgccatgtgtttctcatttttactaaataagcatcaagtttacaa

SEQ ID NO: 99988 - DNA, 660 bp, Oryza sativa
acaatttacacgtaatatgtgtaattagtgtttttcttatatttaatattctatacatatatctaaatatttaatgtgacagcgtgaaaatttttgttttgggaactaagaggctaaggcaaccttgcatataggagctatgcttgggcgtgggcaccacacattggtgggaaatttgtacagttgatgtaataggagacgttgacgtatgggtttagtcaatgtgtcagtcgttgctactgcattacaccctccgttcaataaaaaaccaacttttggggatgaatctggatccatatttgtctagatttatccctagaaattatttttttttgacggagggagtacgtagtagcatttatactgtcgagtatacgtgttcgccatctgccggccggaacagtccagacgctcacgataccaggtcaagtggatatgctgtactattgcaaagcggtattaaaaccgcgtcgtctctccaaagcagctttaataatttgtttaataatttccctgataatgaaagatcgtattggtttcatgtagtgaagtgagcctacctcaactaattaggttttttttttatagaatcagttcactcgaatttaaatattagatttaacgtgtgtgctcgtatttacaactatttattattttaat

SEQ ID NO: 99989 - DNA, 539 bp, Oryza sativa
ctcggtacccatctgtgtaattagttatttttttcgtttatatttaatactctacgtatgtgtccaaatattcgatgtgagagcaagtataatagtaggctataagcaggctaaatgttgaggtggaggagaaaagagagaagagagaggagaagcgggctataaacttacagccggcttgcacacaagaaccaagaaactctgtgagagagacaagtgggccctatattaattgtaaagagctaactattatatgggtagactaagagaaggctataaataaccttatagccaacagattggctgtattattagccttgctctgtcagggtgaagaattttaccgaggatctaaactggtccatactctcatgcataatgcctttttggttgtaggcttggaatttttaataatttcatttaatgagctcgttttggaactgtgactgtcaacttgaaattggtccaacacatagccagaataaattggaccttttgctttcaaattattttgttaacctggacgttgcactttctag

SEQ ID NO: 99990 - DNA, 742 bp, Oryza sativa
agctcggtacccagtattggtatacaagttagcaagcgagtcttcataaagttactccatactatggttttggccactgcttccatctttaggcttatatataccactcagtgtgctacatggtacatactgtgtaagtgaaataaagggttccgagatcctattttatgagccttttttatcacagattcctgcactttggaattgggataaagcaggtgccagatgaatagaaatcgatgcctaatacacataagaaaccatagataaataataccagacacagaacattcccattgaattgacaccacgaaataataagaatttcagtttgatcccatgggtataacagtacaaacatctgattgaattattgcctaaggctttaagatggtaacactgatcctacacaatcttgggtaaccacctcacgtattttatacatggttgtttgatgttcttgctgattaaacttgattttaacaaattttttgtgatctcagacattctgaatgtttcatgtatgcacaagatgcatctcattgtgcagtatgtttttggaattcacacgaaacagttaaactagtgcgggaaactggaaaagttattgggttccaaggctcccagcagggaaaagttcttgatttaggactctttgttaaaagatggataaatggcacaccatgctgggtttcttttactcactttcgctggggttgagaattctctatacgtcttgggt

SEQ ID NO: 99991 - DNA, 727 bp, Oryza sativa
ctcggtactccttattttttatcgatatgtgagatgagtgaaaaatgaacctattttgagatggagggagtaatatatataattgctggtattaattaatataaacttgtatgtctaattaagtcattttccgtgagaatttcatatacatgttactaacataaaaacacaaaattgctcccaattctacatttctttgatgtattagacagtcaatgcaacacaagtcggagagttctcgaagctgaactttctggtaaatcaattatcgccccatatatggccattcggtgatggaggctgcagcggctcgaaatttcctgtaacgttcacatatatacatatatcgtggttaagcttatttaaatttattagttaattaatcactctctcggtcatttctggataaaccacttgacagtttatgtacatgaacatcttgacttggtgtgtcctggtgatggtttgagtcttctgaaactgactgacgatgcataagcatgtggtttagaaactctggaaaatcacccattgcacgaatgggcaaggggggggtctccatcataaccacatcaaagagaccatcaaattaatcacgagtaagcgtatcactctagaactcatatctgagagctatatactttggtattgcaaaagactagacactatcaaaattcagtgggacagagctactccctttatttttttatataccatacttttatat

SEQ ID NO: 99992 - DNA, 524 bp, Oryza sativa
tactcataccaacaagttacaacttcttttttggaagccgatctcgaacgaattcttaggttgcaacccaaaagtccaataaatgtgaggcattgattcatgccttgatcaatggtgaagattgcctcatcttttgtgatgggaagaaaaaccagcctccattgaaagagtagagtgtaacagcaacgattgaggattgagaagaaactagcaaaacacaagagagagagaagagagtggagaagaaaagtagctgccagatgtaaaagggcccggcctcggagagtgtggggcgtcacactgtgctcttagcctattgcagcccaaaagtccaataaatgtgagccattgattcatgccttgattaatggtgaagattgcatcatcttttgtgatgggaagaaaaaccagcctccattgaaagagtagagtgtagcagcagccattgaggatgagaagaaactagcaaaacacaagggagggagaagagagtggagaagaagagttgtaatttgttcggcttg

SEQ ID NO: 99993 - DNA, 572 bp, Oryza sativa
ctacctctacccctacctttttttgtctttgtagccaatcaagcttaaaagccatggataaatggagaaaaataaaaaagataaacccagcatgatggcctacgagatgacctgcaaggtgggtcctcccaaggtgagtgcacttgagaatatctcaaagcggggctctcctacgtgtgggcccaccccataaaatgtggtactttgccttttgggagcctgtcatgtggggccccgacctacctctcgatcatgaccagctagcttaagactaaaaagcaatcaaaaacatatttttttaaaaaaacacttggaatccgatcaaatcattccatgcatgggctttttcatgggtgagtgtgtaggtgtttttacatttggtcactcatttcgcttgcgattcattcatcacaaccggctgctttccgttgaagtttctcggagccaaaccagttttaagctttaggtgaacagaacgaacatttgtgtacacatcaacacagctgtgttgcttacttgctttgatgggagctagccgccatgtgttaattaattaatttcttgaaagcaat

SEQ ID NO: 99994 - DNA, 1043 bp, Oryza sativa
atctaaatttgtcttttttgtttctcgatgtgtagatcgaatttgaacatgaattttggtggactagtaggtatcattatactctacattgttaatttttttcagattttttcacaactatttgcatcgaatttgaaagaaaaaggtatacgaggggatatcccctcgagggattagaatccactcctcatatagaacgacatcatcattggagcagtattttgaaacccccatcagggcagacagaagaacgacatcatcattcgatctcattaaacaatagtcgcgttaacatcttcgagaagaagcttctctttgaattctcatgccagatttaggcaacacggataagataacacgagccaactcgatctactatagtgcagagcccaacatagcacgaggatagcaaaaaaaacacggtgtatatcatcagcatgcatgatagttacaacacgaggcaccattgaaaggaacaagaaataaaagcagcaagttctgaaaaaagaaaagaagtagaaaagaaaaagaaagcaacacaatccatgcacgcacgcagctagagccatcgagaacgaaataaagcaagaaaagcgtgcggcgacggagctctgtttcccgaatccttcttctccaccgatcgatcctcgggacgatcgagaggttggcaggcaggacgatcatggcagtctcggcttttgggctttttcgaacaagagttccagtcagtctcgtcttatctgccaaagggtgaaagtaggaagatttttgactgtggatgttgtggcgcgcgctagctgcttgagccacgcacgccgagcttcttgacctccaccttgagcgacttgaggtagcggacggcctcgtcgaggacggcgggggtgtccatcctgtcgccgccggggatgatccccttgagagtccgcatcatcttcttcatccgctccttcttcctctcgccgccgccggcctctggcttccgcccgccgccgcagtcggacctggacgcgccggacgagcacgtggagtccggcgagcccccg

SEQ ID NO: 99995 - DNA, 551 bp, Oryza sativa
actgacgctgaatgtggtgaaactataatgagctatcaaatttcatcaaacacggcagaagacattacctgtttgcagcaccagtatcgctcacattcttctcagccttatcacctgcagaagcttcaccctcccagacaacctcggttactgaaacagaaaagcaagtaagaaaatcaatgtctccaattaatacggatgtaaagcagaccagggaattaaactaagatgcatgttacaataatattctgacaatacatggtaacacatatcagtgccaccttaatattctgtaggcattgtgagcatgcagcactgcagccatgcacccaaagtaatacccaaagtaatacggaaaaaagcaccatttccatgatttccttacatgagcttaaaactagaagattgactataaataaatctggacatactaaacgtcactatagtgtaaactatttcgttcgtctatattagactaaactacacttttctgtactatccttactatttcaaaagaactgcatactgtctttattgctttgttatatagg

SEQ ID NO: 99996 - DNA, 668 bp, Oryza sativa
gtctaacaaaatatattttttcaaactgggagatgatgtgatatgaatgaatatataaaagaaaggttatatgcagagctcagatggattttttatgggagagtactcagatcagggcgctaggagaaacgatgctcgctcgggcgcttcatccgccattcaatctgggtcactggaatggtagtgctgttaaaaaaaatcggatgatagatataggaagtgaaacagcatacacgatagtgtcacgcatctcttttaatttttttttgccacacgtttgatgttatgctcagatatttttttggtgggtatgtgataaaatattttattttaggataatgtcacacatatcttttgttttttgccacgcgtttgataaatattttattttaggatttgtttgtattcatgttgaagccgcccattataaagcactataatgtgattcatgtcacatcaccttttttcgcgtgatgtgataaaatagtttattttgggacatgaaccctttttgtatgcgtgcgttcaaaaattagtttattttaggattttttttaatcatgtttaaatggacagtccaattaaatttggtaaaaaaaaagcccttaagaacgggactttacatagcccagtggttaaggaccataatggtggggaaacttggtttt

SEQ ID NO: 99997 - DNA, 580 bp, Oryza sativa
  unsure (1)..(580): unsure at all n locations
ttgcatattagtttgtattaattttatgtgcaattaccatttgtaaggtaacatttatagttttttattttttaaaattttttaaaagaggtttaaaaatttagtagcattttgttatgttcactaaccattgtttgaaaacttattttaaaaagtttgaaacatttaagtaatatttacatttgaaaagtagtaatactaaggtttatctatttgtatgtacaattaccatttttattacaactattgtagacattttcaaatcatagaaatgattttaaaataattatgaaatagaaagggtcagttctgcaaaaatctgtccgcctgcgaagattattatgccgagtagggtctacatcttcgcaggccgaccgatagtaaaaatgatcttcacaggtggaccgcccgcttgcgaagatcgttttcctatataagggcaagcccgccgcaccaaaatttctaagttcaaacggcaaccctagaaattttggcgctgtaaggtgccaaattttttcgccaccgcacgccttcgncgtncttcgccgncagcttgttgtgaccttcacccttcgaccat

SEQ ID NO: 99998 - DNA, 511 bp, Oryza sativa
atatatctcttctctatctctactacttaaaaaatacaaagtgtttcctccgtccgtctaaataaaaaaaatagcgaaaaaaaccgaaaaaaaagaagtccgattccccttaaaaacagggaaaagcaaaaaaaaagagtttgagaaaaaaaatagcgaaaaaaacaaaaaaaatcgtagatccggttcccttaaaaatggggaaaaacaacgacaaaaaaacatgctgtccgattcctatgcaatggaaaaaaacagtagatctgattcccacatatggttttcctgttttccttcttttttttcgtttcttttcctttttttctttcccttttttttcttttcttggttttttatttcttaatactatatatgtatacaaactttatatacacgtatacaaactttgtatactgtatattttttatacacacgtatataacaaaaacctttaaatcaacttttttgaatttaaattttggatgcggctggtcagccaataagcgaacca

SEQ ID NO: 99999 - DNA, 782 bp, Oryza sativa
ccctcgggcccgaccccccccccccgagggggttaggccacgtgggtgatcgtgtctgcctcaagtctctaagtcatgatactcccggtcccatgtcaccgacacacacctacatgcacacacgtccgtggacgacgaacggccgacgatgagcttcggtcatggacgacgaaggaagggccgacgacaaggttcggccgtggacgatgaaccggccgacgaagccgttcggccgaggacgtcttcgctcgtggacgacgaaaggccgatgacgaagccgcatgtggacgactgcgagagagagagagagagatggcggcagcggctgtggagcggccggcggcggtggagaggtcggcggcgcggtggaggggccgggggggaagcagccggcagcggtggacggtggcggcggtggagcgctagcgcgcgagcttgcgcgcggtggagaggtcggcggcagcggcggagcggtggagcggcgccagagcggtggagcggcggcagaggggcgcggtcggtggagctcggcggtggagccgccggcgacggcgaagcgggcggcggcgggaacggcctggccgcgggggagctggatcgatggccggcggcggggttgtcacatactgattttcgttttaggatttataaattatgtaataaattattatttagaatttatattaaatgttcattaatttacaagtgaagttagatgtgggaaataaaatttcctaaatataaagcatggctggatttaatttttattaaattctccatgg

SEQ ID NO: 100000 - DNA, 2312 bp, Oryza sativa
tattattagttttagtgtgaaactgacatgtgggtcccataggttttattatttttctagatcggattgccacataagcgccacgtcagatgaagaccgagccaaaatagccacgtgggcgccacgccagccaaaaccgccaagggaccttgtttgtccggttttcgcaagttgggggatgggtcatatccggttttgcgcttcagggacaaaaatcagactggacgacaaatagagggacctaaagtgaacttattccccatataaagcccactctctaaagcccatcagccacaacgacccacctagcccaccttcttcctatcctctctctttctctcgctctctttcttttcctctcgctctcccccgtgccgccgcccgccgcatcctcaggtctcactgccatcgccgccgctccacctcacacgccggccgctgctccctgcctccggcggccgccccgcagccgctgccggcctgaatcggtttcatggctcctcatgagcctgcccccaagctaaccctctccaatcgatgctgctgcccaacgacgaagacacccgcctagagttccagattgggattttccccagcttcagcaccccttgagccaagcatggcttgtctcccccgagttcctcctttctgatcatccccttttctccctacttctgtgatgtgatttgattggtactctcttgtgtgatagcatgctctgaattgtgatgcttgtgaactaatcctagcgaccaacttgatgatgctataatcaggattgtacttactgtttctagggttctagataaattggcttgctagggttggacgaataaatttctgtatgccatgagtgaatgaatgaatgctgatgcaagtgcagtactggaattagaaaagctaatgaaaatcacactaacataattaagtccttgtatatgcttgcatgatgaaataactgaatttggcacaacagcaggatcatattctagaataaatcttattgaatgatgcagtaatttacatggtactatactttgaaaatcatgccaagatatgtactatagagaatggaacaccttgaatacagatagatggtaactgatttctttggatgatttactgctactgactgtatgtcatgactataatttactagattagagttgttgatgcagggaaaaaaataaactattgattaactaactatttactgtggttttattctgagagtatgattttaaacattcgttctgctacacaaatgatttggtagaaaaaaaaaacttatatgttctgttaagttattgaaatttagtagaactacgactatttatcactatatgcatacttagatgtacttctattgtctcttttctgtgtttcgtagtaaagaactagatacatatgcaaacttaacccagattcataaccaactggtttcgcatgctattctacaattcaaatgattaataatttatgatggttcctctattaagtctgggttgattttcaatacttttaaatgaaatcagattaatatacacataccctaacctttccaagaatatgcacagcttagattttactttgtttgtatgaccaaaatctgaaagttctatattttttttttaagtgcacatgcatgatcaactatctgaataaaattcatgtctttctttactaatttcccgttcctggttatataagcagttacattgtgagtttttgactgtgtacataggcataggtagcttagtttcagctacagagattgagcagattacattctattgctgtctcaaaaggtttctgatggacattatggtgttacaactatcttaatttccaagttcttaacgtatggggcaaactgaaaagtgatctgtgctcatgccagatcctaacaggggacaaatgaagtgcagtgttaaagttgcaatggcatttcaaaaaaaaaaaaaaaaacattcatctttgatttcttgactggggctcatgtcgtggccacctccatcctcctggttgccaaccgctgaggaggcgcggtgcagcccaccgcttccatctgagattgttgcgtgggcgactggaagcggccagaggttgagttcctgctggacaactgtgggcgaagaggcaaaatggctgacgaaggccagcggtggctggagattgatgatgaagcaccagtctgtggaattccttttttccatagccacttagcccctcctttcaagataacttctgtatgtttgatgcccctctaataatagcttaggattttttgagatatcgatagctacaaccag

SEQ ID NO: 100001 - DNA, 591 bp, Oryza sativa
caaacaccagtcatatcaagaatttctaacaatcttacagtagtaagaaattatgactattgcatttttatatgaatgggttataaataaatatcctccttaatgtgaaacggtgtgatatccatacagagcgtactagtactacaagttcaagggtggagaacagacccgaacaagggagaagctgctagtacgtacctattggccggtaatactccactcacttaatgtataccaactgtttcacaaattgcaaattttaactatcttttatgatatgtcatgaagtgtcacaagcaaccacgaggaactgtcctttgcgggtattacgcttgctaataacttaaagttaatgggaggtacatgactaacgcggaggatctaactctctatactatgtgctagacagcttcatatatttatgacactaatatattatttatcttcaatgcatgcagctgccaagattacaatgtcgaacaagcgttgacgatacacgcataaaaaatatccagcgtgatctgtgccacttcatccaccatgagtgctggcatgtgaaaggagatttcttctaactagagggtgccctat

SEQ ID NO: 100002 - DNA, 589 bp, Oryza sativa
aatgttatgtttgccccttctccaaagctacagagatatttcaacacggtttcttatatgagtatttgtactacctactatatactcattgtgtagcaatatatggatgacatccaaacatgccctgtattctataggggatacctcaaaattctgtgccattatgcaaaggaggtaccaatcgtctactaatctgttgtaagtgatgtactgttgtttttattaagctaaagcactaaatttttctttgtgctgcagtgctatagatgagaaaagattcaattagttcatgacgaaggtatctatgagaaaatgctgcaattctcatatcacctaatgattgttgttttttctaacctatactccacattatgtaagatccattctcctctgtcattgctacttttttgtaagtgtacatgattgtacaaacaattatttgagcaaacagattgtattcacatttaaatcttggtgatagtcacaatgtgtacatgcatatgtgggtatgcttctgacataaagttcttttagacaatgtttatatataattcttaaaagttacaactgtagatactgtggctgtgtt

SEQ ID NO: 100003 - DNA, 577 bp, Oryza sativa
tgataaataatagccatgctgcatgttctagcttgagagtataagaaataatatgcaaattaaggaaatgagagacgtttggcttgcctggaacagtgcgccttgtggaagtaatcggtggtttttgatgccgccggcgccggtgcggatgaagatgtggcgggcgcccaggcttgttggcagggcactggtcagctacggcttgcgctggtgcccggcccggctgcagcacacgcgccagttgtcgcagcgaaacgtactcgagccacccgtcgtcgttgttagatagcttgtcgtcgatcctgttagtgcgtgtactggtcgctgaagtcggcgatggtcgataatcagggtgaagatatgtccgccatccttgtctgtccgatccggatatacgtacgtatatgcctcgacaccacgccctcaggctgcacgcgccactgatgcctcgccgcggcgcgccaaggttggacacgtcagtgctcgtggcggcctccacggtcgcccatgcatgatgcgggtgcgccgtcaactcagcatcaatgtagtggggtaccgagctcgaattcgccctatt

SEQ ID NO: 100004 - DNA, 643 bp, Oryza sativa
ctggtgctggtttgctagttgatactattctcagagttcatggtaagatgatgggttgattgtgtaaaatatggttgtcagttgatgaactatagtttacacgttcaaatgatttggttcagccccaacagtagatgctgaattaactgagccttttgggttccgaattaatggatcaatgtgtaaacacttttatgtatggatgatgacaattatgttttttcctattatacgcgtatgaacagtaatgtaaaatatatatgcatttgcagtacatacacacctatcggggcatttaactatttgccacttttagatttggcaattaactatttggcatacctatctcaatgacatgtgggtccacatatgtctatgatatgtgggtctaatggcaaatagttaattgccacatctaaaagtggcatatagttcattatctccacacctacacctcactgacaacgctgggaaaaaaataggatgatactccactacagtttgtcactaattatgcattaattgctgccaacaggaaaaaactgaattttctttctaccctcaccaaataaccttcatctctttttgttggtaacaattcatctccacattaactcatacgctaagctgtttacaggaggcg

SEQ ID NO: 100005 - DNA, 784 bp, Oryza sativa
attgaaagccatgtatatttgtccccattttctttaccatggtatatttatccccttttgcactttggaccaccctctctccatctatctcttctccacctctggttccctaccccccccattcggaccttgattgacaaggcgtctgtgtgctccttttctcttgaaccgcgacattcttcctcccaatcccatttctccatcatgcctcttagcacctcgaccacaaacgccactggatcaagtgaaattggaggaggaggaggtcaagcttgggagccatgagagcataggcgatgatagagatcgagctcatggtcttgatgatgctcaagtttctggtgttgcaagtgaatatcaagttttgggtcttgtcgatgccgttgatctccctctcctcatggagcagagctggagggcaaagtagtgcaactgcatcggcaatccccatgaagaagtaaaagcggggtagtggcagtcgtccccaactctggtcagttagatctagggaaaaggatggcatcaatggtttcatggaggacaagaagaaggaaggaggtagtttttccttactccggacattgatatttagaatgaagctgaggtaacaggcaacaatgagcttgtagaggtcctcgttgtcgagcttgagctccccaccgttgtcttcctacaaggaagagactgagcttaatataggggacaccagagtcaaatgttgagcttgagctcgggggaggtggcaaaccagcaataacaggtggggcgggggtaccgagctcga

SEQ ID NO: 100006 - DNA, 506 bp, Oryza sativa
aaatctaaaaactagcatcggatgtaaaaatagacatctgattgatttgttctcttcaagtcctaagtactagctgtgttggtgcatgcaagtatgccatctaatctgatttcaacatttttcctgatttgatgtctctatcttaattagtttgtgagacgactaggcaacttcagctagcgtgtcatttttaacagaactccctcacaaaaccaacgtacctgatccgattggacctgctgataactattgttctccttgcattttctgtcagggcaactctctcaagcaagccgcagccagtagcaaagaccgaaaaaagcaatgcttcgagtaaaacagccggcaacaagaaacctgccaaggctggaaccaagcaaggcaacattatgtcattcttcaagaaggtataagccttctcgcttatctgacagagttattcaggaaggagtatctgttgttgccctggctaaagctaccgtgccaagctcccaggcaactgtagt

SEQ ID NO: 100007 - DNA, 695 bp, Oryza sativa
tttgttgttttttccattcacatgcgtttgcagcttggcaactagaggagctgacttctggattgatctcctctcttattttccaacaatgagcatttgttgcaggtaatgagcttgtacagcaaaaaaggatcaaatttgaaaccatctgttacagcttatatgtgtttacattgaattagcaagtacaataaagaaggctcaaatttcccttttattacagttaatgagcttgttaaagtctgtctatatattaaggaagaaaattaatgctgacaaattagttgtcaaaatttggaaggcaaaatgtggttttttgagccaagtaaaattcttggagttgaactatcctatcagatcacaattgcgtgattaaaatggaagtccttttacttgatattgatcaataggttttaagatgaatctttgatggccggcttagtcacctgttgctttctccattttctatattttatttttaatgtaaagctttatacaatataagatagtttctcgcaagcactcttggttggtgcataagcctaatgtttttgtcatatatggaatggattggtcttatctattatatctttaataacaaattttaagatataagctttttgtgacttctggtatttttgtaatcaccaccgcattgttcaatacaagacagcctactattcattttattgcca

SEQ ID NO: 100008 - DNA, 1002 bp, Oryza sativa
gaagattgcttcatcttttgtgatggaaagaaaaaccagcctccattgaaggagtagagtgtaacagcaacgattgaggattgagaagaaactagcaaaacacaagagagagagaagagagtggagaagaaaagtagctgccagatgtaaaagggcccggcctcggagagtgtggggcgtcacactgtgctcttagcctattgcagcccaaaagtccaataaatgtgagccattgattcatgccttgattaatggtgaagattgcatcatcttttgtgatgggaagaaaaaccagcctccattgaaagagtagagtgtagcagcagccattgaggatgagaagaaactagcaaaacacaagggagggagaagagagtggagaagaagagttgtaatttgttcggcttggtggctcttacccaatcttcatcaagtcaggaggctcaaacgtgattggattggcaccaaacttggtgagttcgttcctcactttgatcacttcaatctgatcagtttatgtgagaatcggttgagaagagcactggatttgagtagtagtttttcagctcgagttactgcagttacagcttatgcaacatttggtagaatgtcagtttgaggggtcaaatggtgatcgattgtgctgttttttttagagtttggaagggactcatacaccatcatttctatcaagtttcgtacaatttgcatctataatttgggagatcttagctgagaaccgaagaggacataatctactatttctcgcttgtttgatgatatacctcttgttagttttgatggttgatattgatgatgtcatgtgtgcaacttgatgttatagctattagctattgttgtgatgtgtttctaaatgttctagagaagactccatttgtatccattgttgattatagtggaagttcggagtggaacattggtcccgtggttttttattcctcacaccgaggatgtttttccacacaaacaacatgtcttgtg

SEQ ID NO: 100009 - DNA, 7601 bp, Oryza sativa
cccttcatccaaaatatagttgtctttagactatgaatctggaccagattcatagctgaaggtagctatattttgggatggagctagtagttatttgcgtgaaggtggagaaaggaaggagtggtgcggttttataagcacgtgtagtacaaaagttgaaagtggtaagagtgataacgcacgttgggcaaagcatccgtggtctccaaaagactatacttttctacatgaatctaaaaaagtgcctatttagatttgtgcgtacctaagagtgaactttttttagatgggtcttcagactcatagctatatacgtggttaataaaaagataacacatgtgacctacatgaataaatatatatgctatggtcttaatggattctacaatgatacgagacatctaggctggagtaacgttcaaatctctactattagaaaaattaattgattcaggactaatctcatttttgttggtcaaactgcattggatatagagtatttgtgttggtcgtccatatgaaaatcgcggacagcactacggcatggcacgtccgctagggaatcagtctagtgctggttgcttctgcttgcaaggcgtgcagtgtcatttagagaagcaaagtttttcaggttggttatatttttgtcatttttatctattgtgatgtataaatatactagtattaattatgttgggtctatgaaaaattattcttgtcatggaaaggtctcgtgtacgtaatcagtgatcacacagatagtgttttctgaattcaaacgtttgttggaagaccacttcagcacagccaaaatttgtgttcgctttgttgcagcaccaaattgctgctgttttccgagcgtaatgtaagggtcaactgatgtggtaaaaatcgaaactgaataacgtagagacatgcaggtaggaacatgccaaaaacggtgctagaagtcaaatttactacataatcaaagatgctcaccaaggcaattcaagaatctgattttctgcaacaagctttacaaatgccccattcatcgaatggccgaacttacagtccatcttctcataacactaagcaacagtcatcgagcagccgacaatcctatatgattacacagggtacaagtactgtcaaatttacatcgaactaacacagtacatccccgttaatggatagcacactaagcaaagggaaaaatcaaaccatccttgaacagctgaaccccaacgaaagcatccctgtgtggatcaaatcacatgaccagctgacaaaactggccacaatgtagaaccacaaagtagaaaattgcacaaaattgtgatatgatcatttccttacagctcttcccatcctcagtccctccactcccttgatgtaatctctcaacacaaaaaatgttttcttgcccagagtcatggtttattgtgtgcatggattgaagctcgtacaacatgatgaggtggtggagctttttcattaacaagaatctgttctggaaagtccacacggattgatttgaactgatagcgctgtttgacatcaaagaaatcaacatgtaaggtagggctacatttgtaaagggtaattaagcttttgcaatatattcatataatctgatgaaattataattctatgaaagtactttctaaaacaaaactatacatatgattcaacatgtctaaaatgacatgttttcaagaccaaacggagtaactactaacaaatcgctacttgtagcaactcatttaaataataagatgctaatacatgaaccaagaggatttggttatacaagaatacaagggtactagtaccaactaccaacacacttcttttacttccttttttccttctttgtaattatttctaaactctttttattaatgaaaattaaccacaggggattcctctgctgtgtttgcattaaaaaaagcaacgcggttgttttttttaaataaaaagaaatgaactattagcctaactctctactaattaaaaaaaagcatgcggtagtgtggtttttgtagaagaccacactcgaggcatcaggcctgacttcatgagcaccaggtttttataaaatgtactctattgtccatgctttctggtgacaggcacatttttactaactagatatggatcaaatatcaaatcttttaaaataaaaaaattgaaatcccatacctgttctttccaagatatatccagaattctgtagtaaggatccaacaatgccactcgatcaccttctttaatctaaggcatataaagtttacattagcatagtacaggatattagaagaaactacagaaagacaaatttgcagtcaacaaaactattttgcatattggaatataagacagcaactatgtcaacaacagagaactcacaatattttcagcaaatatcttaaacctaaaacatggttggataacttgatgggataagtccattttacaccctcgaactctttgctttgtctaaagtgcaccctcaaactctaaaaccggttatatgacaccccctaactttcaataccgtttaaattaccccttccattcaaaccaggatggtttttcttaaattatgctgacgtggcaatccaatcaaccaaaaaaaatttaaaacaaataattggtcccacgtcagctgccacctatctcctacccaaaatctctttcttttcactttcttctttccttcccgagcgagaacgacaccggcgataagatcgagttcgcccttccccgtcgtcccccacccctcgagcgccggcgagctcgagctcccccttccccgttgccctctctaggtctcccttccccccctctctacccacgtgagacaatggaggcgagctcaatgagcaaggcagcagcgatggtcgcgaacaccggttgcgtcgaccccatgctccgatagcagatctggaggtggcacaaggagccgaggaagttgggcggtcttggtggttggagatggcacggacgccgacgagcttgagggggataggaaacgcaggtggtggcgagctccaccctccacgacctcagtgccgcccacctcgtctgcctccgccgttgcctctgcactgcatcgccgctgcggcaaccttcttcgaccttaggcaaggggacgggctctgtgtcgagctcagccaagcgggcgggcaaccccgtcttctccgacctcaggccggcggatgatggatggatgcggaatcaggcgtggcatgaacgcatggaggcgaaaggatgcgaagattgggctcgacgcgcgacccgcgtccactgccacctctcgctcactcgatccatcgccaagaccaggggcggcaagctcggggaggaggagcttcagtggagccgttgcttgagatgcggggggagggaggttggagttagagctcgagctcaccgggaggaggcggcgcttggggaggcagtgttcgagctccccagcgctgatctcatggctaggggtggtcaccagcgccgatccatggatgagagaagagagagatgtgcctgactgtgagggtgagagaagaggaagaggggctcaatgacgtgaggtcatacgccacgtaaccgaaaaaccactctggtttggttttgggggtaaattgaacggttttaatagttggagggtgttagatacccggttttgtagttgtagggtgtattttagacagacataaaagttcgagggtgtaaaatggacttatcctgattagttgattccatatgccaaaagaaaaagttaactctactccccctaaactaatgcgtcggcgcacttaactactagaattgggtcacttcacacccgaatgaaatttatcttttttcctttcaataatttatgtttctatttggataggtcagtagaacacaaggccagttaacccccgagtccagaaatatgaaaaacttgcaaatggtcatgaaaacattcagaaaatgtctttaaatacaggctcattatcatacctaaaaaaatatttcaatagacttctataagggtaaacaaaatagacaaatatggagtgaagtgacatggttttcagtgaactagtttaggggaataaagtggacctcttcctatgcaaactaattatttctttatatgttttagatactgatgatttcaaacacttgtatctactttttatataacaagcgaaatatcatattatgaaactatgtcatgtaaaagtataatgattttacatgattaacttaaggggcaattaattaccctttgggatattactgatcaagtatataaagtttgactgtaggtttccgaacatcttgcactgcatcgcatttctgaacagcaaggctcaatgagtcatgatagattctaggacatgcatccaattgaactatacagttaagtcaaatcaagctttgcaacattttacaaatgaccatgaagaaaatgaatactatgcaataatatagcaacaacgcaaaacaatcagcttactgccatcactacgataaaaagaattacaaagtgcaaatttccatttatgatagcacaaacattcactggtattaagagatcttactgcttcattccgtagaccatagactgagagtatgaaataagactgatccaagtcgcatgttaaataatacctgaaattatcacatttcagtataaatacaaaggtacgcaataatagaacccaatacaccaagattggtgttttagtatgccatctttgattgaatagagatgcatattgaatctgattcatctaaatgatcataccatgtttgagcagcatacaataaccccaggtaaccaaaactagtagcaaaagttctagttcaatgaggctaatagttaacacccattctattcatgtgaaaaaaacaaacccattctattcacgagtattatatttgcatgtttaactgaccgcattgtaaaacctattacaatgattacaatcaaggttaaatatgccagtcataaccgctcagacccaaaatactgtgcttaaataatgaaagaaaatagaggccaatactttattgaattcaactaaaatatttaacagaatttagttgagcagatcatgactagtgcaatcttactgcttatctttggcaaaaggtcctgaagttaaataaagctcaaggttattatttcagccagtaaaacaaatccaagatccttgcaaaaatgttgatgtatagtaaagcaatttttaaattcaagcttatcattgcagtttagcatccacaattcccagttataaaacagttcttataaggaaataaaggaaaactgttttggacaatgggtggacaatttgctgaaatattttcccttttgtggatagagttagaagatgaagacatgccagttacactgctttcttaactacaactaggtgcttcaaagttagcacactttctaccaggtatagtatctgtgtgcaaatttcaactttcagttaatgtaactaataattcttctaacaaaaagttgctaaattgctctatgctatttacaacaaaaatcatgatgttccaaagaagagcactcaggagcataaaaaaaatgtaaatttgtaatgggtctcgcataattaatattgatttcaaggattaagagaacctacattggagcaatgttgtcgtgtcttatcaaaagaatgactttccccaacacagcaactgtcttgttcaaaccctctgataggatgcctatggttgctttcttgtgagatgattttactagagagaataaaggagaaaacgtataaaaaccaacaggagtacaaaagaaatcttatacaggcttgaatatatgccaagtgacagtgaaagtattactgttgacttcactcaaagaagacactgatgatgctaatctcttggatcgtaattgtccctgtggaagaaattattcataagtacaaataaataagaaaataagttattccaaaacaaatcattgtcaattcatgacaaatgaaacttgaagccttttatgcaggcaaaaacaacttgaacttcagaatggttttatgattatgtgtggcaccatgcaggaattactgttcacgcttgtgaacagtaagcgcggaactctagcatctagttgcgttaggagacaatttgcttgagttagcagtttgattggagatgagatttttgggttgtttaagttatgtgttagcatattcgagttaaatctatccctttcttattaaagatatgttattagaccataaacggctaaatcactacaaagaacaagacacatctaccattcacatcaaccaaagtttctacctgaagttcatcattccaatctataatgttctctcttctgttcaaccaacgccgcttgcttgtcttctcagcaatattttatttacccaatgaactaaaggtttattagtcgcagtctagcatatttcgtaaaagtaactccatagatcgctatagttatgaaaaaagatgtattctattttgtgttattttgctttgttttgccaagttgcatgaatatggacaacataaagttcttatattcatggttggtaagtaggaagcctctttgatttagaataagataaaatgcgagttcaaaaggttaagatggaagaattttcatctgtttatgttaaactctggtctacatgccatagttacatactccctccgtcccataataagcgcagttctatccgtcttatttgaaatatttttatgattagtatttttattgttattagatgataaaatatgaatagtactttatgcgtgacttaacttttcaatttttttcataaatttttcaaataagatggacagtcaaacgttgggcacggaaacttatggctgcacttataatgggacggagggagtagaagataccttcattgcactatctagcttatcaaggagactgatgatcttctgaacttctgtatcagcaccaagaccaggatcttttaaagctgcagcttcaaatccacgaagtgctctttcatagttctctaggtatttgtcagcctggaaggaaccaaaacaaataacatattacacaaaaggatgtcctatacttggcggaaaattcagttgatttagctacccagtttaagttatgatccgggttactcactgtggcacaattatagtagaggtctggattacatttcgtagtctcatccttttcctgagcataaaatgaattcaattatattcatataataaaacaaacaaggccacccaaccacgcccacccaaaatcaggaggtgggggtggggatgggggtgggggtgaggggggtcaactctagcacccattacctaaccgttcgctttgcagactctaattagtaactactccctccatccgaaaataataatagggaaaattgattatagagcaccaaaagtttctgtttttggttttatagcaccaaaaggttccggttcattttagtagcattgcaagttacctccgttactgattttggcactatccaaattgacgttatctcccccaccttgccccgtctatcttcttcatcctccccaaaaggtgagttccattacatggc

SEQ ID NO: 100010 - DNA, 3140 bp, Oryza sativa
acgagatctggggtgccagtggacatcatcacaagctgcaggacgcacgttcagctgtccaggtgagctcatgtatggtcgtgcatccagtctagcttgtggacttgtggttcagcaacattgttctgcctgtatgatacccaccctgctatacttcagtttgtgcacattttttatccatgaaattgggattggctaacaaggcaagaggattgatgttggaacagcgttcatcagcaagttccagtcttccagagatgaagtactagcttgtgtatggcgtggtgatggtgcagggacgaccggaagacaggctcgagggtgttggcttttgggccagctttagtggctgatgtccaaggcgagcttgaggcctcaagggagatcaggaatggaacaggtgggacggccagcgcctgtgcgaggcctgagatggggagaaggattgaagaggaagatggtatattggtatattgcaaaaataatagaaagaaaaagaaaactaacagaagtttggatggagtgctaaaatcagtaacggaggtaaactttcaatgctattaaagtgaaccggaacctttcgatgctataaaaccaaaaacaaaaactttcggtgctctataaccaattttgccataataaaacctaggactagatggggcatttgctagtactagatacattgtactaggaaacgtcacatccggtcctagattcttatattttgggactgaggtaagtatcaaactggtacataatgatcatctacggtcaaatcttaaacatgccacctagacgttggtaacgttaagtattaggaacccttggaattgcaatgggacaacgtgcatacaagtcaccatacaaatacgcagaagagcccattagaatagggtaaatacacaactagctataagatacatctagcagtttgcactttgcccagccaaatcactctcttcccagggtaccccttcctttctttctcttgcatgactagtggaccacatcaggtttatttggcaaactgatcttagcaaactcaggtaccatatctaaatggacgccgggtaaacgaaatacgaaagaataaatgcatcttcagcttgccaaagcgatttttggcatggaattgattgtcactggttttaactgttggaaggtgcaaattcaacagtttgagttgagaagtgttttctggactcacacgaaagtagaaggggagtagaatggactcctgaataaaaaattggaagctttacacaaaaaagtggaaatctttcagagaatatatcttactttcatgaatgaaattatcaaaccaacagaagtatgaaatgcacaaacttacagcattttgataggctttgactgaatgatgaagcttcatgtgatcccaggatccactcacgaaaaagcttgtcagatatgcattacccagattatctatacagaaatgaggaataaagaatttttgtaaaaacagaaataaatcgggaaaaaaaaagagtatctcagaaaaacccattcaatgctgatgcagcaagattgatggacctggaacccatatatgtctatttcataacttatgctgagtgcttcttcatttagaaatataacattgctaattcaaatttactactcaatgcggtatttccaaataaagtggcactgaacataaatgttgatggttggtaacacatcactagtttttgtagtagtaaaactaaacagtgtatctttcggatggcattaagtgtactttaaaacttaggtggaattaaagtaattgtggtcattttcagtggtatgtaaccattttttctgtacttagcatctccataaattaggatatatgatcattcatcgatgaagaaacacctcgattaatggtcatttccttgtacctcagtatatgtatgtttaaaagtttagaagtccagaaagtgttaattcattcatttttatcattccaaaatccaaacagatcctaatgctagttttcgatgagatataggagataactagctagttgaggaaggtaaccatccaaatagtatggagatatataattttgtacttgcatattcactgcaaatgcataatgggctaacaacataatgtgataaacactgtgaaaaggagatcgacaacagctactgcatttagaggagagagtgcatctatggggagataaaaactacttcctccgtttcataatgtaagtctttctagcattgcccacattcatatagatgttaatgaatctaaatatatatgtgtgtctagattcattaacatctatatgaatatgggcaatgctagaaagtcttacattatgaaacggagggagtagactacagaagctcattggacttgagaatgttcatctttgcttaattcatctggatttgctgctttccatttcatacagaaagaggtccttaatacttcaactaagataaagtgtaatatataatcttattactaatgataaaactgaataaacaaataatagccttgtctgctaataacttaggtaactagctgcctttctgctacagcaccactcagataatcatatgtgagtagtaccatgtgaatgtgcacactacctccctgcagataacatatgcaggataaataaccaaatccattttctcttgtacagatgactaactctaccaatacaggaataagacctgagttgattcaaggatagtaccaaagcttttattttaaccaacaagcacactccaggatcactcatgaagaaagtgataatgtgttttgaggtagtactagtgatcacatagtattaagagtacaagtttacaactgaagtaattgttcgggcaaatctcaatttctggcatatatccaatggactaaagtaaatatatatgtgcagtacataaaacgacagccttctaaaggaaagaaggcaaagttcagaataaaatattgcacaatttcagttttatcttgaagcaataaaacactagcattggtctgctccaaacagaaaagacgatgcttaattttaggagctagttgtttttgttcgttccatttcacccgagggttgtgcgcattgaaaacaagaatgcatatcgcaaaaataactagagtgggttagc

SEQ ID NO: 100011 - DNA, 664 bp, Oryza sativa
ttgcaaatatactaatatcatgtttattttggctagttttaatagtttttatctatatccatggtcatatttttaaacattgaccacacatgctctttgattattagggatggaattcccagctaatagttacttctattctcttatagagctaaatttcacaactagaagaaatgatgtgcagtacaaaaaaccttcaatctagtttggcatcttttcgatataaacttgtaaaatctgtaaaatttggttcgaaatacaatcttagacattttgtacttgtgacggctttgtaaagctcaaagccttcaacactacattagattgaatgctgtgaaacatcatatacatgctaatggttttgccaacaaataaggagagccttgtggaggaaagtggaaaaatgcaatggagccacaataaacaaaaaggtgtgcaaagaagaccacccattctttaagcatgcatgcaaaagaggacaaaacaacaataccttgagaattctcaacaccttttaggaccttgaattttccacaatacaggaatcatttggttatgaaatcttaggctccttttttgtgactgccttcctgttgatattctcaatgcttacaatttcccccaaggccaaaattttttcgttctatatagattaattactcct

SEQ ID NO: 100012 - DNA, 1500 bp, Oryza sativa
atgttcacgagcgccactaaaacctcccttggctatggggaaggaagtaatttcatccttttgagtacgttgatggagcccaaatccagtaaacaaagaatacatgtggtctcttacaaatttttttttaagaattcttagatgtattctcttcttttatttatttagtccttatgcttcactctctttgctttaatgttacacaagttgcttagagatactgcactaatgtttggatgttatataacactttttttgccaactttgctcattattaggagttgaggaggctttttatataaatgaaatagctgaggataatatatatgtacttattcattgttacaaatattgcatcaaacatccaatagaagagaacttagcaacatcttaatgtttctctcttttctgttgtaaatgttgcatcaaatcttggatgaaacatttgactgcctaatgaagttcaatgcgacatttgtaacttagagggtgaagcagtgaaatagtattatacttgcatgtttaattggatgttgatgcaacatttgtgactaaggtacaaaacatcacttaaaacaatgtgcaaagttggataaggagttgtgcaacatccaaaattagtacaccatctctaaaataatttatgcggcgtctaaaaaaaagaagaaaacattcgaatgcaagtgcaaataaaaaagaatgcaagtagaccctagtagtctatatatttacccccgtcctctccttcattttgtgaagagctccatcaatgtatcaagtagagattatggatgagaggggtgagcagtgaaagtatgagttccttatctcataagatttgaagcctagcctaaacatgatcgccaattcttgatctcatgcaaaatttggtgttgtagaccagattacttgaagccaaggtaccacatgttgtggtcgttgtcctctctatgttggtgtagtggttgtaagagccccttacgtcaaatcattggctttatgaagttttcgttggaccattgtgttccgaatgttgtcttccttccttcagggtaccgtgcacaacctagaaaatggcccttcagaatggcccttcgggttccttctagtggtttgtgataatctaagatgaaacttttgagttttgggaggtggctaatcgtgtgagagatcatcatctttgcaaggagcccctttctctctttttgtatttgcattgatgggacttgaggggcaatccaatataatagaaagaaaagtgcctctgattatgacgcaagatcgctaataatatatgcgtgaggggacagagtggactgcgtccaagggtgaagtataatacatagctgttaaactagatgaaacagggtgaagcacgtacgagggatgactcaatacattgttgttaccacaaatcacattgttgttgtcatcaccggtcaaatcatcattatcaatgaaggaggttgtgcgtcaactcatcaccaatcaaataacgac

SEQ ID NO: 100013 - DNA, 629 bp, Oryza sativa
ttcctgcagcccattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcactttccggggagcacacaacaaacaaagaaaatttctaacctagacaccacacctatgttattaattactactctaaccttgcgcaataacttccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcaaaccctttccccccctttttcccccccccaaaatccatttcggaggactccaacagcaacatactaaagtaatgctaaagtgagttgcactctattttgttgtcaagttaagtgtgtatgaa

SEQ ID NO: 100014 - DNA, 610 bp, Oryza sativa
cctaaagttggtgcccgccacagatgatggtcatatgtgacggcccataacgttaggcccgtttgagatatggaatgttatctcaattgggcctaaactacggcccgtcactgataggtgtcatccgtgacgggcttaagttttatgcccatctaacatgtctgtgcgaccatatctcaatcgggcacttttcggcccgattgagatgactttcttgtgacggcccgctatttctaggcatattagaggccgtcacagatagaaggatttataatagtgcttaattctattgttgtcttgggagctttgacgttatggaaacatcgtaattgttctgtcttcgacggtacttctcccaacatggctgaagcattgctacttgctagagaagagttgtataaatggggtttggcaagggctaagggcattcttgcccttgtgccgaacactgaatagtgtttgcttgtagtaggttaggttgtcttttggtatcgtgaaggtctattgtgtgtgttgtaagggttcttaccatctcctttattcttcttaatataacgatatgcagctctcctgtttgttcgagaaaaacaattgaatttgacataaacat

SEQ ID NO: 100015 - DNA, 581 bp, Oryza sativa
tcctcatcattaaaggacacaccttaactgactcaaaaccactaacgcacactcgaaaatagcctcacgaaatccgtgatctcaagagatacacagtccaacacaagttcaaacatagcctcactaaacctgaagcaactcactagtctcactaaaatcgtaatataaacgtatccacgtgtacgtaatatttgtgagaactaaaatttaatccatgataccaccatcatatcgctggtactttatcatcacattactagtgcttctttatatttgggataagtttgattctctaccttttgttttctgtttatatttcaatttattggtagtaacaaaccttgaaaccttgagcataaaaccaaaaccttacggatttaattatttggtaagtgttggcttcaacctaaagacttgcgaatcctccaatcggttttagattcctttgttaacttttcgcctcattattcattttatctaaacaaattatacaaatacgaaaacgtaagtcatgcttacagtattaaagaagtatttttaatgataaactaaagcacaacaaaataaataaaaattgtgta

SEQ ID NO: 100016 - DNA, 519 bp, Oryza sativa
aggactcaagttgagtcactcaacccctggtctccatgttcaaagcgagctgcgctagccaactaaccatccaagcaactatattttacaacacatatatagggagcatatattttgtgaatcgtggttaaacggtctgaccaacggaccggtgaaccaagggatcgaccgggtcaccagtcggtctggtttttcatactatggcaagtacccgtgcgcgtaggtgctctcaatagagaatataaatagaagagagagttcactctgctatctatcccggagatgcgaggttaaccagcacgagagaaacttaatggctcttctgtaacggctctccgccaggtacgttaaaaaaacgtaacacctagaaggagagcaccagtctcgtcttggcgcgcgtgtggcaatcccaccaccacctcaaccgcccaacgggtgctcttaattagcaacctatttaagtcgaggtccctccacattgctttccaatatgatattaatcccttaacactaattatg

SEQ ID NO: 100017 - DNA, 521 bp, Oryza sativa
ccacccccacccccacccccatcctcgccgccgcaccaccacccgcgcccgccccacgcttcctcccgcgccgcagccacacgaacagacccagacccaacgccaccagcaccagcgctaccaccgccgccaccccggcgcccaccgccgagcccgcggcgtggcgccgcgcgccgtgagacccccgcaggccgtcgaccacggccttctcctccgcagccggcggcggggaggccgcggcggcgagcagccgccgcgacggcatctcggtctcggccctaacctgagagggagatgcgggaaaagacaagcagagggggagtgaggcgaaaagccaactcactttttcgccatttttttccctttctcctcagatgcgtcgtgtgtactacctgcccaccactggcgtgcggatcaggggaggagccaggaggagacagccctaccccactgaccaccggggcccacacgacacggtggcccacctggcagtgttctgatgacctgatgtgatccgttat

SEQ ID NO: 100018 - DNA, 560 bp, Oryza sativa
aactttttcaagttgtgtttccaacttccctgggcccggacaaaacttccggactatttagattgtagccaaaataaactttaccaaattttagcaatttaacaatattaccaagttttggtaggattacttatgtatttactagagtttggtagaaaactaaatagatgcatatatttaacaattttataaaaaaaatagtatgatttgaaatgacatcaatctaaacaaccccttcatgctccggtgacgcttcgtgcgctccccatcatgtatgtacgtactacagccagatcgagttaggcgcacattgctcctgatcgactatatgtgcttgttccaacaccttcatcggacactagttattttgttgctaaacacaatctaaaatcatctttttagagagctaaacaagtcttgacgtgaacgcaaatgtcttagatcacgcacagtacagcagtagcaaatgtcttagatcacgaacagtacagtacttgtcaaggcaatcgatcaagagattagcccttttgaacttctttattcaaacacgcggatcaatg

SEQ ID NO: 100019 - DNA, 631 bp, Oryza sativa
catggcaagcaatccaaagcatctgcacttacgtaaataacatctggaacacatacataaagttactttgctttgctagatgtgcatcacatttctaatcttcattttgttctttggcaatatgaaagtgctgctgaagaattttttcatcaccgcatgctacagccggatgcaatttcaagggaccgcagcaagctgccgggaccattgaattggcaagaacataaaaatacaagtcaatgtcaccagacacgtgtttgcacccgtctagcaatgcactactacaacttggaaaatgtgtgtactgatgttatcttggaccttaccttatgtgatttatctttgttattatattttacctcagatggtaatgtgtgtattagatataaggtagcttttggagatcatctgattagtattctgaagtattctgcttacttcatatatttgtaatcagtttgttaagattgagtcagttacctttttaattcattatattttctgttctttttttccttgtattgttcccttcctctcattttcagccagccaataaagcaaccaagggagtagccaaggatagccacatgtttatcttgaggcttgctgactaacaatgtctctggcacgt

SEQ ID NO: 100020 - DNA, 827 bp, Oryza sativa
ctcatgatcacaaaatggaaaactcaaacaaagtatacacaactattcatgaccacagaacaaagagaggatcttaaaatttctctcttctgtatatatgacaagaatctcacacatgagttgatatcggaactaaactaaacggtggtagtataacttaggtatcactactacagaaacaacgatggatgtcggttgggaaacccccaccataggctttgaggttacagtaataaaaaaagtcggcttgtgcatcagctcgattcgagcagctccccatgcattccacatccatgtatcaccatccatccatcacgaatccatcacctgcacaactcacacaacaccacaaatcaaaacatccatacaaatcacccagcaccacaaaaaatcaaagcaattgattcacatagcacaacaaatcaaagaatttgattaataaatcacacaacaccacaaattaaaacatccatctgccacttgcgccacctcttcccgctcccccctccccctcctctccaatgaggtaggggaggtggctggggctgaagtcggagaggggagggggggtgccggacaggagtggaggccgaaggagcagcgctggagagggaggtgttggattcgattgcccccgagcgactggtggggaggggcggttacggatccgactggccccagcgactagtggggagggacagaaaggagggaagtggcgccggatctgatcctccatgagtggctggtgggaaggggcaaggaggtgaggaggtgcggtgggaggggagggggagaggcgtagtggagaggaaagtgaaagtgggaaa

SEQ ID NO: 100021 - DNA, 1155 bp, Oryza sativa
gtctactatgacaggaaatcctaagaacatatatgtaataattgaaagcacaacataaagatacctaggaacgattgtgtcaaagagcagcgagccagccactaaggcctcctttaatttataggaataacaggaaaatttggtggattttaattctaaagaaaaaaatcttatgaaagcctttgaaataaaagagttgaattctaccattttatttaaatttcatatggaatgggtattcctgtagagattttatttaaattacttttgagtatatctctcatatcaattcctgtgtttttcctacggctaaatcaaacgaccattcacccaatttttatgtttttcctatggctaaatcaaacgaccattcacgtatttttcttgtgtttttttatgatttattggcttttaatcatgtgttttaaaggagtcctaagtaattatgataaataattcctaaaaattctcactctttggtattgttcaagtcttcaagaatctctatccttacgtgagtcgatcctgacatgttttgtgctatgcccttaggtatgtgcagcagccccacaagtacttgccctgtccaaaaaataattaaagcacccatatttttttaaaaaatcaatatttttttatttatgatcttaatttttagtaattgataatatacttaaaaaattgatgattaaagttttacacggtgtataaaaacttgtaggctttatattttcaacgggtaacagagggagaagtacgtacatgttccattaattatttcgtgtacactctcagaccataaatttcgtactatatatagagttttatttgttttggtacaatttgaaaagaaaaggaaaaaaacaaagtttaatttgtcctttttttctcaatctatagataatcatgttcctaatagcccgtgcatatgagatgtttgaaaatagtaatagataaacaccaataacaaacacatatgtacaagtatatatatattgatcgattactgcaggttgatacttataggtgtgccatctagctaggtatgcatgactgcaagctggaagaacatcgtaccagatgcaaggcatgacatcctagctattataataataataataataataataataataataataataataataataa

SEQ ID NO: 100022 - DNA, 2255 bp, Oryza sativa
gtgacaaataattatattagcaataagcagagagagcacacattatattacaggctagctcctatcataatacctactatactataccacctactatactataccaaattgtctcggaatgaaatgccgaccgcctaattgtgggctcgattgcgatatgctaatcgcaaaacaacatatgtatgaaccccccctctctctctctctctctctctctatatatatatatatatatatatatatatgtataggggtaattgtgttcttgtccctatttacaactgcaattgtgattttacctttgtatttttaactttgtgattttaccctcactattttgaactgaagctcaggtatgcccctgttccgttagcaggacttaatggtgctaactgacaggtaaaaggacatctatgcccttgcagatttggcttgtgaggactttgtgttttggctgtgtttcacgattacagtagaaaacggaggtatgaacttgccctgcatgcttaattattttaacaacaaaatccaactttgtaattacacaagaaatgcgattctccagcatatgtttaaaaaaaatcaagggatttattaattaagaaacgctatggactgaggtatgaattcaatgcctcaatgcctgacgtatgaacttgccctgcatgtttaatcattttaacaatcaagggatttatgaatatgcaaacaagaaacactactctcatctctttctttcaacaacagaatagctttgttggccctatccagtttaggaaccaaccaatagtccaaggcagtaagaaaaataaaaactaaagggggagtgacaaagaagaaaaagtaaaagacaataaaactcaaatgttcctctccttgctgttcttctcctccttgtcaccatcatgcctcaggcgagctcctcgcggccatgctaatggaggcaaggcagcctagctagctacgcatatgcagcagtacgtatgtactcgatcatctgctgtgcagcggttcgggcactatagccgaggccgatgccgacgagcccagtgcccaccacggcggacggcgacgggctagctcagcttgacatcgccatttcgcgccggcccagcctgcttcaccccgcgctcctccgcgacgaccgcgcgctcctcgctctcgctagcccgcgtgtgccgccaccgctcgcgagggttaggaatcggggacggaggtcggaatggggtatggggatcgggaggagtcagcagtggcttaggttgaaaggtttgggatagagatgtctttttacattttgcaagtcaatttcttattttcttaaactcatttaatctgagtccacctaacagacgttaaacaggggcaaacagaccattcaacatcaaaaagtaaaggcaaaatcacaaagtttaaaaagtaagggtaaaatcataattgcaaatgaaagtaggggcaagaatacaattgccccccatatgtatatatacatacatatatgtatatgtatatatgtatatatacatatgtatacatatacatataatacatatacgtatatgtatatatacatatatacatatatatatatatatacatgtatacatatacatatatatatatcgatcgaccagggagtaaatgttagacgtaaacagggaacctagctttgatcgatccgataaattctgaaagcaaaaaccataaactccaattaagtactccctccgtcccggaaaatactgattgctagcatcccaatgcaagtttaggattcaagtgaaaataccaaagtgaccttattaactactactactgcatcaattcatcagcatcgttctttgtacccactcattagtagtagtactacagtacatccagagaccatccagtagagtaagaatcaatgtgaacgtgaggggagagagagaggacttgtccttctcgatcacaccaatgcagcagacgttcattgcttctcggttttttagggaatttaactatttgtcacttttagatttgtcaattatctaaatatctcttttaggtttgcacttaataatttgccactggagagaggtaatttcttaactatttaccacttttgcctacgtggcgtgccaccgtgcgtgccaacgtggaaaggaccccacccgtcagccctctcttcaccttcttctctacctccggtcgccgcccacctcccgcatccctgcgccatcgtcggccgccggccccactcagtctcatgcgat

SEQ ID NO: 100023 - DNA, 501 bp, Oryza sativa
ttcctgcagccctatagcaagagaaaaatacaaatctatagtcctgaaagactatagatagaaaaaaaaatacaaccaaaccgtgcgcgtctacaacaacacccgctgcgatagcgaaataagagatcttcgagacgacacctctaagaaaggaatgacatcaagaatgccgttgtcacctgtcccggggagtcaagacaaggttttcatctgaagaaagtaaatgaggaagaccagaaaaagcagcaacaccccaagaggaaagcggcacccgcagacgtcgttgttgccggcccgaaggcagagctttcgcccaaattctcgtccctccaaagaactaagctcatgcatactctgctactgccatcatcgaaaaccttcgacgcacattcgacgcacaggcacctcgtcggtgccacaccgctggccgactgtcaagggggagctcgaccctcgacacgtgcccgctccatccacgcagttgggttagatggggagagg

SEQ ID NO: 100024 - DNA, 603 bp, Oryza sativa
ttacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaggggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatt

SEQ ID NO: 100025 - DNA, 3085 bp, Oryza sativa
tgcgcttattttgagacggagggagtatttttaacacacgatgtttcatttcaaatgtcagatgttccgattggtatgaccatgttgctcatagtgtcaaatattgctgtaaaaatgtatatttgccaaggtctgagtttccagattttttggaggagtttgaggagagaaaaacaaagggggttcaggtttatttttttctagctgaatcatttgaatttgggaaaattctggaggggaaaggggagtgaaatgaatttaaatttgaattttaaactttgtatcggatggaaaatatgtgggaattgttttgggtaggattggatggaatgaattgatatgtttatgttacaaacaaatgaacaactcttgaaaataaaaaatttcaaaagtagacaaccccataaggtaaaacaaaatccactctggcaaatattttcaaacgacttgagaaattaaacaataaattaattaaggtatttccccacttgttttctttggatacaaatgtcatgaaaaattatgctgctctttatcaaattccttctcctgttacgataatttttttttgtaattctttcgatagaaatttaagtaattaagaattacattaactataaaatgattttccttttttggatggataaagcctcatgacagataaacctctttaactactttgttctttagatattaaatcttttaatatcaaatcttttcttagaaatctgagtaattatgtagtacgttagttatataattgtttttagctggcatgttatcaattcattatataaaatatttcatagaaatacgagtaattaggaagtaaatcaattacatattttcttcttctgttttggctggatacaaccttatgataaataaacaacattaagtacttccatcttgggacatgaatcacttggccatcagcaggcatgttattaattcattcatatctaatctttttacataaatctgaccaattaataagtacattaattctagattttcactgcaatacttggatgctacataattatggtatccttttccgcatacgaacatatatattcaacaacttctcttgctgaggacttttttttgctggtcacatattttccaccaaagcttgcaaccttcaagcttgacggaagctcttctgctgctctgattgaaaatcgcaaaaggttgctctagattaaccacataaggtactaccaaaatcccctctagcatgaatccactgccagaattgatcaaacttttgttcttatttttatgatatatggacaaaaatggatataagtgatgaactaatcttcaccactactttttctttttgcttccaatgtttgttttgcatttcttctcgtagttgacagactccatgagtgaaaataatttaaatttgagttttaaaatttgcaagtagactatatgtgggcaaatttgtttcgggtaagatcagagggaatgaattcatatattacaaacaattggtcaactatataaatcaaaatgtttgaaacttgacaaccccgtaaggtataaaacaaaatctgctgaggcaaatattttcttgtgacttggaggaattaaacaacaaatttacagtgatatttgtcgcctgttttctttggacatgactaatttattacttttccaaatctttagacaaatcatataattaagtattataagtaattatacagagtcattgtagataaaattatttaaccacttctttcttcagatatgatttagttagcacgtaacaaggcaagctattatgtattttaagaatcaaatcttttcatagcaatctgaaaatttaagcagtacattagtagtatattttttctttagatggcattttattaattcatttgtaacaaatatattcatagaaatctaggtaattaagcagtacatttattatagatttatttcctcctgttttggctggatatagcctcacgataagtacttccttcttgagatatgaatcagatgggcattagctggcaagctattaattcatttatatcaaatatttttagataactatgaccaattaagaaatacattaattctagattttcactgctatgtttgcatgctacatcgtaaatggtatccttttcccccgatatgaacatatatattcaacaactcctcttactaaggactcatttttactgaccgcgcatattttgcaccaaagctcaaccttcaatcctgatagaagcttttctggtgccctgattgaaaatcgcaaaaggtcgctcagattaacctcagaaagtactaccaaatcccctccggcttgaatccattgccagaattcatcaaacttttgttcttatttttatgatatatggacaaaaaaggatggaggtgatgaactaatattcactactactcttttttgcttccaaagtttgtttcgcatttcttctggccgttaactgactccatgagtgaaaaaaaaaattaaatttgagttttaaaatttgtaagttgactataatgggggggggggaatttgttttgggtaggatcagatggaatgaattcatatatttttgttacaaacaattggtcaactatataaatcaaaatgtttgaaactttacaaccccgtaaggtataaaaaaaatatattgtggcaaatattttcttgtgacttggaggaatcaaacaaattactgtgatatttcctacttgttttgtttggatacaacatcatgaaagattgtacgcctctttatcaaattccttctcctgatatgactaatttattattttttcaaacctttagataaatcatataactaaggattataagtaattatacagagtcatgatagataaacttctttgattacttctttcttcagatatgatttagttagcatgtaacgaggcaagctattaagtattttaagtatcaaatcttttcatagcaatctaagtatttaagcagtacattagttgtacgtttgtctttagatggcatgttactaattcatttgtatcaaatatttttatagaaatctgggtaattaaacaatacatt

SEQ ID NO: 100026 - DNA, 674 bp, Oryza sativa
ctattatttaaaaataataacttcctcatatattatataacatagaaacgttaatataacatagaaacgttactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgcatttacgctgctacgtgtctctctaataaattagagaaatcctagaaatttatttatatactaaaagtgcattaaacatcctgcaaaaactattacgccgtcacgccgtgctataataaattagagaaatcctagaaattcagagaaaaaagaaaggcatatgatcctttaatttttacttaaattggaggaccccgtatttaaaatattagtttagatctattaaaaatccatgctgctaatctctatctgaaaaaaaacataatgtgcgtacgtcgtacgatcgtcttcattcttaaaaaataaaacttaatacctacaccatatac

SEQ ID NO: 100027 - DNA, 600 bp, Oryza sativa
tccaaaaagtccaaaggtttctcaaaggacggtaagatgggcccttccttccccaagtgagcaactcaaacttccctctcccttaagtgataccagtgcaagtttgatatcagatcttgtatattagctgagaagggagtcttatgagtgaagcatgaaacaatatggtaaggttgagtggaccgaccgagatctaaaatactatggttaggaacaacttgacttatctcaacaagtggtttaattagctcttctttcacaaaacacaaatccttttggtataaggctctatgagcttatcatttgtactcttatccatccattttaactccttttatcgactggagaagcatagcttccttacacgcgcatgacataggatacgtgaaaacagatatttgtactagcgatcagccgatcatcaggagaggaacctctacatcccacgtttcttcaaatgcattctacagtatatttagggaaactattggtcattgagagagaccacatttgtaccaatcaaatgcacctgtggtgcactaacattccgttttggtctcgtacactccatatgttaaaatgtcacctagacctccttag

SEQ ID NO: 100028 - DNA, 1660 bp, Oryza sativa
ccctcggcgaagaagctcagcaagtacttgcgccacacgatcttcacctccacgccgccgccataggggacgagcagcttctcgccgtcggggcagaccctttgcccctgccagagcccactaccctcgacggtgcgcttctggcggctccccttgccgttcttggaccgagcctcggcgaaaaagaagccctcgtcgccccggccgtgctccgccagcagcttccatggcggcacgctgagggggtcggcctcgaggatgacgccattgagcgggaggggcttaccctgaaggcgccggagcaggaatcgggagacgagctcgccgtcggtcggatcgaacctgaggcccggagggagcccatcagcgccaccaccacccgccgccatcgcgatcttgatttctagggtttctagggttttggggaagaggaggcgggagagggtgagaattgaagcgtggggggatgagaaagccgtttcttgatttgaatttatccagtgggggagcccaatgtcggtgcgatacggctaccgcgcgcgatcggctcagatcgctggtgggtgtgtttttttttgtgtggatatttttcgcttttttttttttttgggggggggggggaaggtttgataaaccaaatcctagcaatttatttggaacctattttgaatagaaatttgaacaattgctcaggtcctcaggttatatatctcattgtgacaaagaaaacgttgtttacagattctgaacatctgaaggattttactagcgaggtacttacatccaattcaaacatgggtacttctgaagtgagagggggttggggggggggggcagagttgtgtggtaatttatcagattcacatcaatctatctcttgagtaatgggtctgaattcctgatgtttagtgtgtgttcatccagaagggggaagtcttctgctgttctacccttctctgatctctgaatcctttcttattctgatgatcaggttatgaacataattgcgctgaaaattatgagaacctgcaatatctgctactaatggtgttccctgatccgcagttgcacaaacttcacaagataatcaaattaaaaaaggaaaaaaagaggacagagtttcattatcaacaaaagtactgtgtcgtggttaattgatggcaaaaaaaatagttttaggaaatttgtggttattgcacatatacagtccaatactccacgtcacatgcaccctgaaagtctgaagattaaatgcaactcttttattcattttgctaactgcactctgttgtgctttagtgcaggctatgaatcagtttggtgagaattgtgatattccacgcagaaaaggactggcagttagtagcagtgtagcacaaagccacatactttaacctgtacagttcatgtgacatgtactctgtcaaaaaaaaaaaaagagagagacaagaatcaattttggagagaagtttttgaagcaggacatgaatagtgcatggcaatttatattgccgtgcatgaatagtagtattggtcaaattgatcacaggatagccattttatctgtttgttacaactgatacaatattataaactatatacgagataagattcaatttgttttgcaccctccttcaatctcagatgtggggagcatatt

SEQ ID NO: 100029 - DNA, 582 bp, Oryza sativa
ccccaatgtaactaaaatgacatacttaccaatgcaatcatttgtgagtgtgccaatagtgaattgagtgttaaaattgtactttaagatggtctttaggggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacagatatatgtattaatgtat

SEQ ID NO: 100030 - DNA, 622 bp, Oryza sativa
catgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaggggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttat

SEQ ID NO: 100031 - DNA, 544 bp, Oryza sativa
accagatcctactgcgctagctgcatacgtgatgccagtctcaagcaatgggtagcgggaagggccatcctttaaactagtggataccccacgcgctgctgtgggtatctcagaattaattacaagaaagctcaaataaaacaatttagaaataatgttaaaaggatggcccacagtttaggcaatttaggtagaatttcagttatacatgacgcatgtatggttataatcaagcgtgagagaaatgtaatgggcattatttttctaagttgatgtggctcattaatgttaagctttatgataataattacactaagtaggttgtaaatgaatatgatatatggatgatggttatgatgaaagcgctataaggattcaaaggatattattttctagtggcttaatgtatgtttagtgtttggttccaactatataggatgtatagataagttgtgtatctattaataatctctgcaattaaatatacattgctgggatggaattggatcagaactgttgtctttctcatgtgatttaactacat

SEQ ID NO: 100032 - DNA, 649 bp, Oryza sativa
aaaaaccaacttgcatagtaagccttgataattggggaaaatccaaataactggcctttatactcccctcttcaactcactgttgcgaaaaaggtccccacaatttcaatttctcttccatcttcgctagttttttttttgccgggtcggccgaaagattggccgaccaaattttattaagatttagggagtttattacatggttcattcacgacattagattgtcgagtttggggtggctgaacaccctaaaaaaaccaatacaaggaactaaacaaagagagagaggctactcctcgcgcgcttgaaaaatgcctgctgacttccaaatggagatttcttccttcacattaccaaccagctactctgctactttgaatttgtgctaaaaaaactcttccattccgttctttccaaatgaactaacaaaccataagaagactgtatcaaccgccttccggtaactcacccggaaaaaggcgcgtgcatgctgccaccactccgctagcaaaaggttatcatggtttggcggatgaaagaacaaatttatccagtcccgtagcaaggaccacactctattggtgtagaagcatttggtaaaaagatggttgcagtcctcaaattcagcatgatatagcgagcaggtcgg

SEQ ID NO: 100033 - DNA, 651 bp, Oryza sativa
ccctcttatttgaattttctttgaaaaaacttaagtctcgcataaagtattattcatgtttataatctaataaaaataaaaatactaatcataaaaaatttcaaataagacgaacggtcgaagttggacacggaaactcatggctgcgcttattttgagacggaggtagtactagattggaccttctaggtcatatgtttttgtttgaaacggagagttcaagacaaaaatcgaaatgtctgatgttcaatcggaaaccaaaactcggggctaatttatgtgtcgcaaactgaggactccacttgtgggaaaaatcaaaacttctgacagaccgcacaaaccacacaaaagactccccataaatttaatttttcattttcaatttctcacctgccactaattttttagtgatttatcactgctagctcagtttctcatgttgtgtaagtggccaacgtgaagaagtggagttaccccatgccatcttatcaagggtgagttcctccttttgtcttacgccttccgtgcatgggacataggttgcagcaaacctcgacgcaaaatagaacaacgccggccaaaacatctacaaccagtgtgatccttggtttgaaggaagtacgtgtccttgtcgaggtgatatgggataac

SEQ ID NO: 100034 - DNA, 544 bp, Oryza sativa
aaggaagtactatcgtgaggctatatccagccaaaacaggaggaaataaatctataataaatgtactgcttaattacctagatttctatgaatatatttgttacaaatgaattaataaaatgccatctaaagaaaaaatatactactaatgtactgcttaaattttcagattgctatgaaaagatttgattcttaaaatacataatagcttgccttgttacgtgctaactaaatcatatctgaagaaagaagtggttaaataattttatctacaatgactctgtataattacttataatacttaattatatgatttgtctaaagatttggaaaagtaataaattagtcatgtccaaagaaaacaggcgacaaatatcactgtaaatttggtggttaattcctccaagtcacaagaaaatatttgcctcagcagattttgtttttataccttacggggttgtcaagtttcaaacattttgatttatatagttgaccaattgtttgtaatatatgaattcattccctctgatcttacccgaaacaa

SEQ ID NO: 100035 - DNA, 581 bp, Oryza sativa
actcccgtatgtacttcagcagaccagcatggaagcttgacaaataccgcctgtttcatatttcttgaccttttttatagctaacatggtctctaaaaatatatcttttattttaacacataaaagacaagtaaatatttaattttattgagacagtgttttcaaactagagttattagttattgatagtcaaagtttaattgttcgatctcaaccttatttcaaaggttaagaattatgaaatcgaaggaaatactttgatcccaatccgtcccatgatataaggtgtttgaagtccacaatataagacatgatcaaacttggcatattctacaaaactaatctttgacttttagattctgattatacgataatgtttagcaactaagttcacatgaaagtaaattcaaatgctaatttaattatatgagtaaagtgcatatagggagtagataatttggctatttctagctaacttgaaataaaaatgtttgtaccaacaatagcatatggttctatatatgactacctctacacacatggcatgcaagatctgtaaggtcaaaatgatatggaaaaat

SEQ ID NO: 100036 - DNA, 628 bp, Oryza sativa
atgtcacccaaaataaacataaatgatccacttaaaccaaagctaattctgtagttttattatcgcaaaaccactgtctaaaatttatttaatttttctcatctatcaattatgtgtgcttctcactcatcaaataagaataaaaaagttttgaacaaatccaaatattttgagaatctgatctccaaaattaaataacccaaaacagatgtacttaaaacacaatgttaggttttgtcagacggttgctttgacattttatctatcagagattaagtttaatgtgcatatctgtgtagtgttatttttaataaaataatagtttaaaggatgttgcaacacatcagtgtgatttttcacgattagtatttctttccgattctatgtacgtgtgcatgttttcttttatttatttggctttatctgttttatttatcgtatatggtgtaggtatttaagttttatttttttaggatggagacgatcgtacgacgtacgcacattatgttttttttccagatagagattagcagcatgggatttttaatagatctaaactaatattttaaataacgggtcctccaatttaagtaaaaattaaaggatcatatgccttccttttttctct

SEQ ID NO: 100037 - DNA, 548 bp, Oryza sativa
attcaagttggtttcattattactgtccctgatgctacaagtgtagaagaaaactgtgcacagtgaaattacactcttagaaccaaagccaagtatcttttattttactttcgataacatagttcctatagattttaacaaagttcatttatattatcgtgtagaatattttctatttcgtattttagttggataccataaaaaaagtggtggagacttgtgccatacatcaattcttttatttatcattttagactgtccataggtggaagatgttataaataaaagaaaagcagtggcgagcagattgcctgaagccttaaaactgagtataagcacattgcgcttcaaacaagagtttacaaaaataaatttcagaagactcgggtacatctaaggtgcaaaagactataggtattttagcatgtgccatataatcccgaggattataatactagtgttttataaaaaccacataatttacgtgtactgtgtgacataacttattggttattttatatatcttagatcataatattgatggtttt

SEQ ID NO: 100038 - DNA, 1443 bp, Oryza sativa
acctattggatgctgaagctatcactggaatacttaaggtggagcaactctgtttgcaagctctctgtatgaaggaatacctgggggcacccatcattgatgttcctgtcgacattaattttcccattaaagatctggaaattggtcgactgaacagaaagggacctagcacacctgtggcctccaaatcaatttcaggctctgacttgccagaatttgtaagttgatggtatgcaatgaaatgacaattttcttataaactcttatttcaagagttcctactaaatcatgctgttatgcaggtaaaaattatttcatcatgcccttatgggataggcaaattggtggagtcattgcgtgtgcaatttccttgtgtccctaagttgcaactgaagaacaaaatttgggagatagctgactttaccaataaccgttggcaggtctttaacattccgctcattattttaattgatgtgtagttatgcctatattacataataatggtattttcgagcaggttaagaaagatatcttggactggtgtggtctatctcttccaccaggtactaagccatcttatagtgcctttgctgcatttgaacatgaagtgttacttgtaactgagaacagtgatgtgatgttgctaaaagaacatctcagaagctactaatggagtttttttttctttactttaaatagaatcgatattgcatgcttttaatcaagtatgtgttgcggatgctgaattgatgaatgtggattgattaaaaaagtgcatctaactgtctaattgattatgccgtgtatttcttagattctgtgttatctgcaattctggtttgctttcttctatagataaaggtatacagtaatacactgctttcctggtacagatagaggtatccaacagatgcagcctgatgaatcgggagattcagttcaaccctctcctcagcctggcgctaaattggaaatacacaaacaccaaattgatgcctaaggatcaggttgcagcacatctcccttctggcccttgagaatcgagacacactgcttaaaacaacaccatagactatacaccagtgtatatacttagcttattaggttgtacagaatagagagttttaagattcagtcgttcagagactacaagtattgggcttcagttgtatagtgtaatgcagcaagtcccttgtagaaatggtggtcatgggatgagtctcatacgtagtactgccctctgtctgggttactagcatgtgggcctgctgaatgtggggctcatatatcagattatcagtccctcgaagtcagatggcagtactgtagaggatctgttgccgtggtcatgtaaactgtcttgaggcagaaataggctttttacacctcgtgtcatcttcgaaacaaactatggtgctccatgtgcttgtttaatgcgttaag

SEQ ID NO: 100039 - DNA, 608 bp, Oryza sativa
  unsure (1)..(608): unsure at all n locations
tttagaaaaatcagcacctatatgcatggaggtgtaggcaccggttcttatgacagaaccatcatttataagtgggccccactaacggtccaccaatactttcggaaggtgggcccacttataggtgctgatttttgcttgggggtattgggtctgtttttaacatagaaccagtacctataatagaaaataggtaccggttttgtcctaagaaccagcacctattgtgtgcagtataaatacctcctacttacctcaagctggccaggagtagacagagctagtggcgcctctattctactcgtctagctagaggaggggaggttttgccttaaattttttatttaaggttaatttctctatattctatctccgnttcttttattgatgcatgtgttttcactagttgctagattttagcattttggatgtagattttagcactttggtagaaattcttgcaagtgcattattaattaattttatagtaaaataatagtggaaatctaaataatcttgtggacgataggagtatcccatgcgggtccgtattggtgccgccaaaatggtaccgacttgaaaccaagatcccaacccgtacccataag

SEQ ID NO: 100040 - DNA, 671 bp, Oryza sativa
ctccgattataaaatatgggttaggatatggaagggtaaggtctcacggaactcgcccggttttcactcttagatggtggttatgcatatgcataaagtggcttaatatggtggtttgacatatgttttgaaagcttaaccgaacttctttcaatatctaatagaacatatctgcttatcatcagttataagttatcaatttatccttatatagtgagataacactattaagatgttggtactcatttgtaatcagttataacgtatcaattgatcctactatagtgagatgattctattatgatattggtacttatttgtaagtgaaatctaatagagtaaaagatacatttaagtcgaaattttaatatatatgtctaacgagtgggtcatgtgcgtcaaacccatctaactaacatacatattttcataactactgtaggggtataatcggcattgcaaagtttaggggttgaatatccggtttcaaagttcagggtgctatacggatttctatccaaagtttacggggttatttggatttttttccttgtttttaatgtaaatcaaccacttatatgtcatcaaagagacgacaccacaatgtccataatcttttgcagctcttagccggtcgatcgcttattcataatacatattaacatatgtaa

SEQ ID NO: 100041 - DNA, 524 bp, Oryza sativa
atatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatg

SEQ ID NO: 100042 - DNA, 536 bp, Oryza sativa
ccaatttttgttggagaaaagaacatggcctttactccattacttgaattttcatctaatatcaatatggcgtaaagtattcaaaaatccctggagaatggatgagcatttggtatctgtacaatcgcctctgagtctactatgacctgcaccatacccggcctacctcaccttcgcctttctagagagcactggccgtcggcttaactaactccagatcgagtcccatactcccatgggccatggcccatccgtgccacgtgtcgcatgctcctaccggcgaggcgggcccaccaagcttggtcaaccctccagtccgccgtagaccgtagcgctatacggacgtagtacgagtacaaatacgtcacaggcttgtactcctataccggctctgcctggtgcaggcgcttacctgcgggtggcccaaccgcgacgcaccacgcgttcacacggacacgtcagcctactacgcctgtctccgcgtataaatagccgccgcccccgatttcgccggtgctgctaacctcggcccactt

SEQ ID NO: 100043 - DNA, 680 bp, Oryza sativa
  unsure (1)..(680): unsure at all n locations
tcatccactataagctaaatatcactttgaaatgctggcaagtagagctgaaaatgaagcatcatgtttcaactgaacgaatccaacggtcgaagcattcgtacgtgttacaggtatcacatgtgcatattttaactgccaacggcattgcacatatgcagtaggatacaaagctctgtcgcaaaagagaattattcaagctctcaaaaccaaatcatccataatccatgttctatccacattccactgaaggcgaagatagttaaagaaagccnaaattctgatgatctaattaatcttaacgggttcactgtacaacgaatatagggccagtgccacatacaagtatacagcaaggcctttgccgctccagaagacccatgtggtgtattttgctgcagcccacaggtacagctctcgcctccggtacaactgatgtgtcaatgataggagcatctttctgaagagaatgtcaatacgaagcattggtaatatatgattctcgagctataagcattagtatagactctcacggacccatgactaaattgccggcggtactgtagcataagttagccgaatggtccatcggtgtggctttgaaagtaaaaccttcattaggtttttcttctctcgaaccatatatattgctagctgcattgccagccatagtcggcttg

SEQ ID NO: 100044 - DNA, 640 bp, Oryza sativa
tgctgtaatgccagcgcacactacctgcacctaaaacataccaccgagcttgtggactgtaaagctgcgtgctgatgtgaagcacctgcaccactgcataagctggagaaggtgacgatctcggcaccgtaagctcctatgggtgagtcagagactgatctctgctgaatacgtgctaaaggtcaataatttggatgtgagctggttcacgcctatgacgatatgtctgacattgtctttggtcgagcgtgagaatactaagggcagatctactgattggtacaggctcgaatgggacgacctatagaataatgctgaccatgcagaaggatgcaggataccaaaactacaggtcaaccacatggatctacacgtgtgtatttgactcccaaagtagggtgctacatcactatagtagagctgcctcgcactgagtggatgcaggaacatttaagactatgcacaatatttttatgaaccggtgtataggaagtttgctgaatttacaaagcagggcaaagctctagggactaatgcacttaccttcatgggttttggctaacaacaagaattttgacgctagaatcgtaaacaagaaatttaatggccggaaactagcactaaaatttttatggaatgc

SEQ ID NO: 100045 - DNA, 504 bp, Oryza sativa
  unsure (1)..(504): unsure at all n locations
gcgctcaagcgcatcagggaccccgagctccgcgccttcatcgagcgctgcatcggccagccccggaaccggcccttcgccgncgagctcctccgcgaccccttcttcgccggcatcgacgacgacgatagcaccggcacgctcggctagcctgttaaccagctgggtagtactagaaattattgtatgtgaattcgattggaaacaaataaacgttctaaacgaattaagctccagcgagtagcaaatgtttataggttcatgtctcaccggcgctcgagcttgtacctgtagctttggatgtggttaattagtggctagtactggagtatttattgtactgtttgttctttggtttgcactgattngattcatgagcttcaaagaaatgcaagatgacgagctgtatttggcttttgctttgcgtgtcaaatgtgtcacaatcctttcaaaggatggntgtaaattaaaggtgtgagatttccatgagctggatgctggagt

SEQ ID NO: 100046 - DNA, 680 bp, Oryza sativa
tctctcctatgcgggcttgtatttatatccataggtgtccccttgtccaagtcgaagggggaaaatcagtgtggatacaatccgaatattcctgtcgttttcatataaaactttagatatctttccttatgcggaactccccctatatccgaaggttgtttacgtattagacatggtatgttgtgggccctgccgagatttagtcaactactattaagtatgtggcatccataaccccgacaataacttattacgcatataggctaaaaaaattactaattacacatattgcgactaatttgcgagacgaatgttttaaacctaattgattcatgatttgacaatgtagtgctatagtaaacatttgctaatgacggattaattatgcgtaataaatacgcttcggaatttacatacggattatcgaatttgtgtcattattatactacctttaatatttcaaatgggtgtccccatattcaatgtgacacaccacaattttacagccctcaatctaaataccctgtagtatgagtattacttaaaagcctccaaagtttatttttcaaagaaaacagggcgccctataattttgggctgcgggagtagtaacagctatttgtttttacacttcaaaccgttcgtgtatgagcgcgtagatcgcctgctctaacgtaata

SEQ ID NO: 100047 - DNA, 663 bp, Oryza sativa
aactaagtatctatgtctatgaacaacgcataactgtctgcacatgtctaaacatctccaaagaacaatagtatctggttatttaagatttacacatttcagaagtcaaaccttaaaattcgattttcactggcaatgacagaatatttaagatgatgcaccatctatgtcaattatcagtataggagagattcattccttgattaatgaaatcaccatcaccatgcatatgttaggacaatccaattggttctggattcttggcagaattggtcaagatgaacttatgacttcagtaagcttttgacttattcttgaccaagatggttcatttttaagcaaaagggcattaagcttaatgaaacatggcaccaccgaatttttctcaggatttcctattttggtggttaggaatagggattatggatacaacatcctgcaacctcacctcgggggccacaccggcgccgcgaagcccacctcgacatctccgtgccgccaccgaccgtggaggacaacaccagtgacaccacgccgatcttctccgtgggcactacccaacggggcttgcacacgcaccggcaccaacacatgttggcgggttttccacccatgttgtcttattttcaccgtctattcccaactgttgaaggcattggtaaa

SEQ ID NO: 100048 - DNA, 613 bp, Oryza sativa
agagaaaatattctttttagtctctgtagtagtcaaattttaaattttaaataacttaaattctctactaagcatctcatttaggggtgacaacggggcacatcaaggaaaaccaggccccatccctaaccccgatgggtcctgggaacccggtcggggacccaagtgaaggagagggggcatacatgtagggaaataaggtcggaactcgttgacaacgagttagggagtgtgagacagtggtaggccggcctgttgagagaaggagacgcaactgagcataacagagctgcgaagccgaggcagtgaagctcaatagaggtgggcgagctaggaggcgcacttcttcgacaagctagaagcagtgaggaaggtgatgctcggtgtgttgtactaatgtgcgagtagcgagctgggaggcagagaattgcgcatccaggaggatgggtggaatcacgtgatgtcatgagtgaccaattcgcgagcttcggggagctcaaattttgactttttgagaagcatatggtgaaaatgtagaagagctgcatttctcaacttctgttcttctgttaattttttgtgtactctattactactatatattattagaatc

SEQ ID NO: 100049 - DNA, 1082 bp, Oryza sativa
gagcgtcgtcgtggtcgaaccggccaaaggcacggcaaggcttttgccagcgtcttcacattactcagacaagcaccccacgtcgacgaccatggaatagaccgtgacgtctcacaagcaatcatacctcgacgtgaccaaacacgtcagcgcatccacatccacacatcgcgagcaggaggctcaccaccagcgagcaaccctgctggagcccgcctcgactccgcatagccaccgagctcgccggagccctcccgagccatgcaacaccgctacacgcaaccgccgcccacgccacgcccgctcccggtctcctcctttcctgccgcccaactccttccccgccttcatatgctgccgctggcgtcgacgcgtcgtctgctgcacggcgccaccatcgccagccatcaccaccacggccgtcagccgccgtggtccgccggtcatctccacgccaccatcaccagccgccgccgccagccgccactatcaccggtcgccgctagcagccgccgcccatccagatccggccggggtggcgcgggtccgggggacggagcgcgccactcagcaccaggctggagcgagacaaccatgacggcacggcagaggtccctgttgtggtggtgtaacaccctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataagacaaatattgagtaaaatgcatatatgcaaaattaggaattgtggaatcaaatttatatggaaaatacactaaaatcggga

SEQ ID NO: 100050 - DNA, 763 bp, Oryza sativa
gcattgacctaaatcatcggaccgagcggtccggaatacatccaaaagcagaaatagataaggcagcggaattcatgcagcggcatgccattgccacaggcaacgaccgtactaagacctactgagcgccatcgtcttcatctccctcctggtagtaggcatagggatcctctgaagcttcatctcccgcttctgattaattttatatttgcaagggtgagtaccaaccgtactcagcaagccatcacagcaacaatgcacatgataggtgtatttaaaggatggctatggttcctttgcacaaagccagttttgtaattcttttcacaagcctaagatctagcacagactgatcaaattttagtaccagtgttcatattaaacaatgacggttctgtccaccatccattgtgatcccaagaatagcttcccgccattgagtcgttatggttttctgaggacgtccacattcccgcctctcaggaagtggctccatcagcataaaaaaaatcatcatgcaatatcccatcccacacaagttaaagaatttaaagtctagccaagtgtaatacatgtcccggtgctcaataaccgcgagcacgactattcgaatagatttggtttactcacactgcagtggatgcacactttacccgcactccgcgactgcccaacacatgagcctcgtcccaacacatgagacgcgtcacggcaaagcttttcgataacctcgcattggcagtacccgctccatgaacttaaa

SEQ ID NO: 100051 - DNA, 1314 bp, Oryza sativa
aaaaagaaaaggaaaagagggaaaaagagaaaaaggaaagaaaaagaaaggaaagaaaaaggaaaaggaaataaatagggaattaaagggagattagggaagtttagaaaatttaaaataattagaatttagttatagattagttatagtcgtagaattgcgaaatttaatataaattatggattattcttggtaatttctataagaaatcaattcgcggtagtaatttagatgtaattaataactaaacaaatagaggaattcttatagattattatagattatttttgggtaatccctataagtaatcgattcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgagaacaaaacatttatacctgcaaaatagtttgaatcgaaattgggtttgccctagtacgcgaatagtaaagttaatacaaaagaatcgactttcgcgttcgacttccatttggatttatttggatttttatttgaattctaatcgaatccaaatcaattttcgcacgtaactatagagcccgagggagttgcggatccaagtgaaggccaagacccccaagactttgagcaaggcaagtcatcactattccttgaatatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacataatttgtgaaaggagaaataaaattaaacaactgttttcgactggggcggacggaggatttgggtggtatctggaaaaggctagtatcgtccccggtcaattaaggactgagccatgaagttaagcatgaaacgacccccgtacaaccgcacttctcgtatgggtatagacctagcggattagatagccgagcggaggcagtatccctgcatagatggttcacccctgagtgaggcaggtgcgctacggtgggacagccgttgagg

SEQ ID NO: 100052 - DNA, 563 bp, Oryza sativa
atcaaaacatgaattactactgtgtgaataagtgaataatgcatttaccactcaaatatccagtgaaaacgcacgcataacatgtatcactgcttataagaaaaagttaagaaccaccgttgaaaatgaggctagaaactttaacagttatcttacttttaggaatataagtttcaacaatcattacagcaatactacaagcgtgaagaaacaagactaactttcctcccaagttaacggaaaagcaatatgtataagatccatattgaagctaaacttacatgtggtttggagatcaataaagcttcgaatactcagatggcatgtaacagttcagactattgatataccaagtaccaatggtatgccatcaactctaaccaaatggatactcatttcaggacctaaaacttccactgagcatcattatggacacttacaaacttcaaataagttcgccacagaactttataagttctaatgcctcatgagaacattacaaagggctcctttgattaaaaaaaaacttgtttttctataaaataaattaatggagtcctagc

SEQ ID NO: 100053 - DNA, 686 bp, Oryza sativa
cccaaagagaggagggaggattttatttgttttctttttattttaattggttaaatgatcttcgtgactttaaaactatttctcgagctccgaaaattcacggaaaattccggagagtacattagggcacaaagaatattaaaaaatattcccggccaatgacttttaagggaaaattttaattctcccattatttcacttgattaaattgctttaacttttatttaatttccagaaaatgcattatttaatgatttaaaacccgaacgaaaatcggggcgttacatcggattatctcatagatcaaactagtcttgttttggggttttcttcttcccatgtgctagctcatggaagtgatgaaggttgtaggaggtggtggcttcatttgtcagaggtggcaaaatggaaggtttcgagagaagaacccacaaccgacatcttggctggaggtggagatgtaggcccttccttccggcttggaagccgactgccaaagctgcttttgcggcagtcaggaagaatcaacttaggggagttgttgctcctagttgaagacctcgacgatggtggttgtttggtgcagtggttttgtgcttggctccagatctgcagggaagatgttgaccggagtattggggagggggggggggacaagctttgcgctatgacatcgcccgggacac

SEQ ID NO: 100054 - DNA, 542 bp, Oryza sativa
cgatgcagacgtgcaaggggaacacaaggacggtttgtggctatttgcataaaggcggttgtaaaacattttattgagcaaaacagtaaaactgttgagtaattaaagtaacattaaatctgcactgatcaacgctataccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcgg

SEQ ID NO: 100055 - DNA, 576 bp, Oryza sativa
aaaaacaatgtgacaccggtacttaatttatcattttgtccacaatctcagatatcttaatatacataagcagccaattgtttaaatggataaaaaagattcatttaactcttttaacacaatatggaaaaaaaaaagatgatgaagctttccttcaaggttaaagtaactagacgccaccaacatgaaaaaggtcgatcaaataaagaacacatgcacacaaaatcatatatccatatgtattttagttaaccaaaagcaactctttaatgaatgaaaggcgaaacaatcatttcaagcaagatgatgatctagcccacttcacctaataaggtcagatgcaccgaatgaacaatcacctaatcgagcccctgaatttcattcagaacactaccaaattcaactctaaactgaccaatttccatccaaaaaaacaaactgaacttgcaggatagtactagtagtactactacccagtaaccatgtcatccaagatccaagattggtgttgctacaacgatgcatttatcaaatgaaacaaaatttactgctcatcacaatcaaagagaggagggt

SEQ ID NO: 100056 - DNA, 504 bp, Oryza sativa
agcatgagatttggatatgaactaatactgctctttttcttatgaatggtacacgccgatgctgtactaatgaactacattgccattgttcttctggagatatacatacggtattattttttttgacaagttcagcgatatggattgtattcgttctctgccaagtccgttcgaccgctgtgttttcttttactttcccaactcaactcacgcacgttttttaaactattaaacattatttttttaatatatatatatataaagaaaatttgttttttaaattcatattaatcattttacaaacaatattaacttaattaattatacgttaatgagttcttaattcattttttttgaaaaaaaaaatagcctcctctgattcgctcgagcatttcgtcgaacacccatggcgccctcccacgaaaccaagctcgaaggaatcctttctccaatcgctccagctcgctgcatccgcaactgcaactgatctccttctcctcctgc

SEQ ID NO: 100057 - DNA, 626 bp, Oryza sativa
ccgcgcgatggcggcgtggtggcagtggccgagggcggcgaggcgggcggccacgtgcgcctggtcccgccggagcgggcgccggaacaccgccgcggagtgcccgcggagggagcagcggaaggaggtggaattgggggcgagccggtgggaggaggagaagttggcggtggcggcggcgagctcgtggaaggtgaggaggagggggaggtcggggagagaatcgcggaagagcctggagcaaggcggcggtggaggagaaggtggcggtggcggtggatggcgcggaggaggagaaggtggtggagtactgggttgccgtggcgcgaggcgaccgctgatgctgatgctgatgctttcttggggtggtgccggtggaggcggaggcggccatggaggcggtggcgacggagctcttggtcttgcacatccgatgatccttctcctcctccttctccttctcctccggctccggattgggcttgggtttccgcttccagagggtaaccatgggcgaggcgacgagctccgagctcgcttgcttggttgcttgattggttgagctagtggccgcccagatcgggaggcggctgctgctgtggagagttgaattgcggccagctaat

SEQ ID NO: 100058 - DNA, 8506 bp, Oryza sativa
atcgacttagatcgatcgatatgatgtgatttagacagagatgatccacatcaatgtgtatgcaagaatgcaagaaactgttcttgattcgagaactcatgcccaatcgaccatggctgcctgcctgtccctagctagctaccacatcctttgcctctacacagtacacacactacatgagctagatatatagatcaaaagatttactgcctccattctaaaagttgatcgattcatgtaaaaaatttgatttattttgggacaaaaggagttcatttgtaagatcagacatatgcatatatatgttgtctgatccttccagttcatatatatcaaaagagacatgtacacctacttctttcttgaagatggcacagtagtctataccacatctgttactatatgatgatgttttaatttagctttgacatgcatgctcaaagagaagaatggagcaggagaagctgaaagtatgcagtggcaagcaaacatacacatatggagtacttaattgttaactaagctggccttccattaatgaaagcaagaatgttgtttggatatatatatagcccaattcagggtgtatagtggtgtactacatgtgttgctttgatgatgtactacactatataacaacagagaatatatgcagcatatatatatcagttaactggagtggcacagcacatcatatcccaactaatgatgataggaatatttacatcgatcgagcatattatctgcagcgtcaaccagatactagcagccagtgctgtataagaaataaagtatgcatatatctgcatgattgattaaggaatacttgtgtacttaattaatcaactagctaactgagtactgcccagtgtatagtacttataaaagcagctaactggaagaattaattgagcttgcaggtgattagtgaaacataattaaggaacaagagtacgtgtctgaatgggagaggatgaagctagctaactgaaatgtaagtcagtgtgcacgtatacgtgcagatgatagataaagctgatcgatgatgttgagcatctgggacagcttagttagtcaattagtctctaattaatatataccttgaaattaagcttctatatatagaacaagtgtacagatgatgccaagggaactgacgttgagctagctctcctgcatcacgagagagggaagaagagctagctaacttccaatcgaaatgatatttatgtcataaaatcatggtgtacctgaataatcatcatgtttcttggtccattaattcctgcctgtgtaccagaaaagacgaaaccacatgcatactggaagactgggaacattcataggacaagatgaggagagcatgaacaataaattaaattaaccaaacaacgacctaattaaaacaatggtagatcatcaccttgttttgactagctcccaccatgactttattatgagaaaatttaaacgaaaactcaaaaatatattaattcttaaatactccgtaaaggagtagtgctaattgaggattccacatatatatatttgaagaagaaagaaaagaaaatgtgcttagaagaaaggagtttaagctgaaacaattagccaagctcaaatatataggaaggggaaagctagctataggaactgtacctgaagattaatttctagtctccaataatcaaagcaggccatggatcgagacgagtagtcgagcgtttgctgatgcagcatcatcaagattctcatcacatatagtcagccaacctcgatctcgtttagggatgaactcgatgtgaatcttgatggtgctgcacctgcaagcaccgactgtttgctactagctccatatatgcatcgatccatgcctctcatcctcgccaatttgtgccaatttgtgagatcgatgcatatatatggtgcatacactaccagaagaatggatagtatatatggagaatggagctagagggagatcgattaggaaagggattaattcttcctcatctatgaatggataatgagatatagtatggatcaatcatatcaagatcgatcgaagaggatatatatatattatctgtggaaacaacagattaatttggtccctacttaaagtaacaacaagaaaagaaccacatacgccaaacagatatccatgaggaaaagagagagagagaaattaaaagaatcaagaaccagtagcagagactaaacgatccatccgatggatcgccgccgcagctcgccggaccagaaacgaagacctcaccggagatattatctccggatcgatcgatgtatggatggaggaggtggaggaggaagaagaagaataagaggaagaaggtaaggagagattggggttggcatgggtggccacacacctctcacaacatagtgagtgagaaagatgacctcctaggtaggtagcaagctagctatatataagcttagctagctagagccagctagtagctagctacaagaggaggaggatgggggaagcaaaaaccctagctaatagtgatgcatcttgagaagagatggcatagctctagctctagcccccaaataattaaggttttttagcttcttggagctagctatggtagcagctgcatgcttttctctcaagctccatggaaagctagccagatgatgagagtgagagagagagagagagagagagatgatgaggtttagaggcactgaaagggtgattaataagaaattaactagttaatggaaaggaaggagatggaaggaagaggccggccggagcagttgctggttgagctgagaccaagcaattcatcgcggggctagctgctgctgctgctgacatgtaatgccacttttgcttctgattggtccactccatcgttttcacaggtgtacatgacagcgccacccccacgcaattactactaattaattagttaacaactattaatctccgatccatctcttgttcttaactaactttgcaaattcacttgaattgatattttctttctttctttctatgtgcatgttagctgatccttaggcaatacgcgccggctaactcatatatttttttcgagaacggttggatgattaactggcatctctctcttacaatacagacaatctttgatacgaatctacgtggtgacgactcggactagacggtctttttattaaacaaattaatttaatatctctaggtctaattaagtttttggcatgagcagccatgtgagagcatctggccggttggtagaagagccatatcttttacatatgaaacaatttcatgagaaaaaccacaccaacccctggtttggtcatataagaatatggttgggatgttcttaagctaccaacaacataactaatgtatatgtactccaacgaaattaacttagatgtctcaactattttgtagttgtgaattttaatttgttcatggataaataaagtaataaaaaggacaaataatttgctgagcccactaataataaatgagtaataaaactgtacccctacccctggtactgactgtctaattcctcatcacacacactgacttgttgggagggtgccaatgtgcatgggtgggacatactccatagtactagcagtagatgatggtggccaacaatttgcaagggaaaatggctaatgagctagtccatcagtcacaacaggagagactgggacaggcaggggccagtctgtgtctaaagctcaaggcccacccctgaaaaaattttcccactgacgtgatggtgtgacatggagatgtgtgtgtcatactgccaatctgtcatacacacactcacaaagatcataagccattgttttgcccgtaatgagttcagatcatgctaatagctgcatttctcagcaggagacctttggatcttgtttggggagtttttagcggctgcaagcttctccttgaatctcaatctcttctaaagacccaaacggttcagattttaagaacatatgtctataaattatagaaaatgaactagaaatcagtaggtatgagactaagatttttcagatccgcagaaactagctatcaatcatttgttttttaaaggcttatcaaatatgactcttgattaaccaattaatatatcattagtacactagtacagctactaattaatccagctagctcaagctatacactgtgtgtgagagagtgagtgatagagagagagatgagatttggaaaaggtggtgagtggtggagaaaagagagagggggcaactgcaagagcctgctgcatcagcaaggcagctcattgggtggcggcagagcagcctgagctgtttgttcggtggcactgtactgtactgctgccatggccaccatggatggtcccctgaaacaacatgcccctacggtaacactagttacatagtatacactcactagctagctctaagtaaggtcattaagcaatataattgccccttgcaagctagctaaccgctccactctaactaattgttactattgatcaaccatcaatcatgtaatcctaactcctaactcctaaatgtcttgtttatcgagcgggagattctaatatgtaagtagtcagctgatcagaataaaaaagttgggcttcccagtttctaacttctactttattttgtagattttattgctactgattctcataatctaaatgaaaatctagttgctagaaattgtagagttatcattttttagaccgtttgtagagttgaagattttaggaagaattgtagttgccataagcttccttaaacatgactaagtttctaaccaatggatcaatgattaatttcttctcaaacttcttctaatgttaattaggatttcttcaggaacttctatacattctaaacttacatgctgcccaaagtaatttcatcagaattctttatgccttcggcatggactgtggaaattcatgagctcgaatctcgatgtaggcagtacacagctggctgtcgactcagtatggactggtgtaattaactagtgttattagtagattaagcatgatacttagggttaaataaaacatgcactagtatctgcgtgcgtatctgttattttgttagtaagcaacgctcctggtttctgccattgatgtcggcatccacctcacactccttaagtcaactcatcttcctgctctgtcagttcagaaaaaaaagaatttaaacattaatcatgtgtatataactgttataaagtctaccattgcatctacttagtactaacctaactacttcttccacgaaccattgaccactgaaacttgtcatttttaatggagatattacacagtaagtgtgtttaatttgcaggcagttttagctgtaattttgtgttctgagataaatatgagacaaggatctatatatgtttttttttcatgaataatgttactcattcagtaggacagctagctgaaagtttagaattgatggtgtgatcagaaacaaggcctatgcatgcatgctaacgattaatatgatcaagaatctatagtttctgaactcatcattatcaaatgagccatctttatccactaaaaaatgtttattaaaagtcacctgaataaggttacctcgaaataatgtaaagtgaactagctaccttgaacagtctttaaattttctccaccttaatttcccctcaaattaaaaagagagaactcctactttaatagttgcaggtttggcggtgtactagctactacagtgcatatggatgacataaaaagttaattaacttaatactctcatacaaggatagatgcagagattggacatcaaacatgcatagattaattaattatgcaaagggcatgtacggatcgaatacgatttgattttttgcaggttattggtcgattgtgagtgcagtgatgagattagtttaatcatccacgacgaaaaatataaatatagcatctgatgtacctcccctcccgaaagattcctggtctcgatctcaggcaggttgtttctacaaaatgttttttttttgttattagtattcattgagtttctaaaaaaaatactgatcgaaatcatcctatatgtaagtatatatgtgcagcaagcagttaagaaaaaatagattctctcaccttggagaggtatataagtataactccccatatttgagatatacctcgatctccataaaaggagataccaaaaattactcttataggttagtatatgggttgaaacctatctttataaatatttgaaatagaaggtaccaaaattcagtttacattacaatttttagaggtatgatatttgtgctaattaagaggtatatgtgcctccaccctagaggtatatatctccgaactaacactataaagtatatatatacctacctcacatgcaacgactagaaaggtcttaccggtgctaatcataaacttgttttctattcagttaaactgtctattttttacctattaaattgtgaggaggtatatacctctctaaagatgggagaaattatctcaaagtcgagccaggatagaatttctttgaagtaagaagattgaaatttataaaaaccatgcatgttttatagacaatgttgtggaactacagtactcgttatagtttgtggcaaattaataactcaattatcatggtttcaaggtttcacaaaaatgaaaaatccgttaaactccaaacaatgtaatataacacttatttactttagagtaaattttataaaaccccacctattatggtctaaattgtacaaaaccacatggattttagcaagtgtcacataaccccatctattatagtcctaaagtttcacaaaaccacactattgatcattttgaatttgacacaccacacttttgagttctatagtcacatctcaaatttatgaggattttatccatcatataaatgttacatgtgttttttttattttactataggagtatgtaaaaatggttaatggtgcggttttgtgaaactttaggatcatatataatacccgagattatgtaccacgtgccaaaatcattgtggttttgtgcaacttaaaccataatagatggaattttatgaaatttactcttttttattttatctaagtgtcgttaaattaattgcatgatcaagttgataaattaaattagttaatgttcaaacaacattattatataaaagatgatgaatttaagtcagattttactagaagtggggtcttatgaaatcttatcccaaatgctacaactcaaaataccatatttcgaaaatttcaaccaaataacttaaggctttttttctaaaacttactccagtaaatttaatataactaaagtgcaatgtgtgcatatatactactacatccgtttcaggttataagactttctagcattgcccatattcatatagatgttaatgaatctaggcatacatatatgtctagatatatattaatgtgagcaatactgaaaagttttataatataaaatggaggaagtagtaaactcccatttatgtatttcataaaagtacggctgatcgtttggcctatgaccgataagtcgtaaaatgacatgcaagaaaaaaatatacgtaaattttatatttatttgaaaattcatctttttttggcagcggcttattattgtgcgggtggtagcagataattaaccatacataagctacgtacgaatagtcaataagactagctagctggatatatagctccaaattaataaggtatacttgattgcgctggaagatgcataggtacttgattcctggttagctagcatacatacattaattaagaaccttttcttttggaattgcctccaagactagtacacatgcatatatattatatatatatatatatatatatatatatgtttatgttatcctaatggaaagcaatgggagagctccacctgaaaggtaagcttgcattctgaaaatgcagagattcttcctccaaacatagtcaattggctggctggggacacatcacatagacaaggaataaaggagccatgtaatttagctagctcaagctatagcttttgttggcaagttaattaaaattaacaacaaatgaaagcaagttcctaagcatgcaacaaacgaaaataattaatggtacctcccgttcaaagaaaaagagtaacctcgggccctttcgtggtgcacacttcatcatgcatcgatttttcttttgagcaccaataattcgacatggaaattaaatacccaacagaaaaaaataaatgcaattacaatttatactttactcgtgtgtaaaacttcaagctaaaaaaaatcaaggaaacactacgtacataaatcaaggtactatatatccgtaggacatttatcactcgtttttaatttgatttgtataacaaaattttgattttacacctaattaataaaagaactctagaacacaatatatattatt

SEQ ID NO: 100059 - DNA, 583 bp, Oryza sativa
tcaaagacttttctcatagctacttgtatataccagccaactatggaaaacagaaaaaaaaaagagtagcatggtcactttttagtttttatccactcctcgtctcaaaatttttggaactaatatttaacaaaatgttttcctatagggacagtctattcccacttcctgaaaaaaaaggtcaattttttgtacatccaggattgtcttgagatttgttcatgaacagttaatcttatcttctcctctcgttttcccatcccaagcacgaccgcactaatgggcgctcacgggcgccatcctcccctagcccgactgagccgccgccgccgccttgatctgaacagttggctgaaggccatcaatagtgccagcacgttccgaccaactaaccgcctcctgctgcccccctccctctctttcctcctcccaaatccggcggctgcaccattcccctgtgctggtgtcttcaccagctcgcaccgccatcaatcaccatctccataccctcccccctcccaccggaacccacgcccccgctgccaactatcaccctccggctaagccccggggaataacaacc

SEQ ID NO: 100060 - DNA, 745 bp, Oryza sativa
taatcttggcagtgatttttttcaatcatagttatcaatatctttggtttttatttcgttcgtacatacgtatagcttttgcctttttttttttcccggatgaattgtacgcaaggattttctcttgtatgtgaataggatattgggagtgagagattatttttttagatttaataatttaataatttaattgtctaaaataatggtctcttagctttaagtgaaaatcgaggattaaatgttttattttctctaagaacttctatgattttctttaatttattatagcgctacttagcaacgtagaagcatttgtagagtgacacatggtgacgtgagagcgtttgtaggaaatttaatggacagagtataacaaaataaatgataattacatatttctttagtaaataaacatatgttcaaacaccaataatattatggatgtatattaggtaaagcaaaataataaaagaaggtgtataagaaaaggaaaaaagtctagggggtatgttacgttcgtacttgtacgtacgtacttgcaggtggtgagggaggcatacgtataagggtctatttttaatctaatctaatagtgcaaaattatggacccaccaatttaaatgaaaatcgagggtcagatgtttctaatatattaaaacgtcacatggcgacttaggagcatttatagaattgtcacgtggcggcttaggagcgtttgtaggaagtttaatggacttttagtata

SEQ ID NO: 100061 - DNA, 652 bp, Oryza sativa
cacatgttattaaaatattaaccgcttaatatatatgtatggggcacatggtaatatttgttccagcttcctgcatgtttatatgcatgtagcttaatatatatgtatggggcacatggtaatatttgttccagcttcctgcatgtttatatgcatgtagagagaaattaattgtgtggctagcaagccattagatgtctaattaatagcaattaattttgatacctatttacagttgtttatagtagctcttacatattcatcttacgactttgattatccgttgattcccaatttacagattaccatcactcgcatgaaaaaaaaatacgtactatttaaggtttaggacagctgaaattgatgaattatctgatttatgttgtagctatttgagggtataaacaaataaattgacttctaaaaagttaaaatgtggtttaaaaaaggcacccatttaaaacctggaaagcgtgcaaacaaaaattcaactatgtaatctagaaaaaaagaaggtcttaaacttccttataacacccttgcttttgtaagagtcctcttgatatcggtaatatagcgctcagaattataatataatgattctctttacctatatgaataaataggccaaaatccaaatccgacataacac

SEQ ID NO: 100062 - DNA, 560 bp, Oryza sativa
aatactatggttcaattttagtttatgagttctaaaatttagaaaagataaataaaaattaatttttactactttataaatttcaaacctgttagtaactgatatgaactgtactatatgtcaaagccactggaaaataacagcacactttaaaatttcaatatttacaatattaaaaataattacttgttaaaataaaagaaaaaataattacagaagcaaatattttttagtttttacatttttatgattttagacttcaaatcgattacaatttgatatttattgattataatatttcgaactaaatcatgaacaaatcactttgaaaatatttaaatgtcaataacagaagtcgtgcaatgcacgggttggccactagtgtgactaatcaatataaaaggagggaactgtttacattttttagtaggatagatttataaaagctaacaagtgctttttaagatgacaaaaatcaaaacctatttttatatgtataaactaagtatttaaaaataattggatatttaaaagtttgacagagagtaaaatgttataaa

SEQ ID NO: 100063 - DNA, 677 bp, Oryza sativa
aaatgaagaaagagaaggaaaccatgtcttgcatgagacatggtttctacacaacatccaagacatcatgtgagataagtagcattaaattgaagtatggaatagtggtgtttgcattgaagaatagtgtctagtactagtttcttaatgatgtggagtttatagaaaccatgtctagtgttataggttgggactgcccttataatatttcactatgtatggatcaaatgttgcagtgaactttaaaataatttttttttttctcgctatttgctgaaacattgtttttatataaggtgaaacaacacccgatttaaacgagttaaatattttcgatctacttagtgaaacaattccgatattcctagtggagcagggtgcaacatttaaaaataattcaataacaagctaaaaaaaattcgtcggaatatatccatgtatggtcttgttttgaagatttaattgcaacgaatttaatagtgcaatcggatcatgatttggataagtaatttaagagaaaattcaatttaaagtagttttgcacgtaaatcgggctgacgtcagcgcctgatttttctccaaaccgatcgggcgcccgaaccgtaaactcgtccgaataaaaggagtcgataaaattcctatggaatgtactatgaaggagaacctcatggaacttt

SEQ ID NO: 100064 - DNA, 541 bp, Oryza sativa
actcggtagctcttgactaataatcatactaactatatcaatactaagtattatgcatgttatctcactagatttatatttcgaagtactttcatgtgatgctaatttcatatttgttgcaatcatagaatgaaataaaatactagttaaagtatgttattgaagaatgtgtaaaaaatataggtcttataatttgggacagagggagtatactagtagatgtaaactgcttcctccgtttcgaaatgtcagactttctagcattgcccacattcatatagatgttgatgaacctaaacatatatatgtgtctagattcattaacatctatatgaatattggttatgctagaaagtcttacaatatgaaacggagggagtagaattgagtgtatattggaggtatcggaattgtttgcttttctatttcttcttccacatagcttaggattaattattgtgagaatcagagttcttctgctgtgtcactctacccatatatttgaattaacccctacctagactttgattatacacgtgat

SEQ ID NO: 100065 - DNA, 628 bp, Oryza sativa
caaagaaaagcaaacacaaaggcgagtacatctttgaacatcaaaacatccaaagctgccccttcaagaaatcaagaaaagaaacaatttaactgcaaacacatgtgtaaagcaagatctggatatcaaaacacccaaatctgcccatcttgcagtatgtacgaaacttcaaagaaacctaaattcactgctaaacccaatacttcatcaatcctctaatagcgtggtcatctaacggggggagaagaagaggcggcggcgcttactgagagcacggtaaaaaagaaccagagcatatggcctcatacctagcaggagcaacatcagacatgacatctacgggcagcaagggcgcaggacaggggatgaagggaactagggaagagttactttcgtcggactccgacgactgggcggcatcgctggcgtgtggccggccggtggactggagcctggcagcctgcctgcttttggagggatcgctggtgccgcggcgtggtcggctggccgcgcagggcgcgtgccgctggcggctgccgagccgggcgggcggcgcgcgtgtgactgcgtggaggacctgactggggcggcggggcgatggaaaaacgggcacggcggcgacgggtgg

SEQ ID NO: 100066 - DNA, 646 bp, Oryza sativa
attattctgacaaaaataacaattttgtttaccatgttagttatgtttagctagattatcctagttaaaacaactccctgtcgtaaatatcaaaggaaaatctttactttaagatatacttttaaattccagagacatatatttaaattaggcacatcactatggagtagtgctagacaatagtatttcatcgtgaactccccattagtagtcgagctccatttaaaattatcttgcccctgttttagttatacagtagcaaggagtcataataaactattctaggccactaatttcaaaccaattatgttccttctccatgaaaaaattggagggtcacttttcctgcaacatgtaaaaaatactatatcgaattaatgtaatactttgatctaagtggttcattccagatctaacggttaaaaatgccagaaaatgcacaatactatttatctttgccatagcaatcagggaaagacccttcttatattgaacactctttactttgggtacctcaactacgacgtaagggctatctatatttgacactcttattgtttctactctagccctagcattgacaatgctgatgattggatagtggggaatgttagaccgtattgttgttaagaagatttcaggatat

SEQ ID NO: 100067 - DNA, 638 bp, Oryza sativa
atttaatattttagtcagtactaaaaaaaatgttttttcatggcaccacaccttttattttctggcgattggctcccgcctatgaaaatgaattggacaaagattattgtagattcttctttatccttatatatatgcatcagctcatctttggaccaatgaaaactacatgtaaaaaagagagaataaatgtcactcatcagattgtattggtagaagcaaactaggaaagcccatagaaggaattaaaaataactaggaaagaagcccgcgcagatgtgcgggcattttgtttaatgtttatatcaaaagcgtttcctagattcaaacataaatcactatgtcccggttatatataaatttgcctaatatcgccactacttattattattattattttattttattatggatacttattatcgttcttttgaaacctgagtgattatttaatagatgaaattgtatttgtaacatcaaaataagaacaatacatcgttaatcgactaaaaaattatctccactactaacctaactgttcatgtcgatctgacttatttccaaatctatgcataaatattccaataatattttatcaaaaaaatatattataacaatatcacttctatgagttaata

SEQ ID NO: 100068 - DNA, 571 bp, Oryza sativa
ccgacatcatcgcgtgcagtcggattaaatggcctgcacaggataatgcatcttctcgtgcgggcgccggcccggcgccggtcctcgagtttttttcacgcggcgctagttacggccctcctagaaccaaacagggccggcgtttaggaaaatgatttgtgtagtgttacctactctgcctattgtgtattgtgtagtactccgtccattccaaaatttaagactacaaagctatatttggagagagcgagagagtagcgattaattgattgtttttttattaaaaatgaaccagcggtgttgctcacgcccgaccggcagtgataagccagcagtagcccattacgtggtagcagtagtgattgaattattttttcagcaaaatttttaacaaacatctaactatatcaggccagtaatatactagctacatgctggtaaggcagaagatatggctttaatataccagtacgttcacctcatgtgcagctaaaatatttcagaaatcggaacttgcagtctacagaacaccgtacatgctcgatccacatgggcagatactacgtaccac

SEQ ID NO: 100069 - DNA, 541 bp, Oryza sativa
agaagacatataaccattacaatcacaatgataaacgcatgcattccttttgttttgatagtatgaaattctagttgtcttgactttttatgcagctcacttgatttgcatagcctagaatctagcaacttttatatgcctcactgactgttaatggggctgcacgcaatatcactttcactagtacacaaacagctataggtgccagttgagaactggcaataggtgacagtttcccagtcggcaccaatgacaccggtcatagaaccggcacctttgtgctatcccagattcaaaaaaaaaagctggctcaagctgagccgatgcttttacatatcacaaatcaaatccatcactaatcatcatcaacaacaataataatccttaatccaatccatcaccaatcacagatgaacaacaatcagatgcactaactccctagttccagcctgtcgtcaatctgccagggtccctctctgcgcgaggtcaccgcctgccgccgggtccctctccacgccgatgtcgctgctagggtccctct

SEQ ID NO: 100070 - DNA, 837 bp, Oryza sativa
gcacttgtggtcttttctagaagaaattttaagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgaaccgatgcaattgttgagaaaatttcaggaaagcctattcacccccccccctctaggctacatctctgcacgttcaattggtatcagagcctggtgctcttgattcaagcttcacacctttgagtgatccacgatgtcggacttagggggaaagaacggggaaaatgaaatgaagatgaagcgagtagcaagggaactccaccacccaagggagctactataccttttgattacagcaaacttaccattccctctcacaacttcgtctccgtgccttcagggcgtgctcctcaatttgatcagacatattatgctgcttggaagcacaagatgaagggcatctaatctctttgcatccaagtatttggaatgatgtttgtacaggtattgatata

SEQ ID NO: 100071 - DNA, 782 bp, Oryza sativa
catcaatatgaatatggggaatgctagaataacttacattgtgaaacggagggagtatgatttttaagcaacttttgtaagatttaacagtttagcaggttgtgaaacgtgcgcgtgaaaaatgtgagagtggaagttgggaactcaccaagtacgaacacagtttaactggtacttcctctgtttcatattgtaagaatttccagtattcttcacattcatatagatattatgaatctagacatatatgtgtatagattcattaacattgatataaatgtggataatgctagaaagccatatgacatgaaacgcatggagtatttagtaacattaggtgcaagtagcagtttcactgccgattatgcacccgaagatcctaaagcaggcagcaaatagagtgatgtaacatgctctgcctattgtgtagtactccgtccattccaaaatttaaaactacaaagctatatttggagagtagcgattaattaattgcttttttattaaaaatgaacgagctgtgttgctcacgcccgaccggcagtgataggacagcagtagcccattacgtggtagcagtagtgattgaattaatttttcagcaaaatttttaacaatcatctaactattgcaggccagtaatactagctataagctgataaggctgaagatggcttcaatagttcaatataccactacgttcacctcatgggcagctaaaatatttcagaaaacggaacttgcagtctacagaacacatacacactcgatccacgtgggca

SEQ ID NO: 100072 - DNA, 515 bp, Oryza sativa
atttggcagcaggagagcttcttgaggttgcaactcctggaaaaggtttgcttcttatttgacatattggatatttataaggaccatgcccatatatattttcctcatggctgtattttttgtgtagttacacaagaacagcttgatcgagctaaacaggcaaccaagtctgcagttttgatgaacttggaatccagagtatgcatttctaaccactacttgaatcctttgtgcttatcttttgtttcctgttgtatccttgacactttgttttcttcactgcaggtcgtagcatctgaagacatagggaggcagattttgacgtatggggaaaggtatggttgcaccagcattggtaacatagcaacaaaagtcacctcacatggttcttaaacctttatgtgcactagccatgcattcactatcatttatgagctatgattgtgcaatcatgctgtgtcctgacaattttaagaacgggaactttagcatgtcattaaaatcatagtgaaacc

SEQ ID NO: 100073 - DNA, 636 bp, Oryza sativa
gcgaattcgagctcggtacccggagacgacgacgagccattattcacagatctacctaaccagatcaagcgaattgagacaacccttgacgaagagaagttttcgtccgtgtggaaggatggtgttgcgaaaattgtaaaacattagtatatatatatatatgtatatatatatatatgtatatgtctatatatatatatatggatatgtatatatatatatatatatgtatatatatagatctacgtatagatataggctgaggtagagcatccgataggtgagtgagacactcctatctataggagacgcctatacagatgattatgctatcaaaattcacaatcactatatagacgatctgtactctggattgtttgtttagagaccaaaccacttacactagtgcaaaataaacttttcccggcggacaaaatacattatctccctgcagaggacctgcccgtgtacacccaggtatctacgaaaattcatatttttgcgttcggacgggcggaccgcacgtgataattgattatcccgtgcggtcgtgttaagtagaccgtacgggataattagttatcccgcgcggtcctattatattgacctcacgagaaaatggataatcccagtcgg

SEQ ID NO: 100074 - DNA, 535 bp, Oryza sativa
gacaaaaaagtcagttcttgaagtagaagctttaaccttcccggaatacttattatcggtaacgggtcttactatgacccgtcataaatgagttggggtctttatttaggccaaataagaatgacggtcgtccgtgatggtggctgacccgacacatatacctttccacattaataacctttggttcgtgacagtacccctcgcagacacagataaggcttccagcctattacagatgagctatcctgagctagtgaaccaatctgaactgttgtgactactacaaaaaatagttttcgctggcggccagctggccagaggtgctgccagtgagttgtcacgcccggaatttcaatccaaaattctaaacgcttacatgtatgtaaaccctcgtccaggaatcagccgaggcacgcaataacaaattgataatagagtacaattattactctaattaataagcgaataaaatgtcattacataggtagatagttcctctcaatcaataaaattctgagcagcggaaaataaaaga

SEQ ID NO: 100075 - DNA, 552 bp, Oryza sativa
tgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtagaaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaaacaaaaacgaatccg

SEQ ID NO: 100076 - DNA, 527 bp, Oryza sativa
tttgaaagtctacatgtactacttttgttgctacccttcacacaaaagatatgctgctgatagaatgtaaaaagaaactatgcccatttccttgtttccaacacaatcttctagaaaacatagcaatataaaatgggggcaccaggagtagggagaaaaagaaagtatgtttacctcacattagtattccttagcctttcacccatcctttgctggtgtcatccactaatccctatgcatgtctgtagtaacagcaacattttttttgtgaaagctaccattgtttatcacttactgcaaataatagtggaaataattcatcttacctcgtataagcaggcagcatcctgttctcttgaaacaaaaagcatctactggcagaaaaaactgggggtttgttcagctagcataaaaaattgggggctctgtgggtatatccttgagcaggaaaacttaccagtagatctagggtgcatccactgaaaatcgaaaaggaaaatcaagaacagtgaagaatgttgtggatt

SEQ ID NO: 100077 - DNA, 670 bp, Oryza sativa
tttcgctccactctaaagatgcgtgtttgtttattcctgactaaccatcacatcatcgaaagaaggcttcaatgatggggctttcttctgtcattgagccggactgcctgaggcttgcgtggcctattaccggtccttgaatttctgaatgtcattactgtgagctagtggaagtaaaattgtgtgtgaagctgaatatccttttggtgttcaggcctaagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaaccccaaacaacaaaatagacatgcgtgttacagtaacaacttcgacttcaaaacgttactttattacttgcacatca

SEQ ID NO: 100078 - DNA, 1217 bp, Oryza sativa
acacctatagtacttaaaggtgccggtactatatttttttcatggtgtggatgtgggaaaaaggttatgtcggttttaaatgaaccgccacctatatggctggtctctatgagggttttttttagtagtgcattaaggtaatttagtgaatcattgtgctctcaccagaaaatttatgcagcttagcccacaagctagctgctaccagtcgcagtctcgcaggattagggcatatatcaaggtagagacaggtataagctctatgctatctaaagactaatgtcatgcaacagttgtagataatatggtctttaccattaatgtattaaaatattttttttcttagtcttctttcctttctttcaccaccgtgcaataaaattcgatctaatagctaagagttgactctgaaccgttgtcatgcataacaaccatatttctatttccgtttttctttttcttcattagtcatcaaatttacatacatggtaataaagagaccacttataaagaccattgtacatgcgcttaggaaccagccgcagacgcctcttggcctaccgatcgactacggaggctgcagcatgccaactcgccgttgggcccgtactgctccagtacgcagaacatgatgtcaggctggttgctctcgccgattggaggccctgtgcgggcactaacctcgcacaccgcccttgatggccctgtgcggaggctagcatgttttctgttttcatgatgcctctcatttgtatcacacagcgatacatataaaagtttcccccttttcaccacattttaccattttcttcaggtccaacctatgtttttccattgttgcatccaaacactgccttttcatttttatgttttacgcatttttttttacttatgtcagattgaggaatccgtaatacccgattgtatgcaattttttctattctcgtgtttaagatataaggccttaacatgtgcacatgcatgactatacaggacagggagaggtgcaagcaaattaaaaggaaaagtaatgggacagcacttgcgaaggtccagtaaaatgacagagatacataccaactggagaactcttgaaattattatatatgctcctttttttccgtttgcactctaggttgaaccattgttgttaattctgatatcacatcgaaaagtttgtatcctcccaatttaaagacaatttctacattttaggt

SEQ ID NO: 100079 - DNA, 548 bp, Oryza sativa
tatcaaatactcaaatgttggctaaatgctgcttttgcaaatgcaaccctattatgccatcctttgttatcttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaa

SEQ ID NO: 100080 - DNA, 555 bp, Oryza sativa
aaaaggctgtcctaacgatgccttcgagaaagaaaatgacactcaaacgtgctgccattgccatgaccgaacctgtaaaggccaaaacatatgtttctccttcattagagagcaaatctttgactctaggcagtgcttccaacagggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacgg

SEQ ID NO: 100081 - DNA, 647 bp, Oryza sativa
attcaaattcgacaaatttaatgttgttaagtagttcttgttttcactgaaatctctgaagttgttggaagaaatcagtggaccgaccaagattattactgtccgcatcacatctgatagatagtttcagcaaattctcggtaaaatgctttagcagtgcagcatgagtggtaagaagaaccacatctttttcgaatcatgatatttatgtgtttctatatattgttatggtcttagagctgttggttgctccaagtataatttttatatgctccacaaattattgccttcattgacaatgttttaatatacagcttattactctgagggatgagtggtggtatgatatgctgtatattttatctgtgcagggcactttttttctctgaatggaccataatatctgttgagatattgcattcttactcacctgttcataagataaattattgcatggaaccatggactgaatcatatatcgtgtgctctatgcagtatggacatttgctaaaatcctactcaatttatggtgtaatgtatatgtagctcctgtaagttcttcctagatgaattctgaatattaatgtttgcttcaaatgtaatatctgagagacgtggaacacgttgtggatgccaagcatgttgga

SEQ ID NO: 100082 - DNA, 555 bp, Oryza sativa
ccgggagcaacaaaatctctgcttttgacagtgtagcaatacttatgcctctaatagtatttctcaaaaacattgcaatcaaaagctggcattgtcttgtttcacaaaaaaatgttcatcttttggaagtgttataatttttcaattcaaatatgtttgttaagttgagacaactgagctggtatcattgagtagactggtagattatgcaaccatgccaaacttggcatatcttcttttttttatcatggtacagtcggcatatcatttaacattttctcttgtggtgatctagcagaacatagggttttatcttgagaaattctagatttctatctataagttcaataatctttaccacaagtatggattgaactagatgcaaattaattaagctgtggttgcaaattgaattatgtgagtgcatactatcatttagcaatgtcaacagattaaattttgagatatttggatgtagtattgaagtatcaattagtaatatagacaggttggattttcagatgattatgtggcatatcatgcattaacgaaaaa

SEQ ID NO: 100083 - DNA, 958 bp, Oryza sativa
accaacatctaggtcattaagttcaagttgactatgattcatcataaatgaaactctaaatctgttttggttattatcagttgtagagattgttgtacatttgtatcctcaacatgaatcattcataaacatagcaaactcattctttatatatataaataaactcattctttaggttgatataggatactgagaaactggacccgaatcagccaaggaaggcttatgacaacaatcgacccaacgacggtcatcttgtctataaagaaggagaagttgcaacaaagcaagatggtcatacggaaaagtgtttcagtaaagacaaggattgaaattattagacttgaccgggaagtcaagatgggtaacatgaatagtggtaatccaaagctcgatcgaacttttggcttgtatcagatgctacacagaataaaaacacttgcactagttactgctcaatgtgctttcctcacaaacgatccagtgggaaagaacacatcaaggttgaaggtgcaaaggaatatgcaggaagtcaaatgatgacaacacgaagagaaaaatggcaagtaaaacgaatgtaaagaaagtgaatataagatgtcttttcttgggagctcttcccaattacgagccaagtgatatgttcaaggataatctacggaggtcagaccaaaatcatatcaatgtttagatccaacaaggaagcttcatctttggtaggttaacaatcaaactaatataagccgctcgtaaagttacatgacaagttaccaaagtatgacaagttttataacctggttatcttgagaaacattgtatgatgagagagttgttgatcctaaagcgattattgacgtgtaccccaacttttcttgggacggggatcaatgcacaagcaattgggaaaaggtagttttctgatcgagacagcgcacatgtccggtcgcgtggagctcag

SEQ ID NO: 100084 - DNA, 965 bp, Oryza sativa
agaaattttgaaaaggctaaaaataaagatgctccaatcttatagaactcaaacaagaaccggatataaaacttgtcacaaaagattttctctaatattttaaaattttaaaattgaaatggttgaataggaagggaaagaaatacaaatgattaaaatagatgggggaaaaacaaataggactttagccccaaaatatttagcatggatttttgatggttcgataataggctaaaggagatttggatttttgaataaaggaattgaaaatgggtttcttagctcaagagcaatcactcaagtatttgtgataatattgttctttgtgccaaggatgtgatcaagccatatagattatataggtggtgtgatcaaaatagaaacttgaccacataatggatggtagcatattttggttgaaggggaagtgaagattttggggggaaatataggaattaatattttatgtactccagagatgtcggagaatgatatttcatgtgctctggagatagttgggtgagatcaaaagggtatttgtggatgttggagatgttagggaatggattcaaaggaaatataatttagagccaatgttagggatttaaataaaataaatggagaggttttgtaaaatttaaaagagaacaattaactttgcaaataaagttttagatccaagataaaagaaaaggttaaatgcaagattgctccaacgtaagaatcgacaaaagcatgacttaaaatatttcgcaaaaaaaaaatcctgaaattttgagtccgttacacgtacacatgggaaatatgtcatttttgacatatgtgaatgattaacctctccttttgcaaacatttgaactgtgacaactgacaatcaaatgtggagagtactagctttaacgtgttaatttggtttccatgttgacttaccaaagttttgatgaaatccacaagcacaaaaacat

SEQ ID NO: 100085 - DNA, 1238 bp, Oryza sativa
actcatttgctgctctgactcttgaaaatcttcagctgaatgatgatgcagctagatgcttttcgacgcatgaatattcagaagtcagcacatatacacatgtacatgttcgctagcggtatagatgaataagaatgtattgcagttagagtttagtccaacaacatatgtggagtggagctttaccacctgcatgaagcaatatttcttagagtgcatacatgaagcaaatttttctcctccattttcattctttgtcttttaaactattttggatcgcatttgtaatatttcggataatgacactatgtcttctccataaaggataaatatgtgatgacgttggtgcagacacatgcttcaccatatttgcacaaatgcgaggacttcctcaccgacacgaatttaaagcatttgaagagctagataatagatatccgtagaacgcattgcaatgaatcgcatcaagtttttgcaaccaaatatagaaacttgaaacggacaagcaataagaatggaggaacagaaaagagagaaaatcacagggtctcaggtggtctatcattcaggatcagtgacaatgtgatctgatagtcatatatagtccaaatttttgtgtttacggccttcattcatgattttcttatcaagtccctccgcgaaataatacagatgctgacctgattttttgacgcaacatgtttttgtgcttgtagatttcatcaaaactttggtaagtcaacatggaaaccaaattaacacgttaaagctagtactctccacatttgattgtcagttgtcacagttcaaatgtttgcaaaagggagaggttaatcattcacatatgtcaaaaatgacatatttcccatgtgtacgtgtaacggactcaaaatttcaggattttttttttgcgaaatattttaagtcatgcttttgtcgattcttacgttggagcaatcttgcatttaaccttttcttttatcttggatctaaaactttatttgcaaagttaattgttctcttttaaattttacaaaacctctccatttattttatttaaatccctaacattggctctaaattatatttcctttgaatccattccctaacatctccaacatccacaaatacccttttgatctcacccaactatctccagagcacatgaaatatcattctccgacatctctggagtacataaaatattaattcctatatttccccccaaaatcttcact

SEQ ID NO: 100086 - DNA, 673 bp, Oryza sativa
tccatacccgaaatgccgaggtgagcacatctctctctctctctctctctcagtctgaccctatatatccccagtgatgatgaacaaaatctccataaatgaactctcgtaatatcccactgtatcaaccggatttcgcgaggctcgcatgcacacgccgcattagccaaggagtgaattcgcgattgaaaaccaatctggcattaatgtgtccgatgttttgttgccaactgctaaatgaagtgccagcagagttgccccccttccaaatcattccttcgcgagtagtagaaactggtgttctcatttgttcgaaacacacaccaccaggcagaggcagattttttctcatttcctctttgctttttttcatttcccaactcgagttcgcttcgatgatgcagcagcttcatggctccgactccgtgcaagcgcagcgccgccgcccaaggtgttcgtcatatgcatatgtgttcgcacacaaaaaaaattcctttctctttttttcccctcaagaacacggagaaaaatatctcgttttccccttttgagaattatgatccttagatctgtcgttgtggacgtgtttgatggtgatctcttcgtgcgtgtgtgcttgttttgatgcaggaatggtgacgccgccgccaagaagcagccgtggtacaggcgg

SEQ ID NO: 100087 - DNA, 613 bp, Oryza sativa
tagaggcaaaaattgctatgaaaattaatcaatgcaggcctttgcctctaccagttgtagagcacgtcagcaaaaaagaataacgtgaaggtgtacagtcagggtttccaaggctgcaataattcaccctccatgtaatgcgatgaaaagctgatgtatcattaatataaagcggtggtgtccttatgaccccaacaggcaattccacactgtgtcctcttctggttggggagagagaggccaccaaagagaagcacagctggaagagatccatcagggaagagatagggtgtggtaccaagcagggaggggccagggccccatcacagcagctgtgatagagaggtgaccagagtggaccatgaagccagacagcctggcttcatgttccatctcctccacttactagtgacatgactcagttgtcccacctgttaaatgggaccaaaaatggtaggataagggtaggaaatgaaaatagctggtgggagaattaaagaagttcagtaagacacatatcaagtgcccaggagatgttagtggccagccacctgtaagaactggaagcattacgacatggtgagtctgtctgagtctgaattgcaaatcacat

SEQ ID NO: 100088 - DNA, 708 bp, Oryza sativa
aatagttcagaattctaacctcctgtgtcacttcgtaaaatgatttcaccagtcaccaaagttcccagacttaagaactccttgatcttaatgccgtggaaaagcagtcaccaccactgaaaaattagatgcaagacaaatgggtgataacaattgattctagggcactctgtaccacaaagccctctaattatgcaaccatatggtaacagagacactttaaagattttgtttcccctccaaaaacaggatttaatggtttcttcttgacatgatatgttgcagtacaggagagaggtttgcaagattttggaagctgcctgtgactatgtcctaaaagaagagtcaaacaaccaagccagtcatgaaattgaggcaatatctttaacatgaaaaactgtagttgtaaacccatgtgtagttccaccgacagatacttccagcacattgaagaagatggcagatgatccaaatgaacttcatctccacaatatatatgtacttactgcatgatacagaaaagatcaaacactgttacttcaaactaacaaaagaattcaagagaagctgacttttctaaaccttattttcttatcgtacatgaacaacacacagaagtatggtaaactgtaaggaggtgctaattattatttacagctactaaagtatgacgccctggttttttacagtaacactataatcacaaca

SEQ ID NO: 100089 - DNA, 723 bp, Oryza sativa
cttccactccagcaggcaagatctgcttcagaatatgatctacaggaaataaaagggatgaaaacccaacaaatgaaattcagcactacacatcaaaatagctttaacaatatggaatcctacattcctacacaaatgaagaagagaatattagtagcattcacaactagaaaactggaacttttgaaaagaagtccttgatttggaagaccaatttgccatctactactttgcacaagaaataacataaagaaaacatgattgaatgtgcctaagtaacacactgcaacaaaagaacagaaataagatcttagagaattagatggtaaaccgacctgcactccagtaagaataaccaagggtcaaactgtaaggtacaacatcaatgttgcaaatttgcttcagtgaatcgtaaaccttctcctcaatatcagacaggtctgtattccaaaaaccaggcgtaagcattctttcaacagaggcgaaacagattagaaacactaaaacagagaagttttctttcgatcaaaaggcgctaagcaagcatggtaaactatggtactcaagacatgagcaaccaaatggatctaactagactcaatcaagtattggtgacggcattcaaatatttacagcaactcacaatatttgcttagttctaattcacaattccagataagaacaggctaccaagaacaaacacagcctgaaaaacatacatac

SEQ ID NO: 100090 - DNA, 1836 bp, Oryza sativa
agaaagctagagatattcagattccgtggttgctaaccgtaagggaatatcttcttggcggtcgaactaccaagcaaattaagaaagttgtgaactttcaaatgcgccaagaaatgtaaccttgtccctttagaccaacaaaaatatatctttccttggctgctgagaaactgccaaaaaaattcttactcttgaccgttagaaccgctaaggacattttttatccttgacggttagtaccaccaagaaagattatccttgtcagtcagggccaccaagaataacttattgatgtccaaaactgtgtctttccctggcggccctacctaccatggcaatcaagaatatatttggggtgtaatatgagtaatttccatggcggctagaaatgctagggccgccaagaaattatctttggggtacattatgcagatacagtccaaatattggtgacacacacactatatacacacatgcagtccaatgcaacacaacatagcgaaagtaatgtgaaagtcaatatagctggccattatgtgaaagtacgccgcgagaatcgccaacatttccaacaatggtaattttatcttacctaaaggtataatattttttagtgtaaaatttagtatctttacgtactatctatctaaagataaaaaaaaattagtgtaaaatttagctatctcaaggtgttttctcaagaattgtaaaatttatcttccaacgatgatctgatttcctctgatgattaccatgtgtgacgtgtttcttttgtataacgacgctctgtaagcctgctgatcagggagcaaaaatcccaattgaagtgtaaaaacaaacaattcaacagttccatgaaagaaaaatgctacaaaaatgtgtgaaatgacaccggagaaaaataaaggcatacataaaatagaggagtagaataagagtcggattctatactaaagggatatacctattgtagcaggatggcgacatggcgacttagcatagcgagagggagcggctgccagcgacgttcggccaagggttgctgtaactctgatatatacgctgtaatatgttggatcggggatgtgtacccgttatcagtgcctcggggatataagctacgactctcaatgacgtcattgtgtttggatctcctatgacatttttcgcatttggtttctaatgatgatcttgggccagttttataaggcttttacgtgtttgtgaataaaaaaaagatgaagatgaagacaacctccgggccatgtttgcaaagactctctatcagggggccaaaaaacctcaatcaagttgcgttgcatggcaaccatgaacaatcaacagaaacatgtttacaagggatctctactcctaccgagtcctcatcgatcaaccgatcgatcactgcgttctacatggcgaagatgcagctgacgaggtcctcgaagctgtaccccgtcagctcctgcaactccgtgctccagaccagcgcgtcgtgccggttcagcgaacacctcgcgacggagatcgacgcccgccggccgccgcctccatggacggcaggtatagtagccccgggcagccgtacgtagttcattagcgactggtcggcaacgtcgcgctccagccgctgcatgcacccgtagcttttcctctccccggctgttgtacacttgtaccgggtgaagtgctccacgaacgtgtccgcggttgggccatatgtagagacatcagagtaccaaaagctaataaatttgaatttgatgaattaatcacatatatttcaaccaaataacacgcgcaattttgagtttacagatcaatgtacaggcaaca

SEQ ID NO: 100091 - DNA, 1006 bp, Oryza sativa
tagatgatagaaacttgcataagttgatgtagtttatcataatttaaacagtatatagaatgatgacccaaatttaaaagtaatatgatgtggctttataagagaagaaaatgtgagagataattccaaccatagattaatcatttgagggatagaagcaattgaggtgatatggcttaatgagagaagagagaaataacattaactaaataagaataaattgtataggtatatagatattatacaaaatgatggagagatatattgaaatattttgagaattatgtggaatgatgatttaacatgcttggattttttaaagctataaaatttaagtgaggatgaactataggcatataggatattataaaaggtgatggagagatatattaaaatattatgtgaattatgtgggatgataatttaattcacatgcttgcattttaaagctctaaaaattaataaattagcatgcttgcatgagatttgagatgtagtaaatgttagtggatgatgttgcatctttacatattgagccttaggatgtagtaggctaactttatagaaagataggattttgtagctaaattttgctacacctatgaataatttgttgccacacttttgacaaattaacttgtggtaaagttagcgttcgaacaattagatcttaaatttatccttaaaattattatacctccttgagccccattggttaccctaataagccaaaaaaatatatcaaagtttgaatttttaaatttaattttgaagtggattttaagatattttcaacgtatttttttacattgacttttaagtgataataacacatatataaaagttttacctgtaaattaatttttattccctaattagtcatgttgacttattagagaatatgagcaaccaatgagaacttaaatctcacctaacctattttttgcctaattttgcataagtgcatactacctgtaacacacttggttataactggtacttttcg

SEQ ID NO: 100092 - DNA, 1038 bp, Oryza sativa
cgtacacgttcgtggagcacttcacgaggtactacggcgacggagaagaagagaagcagttgaaggaggcggcgcatcgggtcgccgacgggacgctgctgacgtacgggttccaccgctacctgccgtccatggtggcggcgtcgtcgatcttcctggcgaggctgcacgagctggggcatgagccgtggagcaatgatctcgcggagctgacaggttacaaggccatcgacttgatggggtgcgtgtgcgacatatacagtcaaattgcatgtcctcgctttgctcttttgcaagagtacttcttcgaggatccatagcccatgtataggaagaacaaaagagtctgtaaaagcacaagcatgcaaggcatgaatatgatggcttaaattttgcactgttgcctgtacattgatctgtaaactcaaaattgtgcgtgttatttggttgaaatatatgtgattcatcaattcaaatttataattactagcttttagtactctgatctctctacaattatggcccaaccgtggattcgtggagcacttcacccggtataacagccggggagaggaagagctacgggtgcagcggctggagcgcgacatcgccgaccagtcactgatgaactacggctgcccgcgggctacctgccgtccatggaggcggcggccggcggcgtcgatcttcatcgcgaggtgttcgctgaaccggcccgaccggtctggactctggagcacggagctgcaggagctgacgggtacagctccgaggacctcgttaactgcatcgatcctcgccatgtagaacgtagtgatcgatgaggacaccggtaggagcagagatctcttgtaaacatgttctgttgattgttcatggttgccatgcaatgcaacttgattgaggttttttttggccccctcagcaagatcctaactagagagtctttgtaaatatggcaaggaggttgtcttcatttttttttctcgaacacgtaaaagactttatgttcataaaaccggtccgagatcattatcg

SEQ ID NO: 100093 - DNA, 694 bp, Oryza sativa
cgccaaatcgatgtgctaggaatgcgtgtagtgtgtttgcttgctatgatacgaattgtgtcaaacaatatttttctttgtctcaatcatatggccagtcattcatatgtgcttgacaagaatatggctacagaaaatcttcagatgagactccaagctccaggactgatccaattttggggatcccagcttatctgtagcagtacgtgaaacatagacacttaagcagcacccaaaccaaagcatgcagaaatcaaaatacgggcatcaaagtatatatatggtgttacgtctgtttgtatgtgcgtgtgtgtgcatcttccgtgtaattgtaaagaaaaatttaaatctgaacatgtcggggtttttgaaaaatagaaaatccaagtagggatgaaaacggcgcgagtatttcctgaccgctggcctgacccgagacttgcaggaagaatatggagacaaaatgggatgctcgatattatcttagtgttgtatctgaattcgtaaaataatatgggttaggatataggaagagttgtatcttcccatatatcccatattatgaaatttgtataaaattctattataaattcacctataaacatgatgaaatattggttagtaactattttgcgagttcacgtataataatggacaatttgctcctggatatatctcggcttcttatattaaa

SEQ ID NO: 100094 - DNA, 609 bp, Oryza sativa
aaaatagatccagcatttagcgatggcccgcgaaaatgggcttttggcatcgtggtccacgaaattcagctcaaaaccaaaccttaaatcccccacactccctagtccccctactcgtgcgaggctcctctttagtctcaactccagaattgtgctctcccggtgatggtggctcctacccccagcagtggtgactggcggtggcagcggcggctcctactctcttgcccccaagcggcggcggcggcagctgctccaacgtagtcttgccccaagtggtgatggcggcaactccaacgtagtcttgccccaagtggtgatggcggcagctccagtggtcctgcccccaagtggctgcagtggcttctacggtccagcccccaagcggcgacggtggcggctcctacggcacctcgagcagcaacatgtgcaatcaaatagtgagtcacatgtcaaattttagcccaaattctataagtttttttatttttcccctaatattttttaaaactgctaaataccttagttgtagctataacccgctatagccgctcttagctgttggagagcacaaccgttaagaggcttagccggagatttagaacattg

SEQ ID NO: 100095 - DNA, 1297 bp, Oryza sativa
cttgatggtgtcgtgatgaggaaaaggaacacattgacaggaagcgaaggacctcgccagaacttatggaggaagtggaggaccatgatagagcttgagaaggaagaggaacacattgatgatgagcttgtccatgcaagaaacaactatgacatatagctattgctgggaaagaaggggtcatggtaggctgagggtcaaggatggatgtttttcttatggtgaatcacaccttattttcatcactatacacgcacacatttgcagtactagttacggtcacttgacatagtgctacattatttctgtcctcaacaataaacaatgcacattttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttttctcatgcagttcaggaaggaaaccacaaaagcggcatagacgttccccttgcgagccatatactatgcatgcgaaagattttattattttttaaagatttcataaaaccccatatttattgtcaaatttgtgcaaaaccgctgatattttgtcttgtgtctcataaccatatattttatggtctaaatgtttcataaaacaccatctttatttaaatttcagttgaattcaatatatctaaaacaatatattttaaaatggtaaatagttaaaccgacaacctcaatcaagcaatcaacaactaaatgtttcatatacacgttatatattttatgtttaaaatttttagtaaatacttgacaacaactccctccgaaaaaaaaggagataaactctaactatctgatacagcagctagagtttactttttttttctttaagaacggatggagtatatatatatatatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaac

SEQ ID NO: 100096 - DNA, 1307 bp, Oryza sativa
agcattctgaagaaggatatgggccaggggagccggccacagttggaccgaacccccagctggcccaatccagcccaacttcggcatgatagttgtacttctcatcctatgacggttgtggccgttaataccggtggaaaccgtcatcaaaagagacacttggcaagagaaggatgaatatgctatttggattctatggagaatattccttagcatctccactctctcaagtcacctccacactataaatatccctctcctctccctcattcacacacactccaagcttgagctgaattataagaggctctattgtactactttgtatactagaattagaaagagagtagagtagaagaacttggaggaattccggagttctcggtaatcctctcctatttcttttattctgttaattactctattttcaatagaaatatcttcctgagtaatttagatttacttgcaagaattatctattggttagttcctaatcagcatacgagattattgttcactataatcaactaaattataataattgctttagtgagttataaacactagagtagatattaattgcttacatatggtgtttaggtaatttatatctagtaattgttgtgtatcccacaatgcgtaggtggtaacagccctcaagagcacttaagtccttcctgttcgggtacgtagtagagcgacatttgggaacaacgggttgccagtgcctgaagtattgcgctaggattaaaattaagctttccttggacactgtttctcactagaaaatcgtctctattattggctaactttagctttgtgtccttagatgaacatgataagaaagtaatacacattccttgtggaaatcgataactaaaaatactcccgggtgaagtgccacatcggtatcttccatgcgcttgcgaattttatttgaaacgttaagaaataccaacagttttcaccttcaaaaaccgcatgaccaactatgaagattctgctgaagggttttatatctttacagaaactactttcaccatatgataaaggatcactctacgcatgtccaagaggtaaaactgtggtgtttttttgtgcacaaacagatggaacacatgttgggcacaattctcttggggctcatagttcaattgatgatggagctacccaaatagtcagttctgggtagcatattttgatgaaggaatgaagctgataaacaatggttcaattgagtaattgccaccacgctcggattttgcgtactaccttttgtcaacttaactctgtagaaagaatgattg

SEQ ID NO: 100097 - DNA, 689 bp, Oryza sativa
ttcattaacatatatatgtatgtgggcaatgctagaaagtcttacattgtgaaatggagggagtagtatgtaagctgatcgttcttgtttactaactgctgaaatgcttctcttcagtgtgcaagccttgctcgcttgcctgttcagaatgccctctatgccgtacaagaatcgcagacaggataattaccttcacctaaagtgcatgttatcttaaaaggtaccaaaatctctccactggcatcttatttgctttttacttggtgcgctaacctctgaaatttctaaccaaataatgctgtgcgtatctgtcaggtaacttgaagcacccaatctcttcttgtaaaatcatcagtggtatatgattcttttttcccctagcaaagaaggtgcctttttatgttccttctgtgtttgtatcccaattctttttttttttggtttgctctatagctttcccagttcaacctgttctttgttgtacgagaagttacaagatataacttctctgcaaatatgtatagatatgcgactcgacagtataatacatttgcttttttttttctcctttggcttttgggaagtaaagcaaccaaagaacatgagatccaagagacagagactggtacactctgcctcttatccgttgccctttgcagcagtctactgccaaggcggcctgtacagca

SEQ ID NO: 100098 - DNA, 598 bp, Oryza sativa
gattcatcactccaacctctgcatccgtcctcacatagccttccgcctggatgtgtctcctccccttctcttctcttttaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcaggagtagcccctgagctcaaactctctgtgactctgtgactccctggaagacccacccgttggagacccacttgtcttcactcagtgcattagatttagcttagctctttggtttttggttttttctctttt

SEQ ID NO: 100099 - DNA, 699 bp, Oryza sativa
atggtatacatcctcaaaattgggtcaagattgctaccctgaacttttgtgggaatgcagctttctggcttcagtctgttaggtctcaattggctggtgctacttggttcgaattgtgtgacagggtttgtggtaggtttgcccgagacaggaagcaggctctgatcaggcaatggatccatataacacaaacaagctctgtggctgactatgtggatagatttgattctattatgcatcaactgatggcatatggaggaagtaatgatcctgcttattttgtgacaaagttcgtggatggactcaaggaccacatcagggtagtagtgatggtgcagcgccctcaggatcttgattcagcctgtacagtggcactgttacaggaggaggcattggaaggagtacaatctgttagcaacaagaaaaatgagacaacaacttttctgaaaactaagccaagtcacaatctgacctcaccaactttccaagccaggagcattccttttacgaacattgaagataaaagaggagtagaattcagcaagggaagggatgataaggtttctgctctaaggtcttacaggagatcaaaaggcttatgttttgtgtgtggtgagaaatggggaagggaccacaaatgtgcaacaacggttcaacttcatgtggtggaggagttgatagatgctctgaagacagatc

SEQ ID NO: 100100 - DNA, 586 bp, Oryza sativa
agtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggagcagactctcgcggttgcgcgtgcgggcatatagcgcatgtgggctccgtgtgaggcacatggcatatggcgccggcattggacggtacggtcgtgcgccaagagagggcggcgtgttcgacagttcgacggggtcgtcgaacccctgagggtgggtggaatgtaacaccctaaaaaaa

SEQ ID NO: 100101 - DNA, 535 bp, Oryza sativa
ggggggtaggcgaacgcggtggcggtgggagaagcaggcagggccggcggtggcaggtgagcgcggtgccggcgggcgaagtaggtaggggcgacaggcgagaacagcggcaacagcgggcgaagcaggcaagggcaatgggggagagcggcggcggccgcgcgtgctcaccgtggtcctccgtagtcgcgtcgttggccgcatcattgaggcggctgctcgtcgcggtggtcttgttcacgtggctcccgttgatgtgccatgtccaggactgcaggtacaccgacgccaccgcgttgaggcaaagcgtgccgtcgtatccgcgttgaggtctagtatccgccggagacgaggagaggaggccgggcggagttggggagatgaggccggtcggagagagggaaagaggtgacacctcgccgccgcgtcccccgcccctctgctttgtcggcgccaagagccgtcgctcgcccaccgcttgccatcgctgcagccgccgctccgcctgctctggccttgcgctaacaccgcccct

SEQ ID NO: 100102 - DNA, 676 bp, Oryza sativa
tatacacctcaagtttacacatataaagtttagagaccaaaagtttatatatccgattcaaatttgaattcaaatatttttttatatatagtatttctatacatataaagtttatagacctaaagtttatatatccgattcaaatttaaatttgaattcaaatttttttcatatatagtatttctatacatctaaagtttatatacccgattcaaatttgaatttgaattatatccgattcaaatttaaatttgaaatattttctatatatagtatttttatacatctaaagtttatacacctaaagtttatagacccaaaatttataggtcaaaagtttacatacccgattcaaatttgaatttgaattcaaattttttatacataattttttctaactttttgtttttttaaaaaaaatttgtggtgtcctgtaatagaaaaagaaggggaggaggaaggggagaagggagcgccggggggggggggggggggggcctcccaaattgttcagcgaattaaggcccatcctgccagattgagtgaggtttattaattaatctactaataataattatttttctttttttttttcaaaccacaataaaatactaacacctacggatttttttagcgattaaaattaatgaaaaagctttatttcctctcaacctgg

SEQ ID NO: 100103 - DNA, 2313 bp, Oryza sativa
taatcggcgcggtgtccactgtcaaattactacatttatggagtgtttttctttaaaagtgagtttgtgcagtgtcctaaagttaaaaccacacataacgaatgtcctgtagcaaaatttccctaaaaacaaactttcacgtagtgtagtgcccggttcggaaggaacacgtacacgcacagtgccgtgctttcagtgctttgcctacgtgaagctgcgagagagtgatggtcgatcgtggggccccacgggccacaagggaaaattgtccgtgcttgggtggtgctctcttcaaggatggggaagagaatcgaggtgagaaaattagggcacagccagcgctgaattgaattgaattcgagcttttatggctgctgcttcttgaatcggtgctgcaggtcatcaatgctgcttgctgactcctcttttttctcgcacacgaacatgtcgtacagctacgaccgtgtattcatattgaaattgaaagtttggttaaaattagaacgatatgacgaaaaagttataagtttatactatgtatgtgtagaaaagttttgatgtgatagaaaagttggaagtttgaataattattttgcaactaaacacagccgtactcgatactctctcacaactactcctacgagtatagacaatactttttttaataaaaaaggagtatacaggagtagtagtagaactctgaagggattgagtacaagtagagtagtggtacgatcagtatgggtatgcagcagcagctagcacacaccaggcaagaacgactgaacaactatacgtatttgctacatattccgcaggcgtgcgtacgtacagtcaaagaaacagttgccaaacgtcttcaggtttgttctattagtctggccggtctgcttaattaattgcttataagcttatcctccctccgtaattataaaggaagtcgtttagaacaatgtttaagttaaaccttaggaatataaattatgaataactcttaagttattgagtttgaaaatgcaaaaattatatgtatagatttatcttgaaaaatactttcataaaagtatacatatatcacttttcaatcaatatttttatagaaacaataaatcaaagttgtgttttggagactgtgtcgctgttctaaacgacttactttacgaatatggcgggagtagataattaagttaattagcacgctgtaattcatgcatccaattaacgtggtttatttttctcgttctatgtccgtagatgctgcatgcaccactatggcgaagcaacaatttgtcaatgttttagcaccaatgcaacatctcgctcctatcagggctcaatattctgggtcgtaataatttctgaaatttgcttacttcagccgacataatattgtgcaaattttaaagtaagcaaattttatttgattttaataaaaaaatgctcaatttttgttattcgggattcattttctgttggtcccccctataagtaatgtgcaaagcaatatataggtccccgggctcctatatataacaaccaaaatatctggataagaatgtgcccagatatataactagaatttactaatatattttaaaagatggtgatagtaataaacagcattgcaatgtgtgtgtgtgtgtgaccatgtaaatactgcagcactaggtagaaacataaccaatatattagcaaagatcattgttgttgcaaaatctgaatcattttaaaacatggtctcaggcggaggcgaggcatctcggtagctggcttgctttttaattttagctcagttggaccgaaggtcctgagccttgtttttcttacttgtaaagtttattctttctttattcaatgaaattggcagtttgccgatcgattcgttcaaaaagaaaatttgaatcatgtgtagcttcaagtagaaatataattacatgtgttgcagttaattttgatcataattatttttcaaacatactccttccgtcccaaaatataacaacttttagctatgaatctgaacacacagttgttcagattcatagctaaaaatgcttatattttggaacggaggtagtaggtttttggtacataaaaataatataggtaattaagtttatcctaacaaaagctttgatcacaacattatatttattcaaaagaattaaatagtcaaagtcctgtcccattgattttaaatggtacaaaattacttccttttgtgactagagggagtagtagtacaactcaatacaacaatctgatcaacaatggcgcattatcgatccgcggagtaagtacaacttaaaaaaa

SEQ ID NO: 100104 - DNA, 610 bp, Oryza sativa
aaaataagttatattttccaccatactattaatatagccgtaatcattgtggaacatctttatagtcatttaaaaggtatcaccatagggtgaatttatagtcttgtgatcctgattttgttgtaaccaattcatagcttatgtttcattatataagcatttattattatagaaaaaaaactacagccaattatgcaagcatgtattgtaacctcttggttaaaaatttcaaacccaattttattgatagaaaaccataatcctttacaagcgagattttttccttagtcgatattaatacaacaaattacattgtgcacattgcacccatgatgtgccatcatcaatccttctggtcgaccatcgtattgccctactctaatagcataaatgacatgcggtacttgtatctctatggagatttttacacacccacactgcaggggcctaatgttctcctgtgccattatttcacctgtctagttaaagatgtgatgctactgaaattaatgcttaaaacacgcaatccacatattgtcgtcccaattctcgaaataggcagtgttgatccttctgcatgtagaaacattattcaagtggcgaaccaagg

SEQ ID NO: 100105 - DNA, 767 bp, Oryza sativa
aataggtccaccatattaggtgaaatttgctaaaggaatatattactattatattttttggtgctgttttacaaactgaatgtgttttagctactattagtttattaaatgtaaatagaataacaacttattatgaagttctgtactatgataaaatctatatcattatatttttgcatgtaaaagtaaaaaaatataacccaaaaatgaatatttcttttaaagttgaaatatgatgaatatgggtcttaatttaaatgtaaatttaatcacaaataatttggttacatataaattagcgtatgacttagatgttatagttatttaattttttccatcaaaagttatgcttcctaactaaggccctgtttgtttcagcttaagattattgtaatctaaattattaaattagattactctaagctgacataaaataagctacgagttgtttgtttttctagattattagaggcatctaagggtagtgggtctttagccactcaataatctggaaaaagctcctctagaggagattattggattatagtaatctggcttatagattgtaataatctagcataataatctacttgtttatttcagcttactcataataatgcagattataataatcctaagctgaatcaaacagggcctaactaatatggcatggagagggaataggaagaggagaatgaggggtggtgtgtacgtacgtgcatcatccacgtacagtccgtttggggtggggccgtggggttgagagg

SEQ ID NO: 100106 - DNA, 2121 bp, Oryza sativa
atatggagagagaattgccagaaatctcttccgaaacaaagggatcacgacaagtcatattttgataggaggataaagattcccccttttaatttgttagggtgtgtttgagaagaaggggattgaggagattgggaagatacgcaaaacgaggtgagctattagctcatgattaattgagtattaactattttaaattttaaaaatagattaatatgattttttaaagcaactttcctatagaaattttttgcaaaaagcgcaccgtttagtagtttgagaaacgtgcgcgcggaaaacgaaacatacaaactcactctctcaccctctcgaacgctgccagtacacatagaatgctatatatgcttaaagcccatcttttaatttgttagtacacatagaatgctatatatatgcttaaagcccatttaaaacataggactgaaaaaaatacaataatataaaaaatgtaatattccgattctatccaaatgcaactaaaacacatgattacaaaatatatgaaaaaatacagggcgaatggtcgaccgaggttggacatgatactaactttcctttaaaatatgcttgtgttaagccattccaaagcaattttataggactgttcgaatctcaattcttcgcttcaaagaaccgagtagaagacttttctattggatacaaatttaacggatctggatattctaaggactcctttcattcgtagaaaaaagtggaggaaaaaacatagaaacacgaatcctatacaacttggtactgtgtatcctttgatttgtagtaattgaacaaaggaaaagcaaggaaaaaattcctatgactataatttcaagtgaattcaatagaaaaaaataacatccaccttgagctcatttttcttttctatgcatagggtcaaggcaaagactatgggaagatatggtttaccctagcaaaacgtaccattcaaattctgaactagtattaacttaatacttaacattcctatgtttttctgtgcaccaatcaaacttttctaaaaatgaattgcacaagatagtgcgaggtctcatattgatatagaaaaaaagaacaagacgtgccacgccgcacgccaacaactaattgcctactgtgagagagacaaaacatggcatcccactgtactcaaccagtactgaaaatacatctttagtatcggttggtaacatcaatccggagtaaacatcgagacaatactaaatatacatttttagtacagattagtcacaccaattgggactaaagatattattagtagtaaagatacctgcagggttagttaaaaagaaagtatctctagccaaatcaaatgtgtatagtaggtaggatggtaacacgcgtgagggctaaggtgagagatcttgaattcgaatcccataatccacacttttttttgacttgttatgcctttttagtacttatcacggttgctataacagatgctagaggtgatttccgactggtgttaaaaatcgtttgttcaacacgtcgtacttctcttttgctctctctcatagtttcttttcttaaaaggtgtcaaaaaataggtttcttttcttaaaaggcaggagaagtgtagtgtacctcatcagcgaaagatcacgtgttcacatatgtgtcttccttctttctttaaaaaaaataaaaagataactaaaatcgactagagggtatatataggagtacaccttccgtcttaatataagtgaaaccagttaatatttcttatatattccttcgtacatgctgctctgccccacaaaatgaagttaaatttagaatatgacttataatctactctctctgtccttatgtaagtacgtacatttctaccattccatccttattctaaaataagtgaatttttaaagtgttttattttccatcaaccacttgctccttattcaaatttcaactttttcttaaagaaccaattacaccctatcttacccccaccaacctacacctcccacaatctcttatttaattagaggtgtataaattatttatattctctggtaatttttgctccatgtgctagaaatgtacttatttagggagggaggtattactagagcaaac

SEQ ID NO: 100107 - DNA, 663 bp, Oryza sativa
aagcattctcgaataaacatgtgttacatttcaaatcggacttagttatatcaacaatggagtgagatttcatcaaatctgggcaaacttagacccatattataaaaggaatttacatttccggcctcttgtgtcaccccgtgcagacgacgggaggagtgccccaaacattagccgccgccactatcctccctccacctctgccttgccgctgccggaaatcgcgcaacaagcgaggacgacactggtggggcttcagttttgcctccccagctctggttcggagaacaggcgatgcaaggtgacaacgaagatagtgaggtggcgacggtgacagtgacgagcagcatggtggcttcctcgcgttgagctcaacggacagatacggaggaactcggacggccacccaactagctagccggggagctggctccacgactagttaaggtggggggaggcgatacgatgggtttggggagaaggacggtggttggttgcaatttgaggggcgagatgaaagtgatgataagtgggatgtgttaactgtataaatggcaatatgaatcttggagcaattctgaccataaaaatgtgactgatttttgagatacaatcaatttactgatgaatagtaggcaccttccaaatcctgccactgccgcg

SEQ ID NO: 100108 - DNA, 516 bp, Oryza sativa
tgctatgaaaattaatcaatgcaggcctttgcctttaccagttgtagagcacgtcaacaaaaaagaataacgagaaggtgtacagtcagggtttccaaggctgcaataattcaccctccatgtaatgcgatgaaaagctgatgtatcattaatataaagcgggggtgtccttatgaccccaacaggcaattccacactgtgtcctcttctggttggggagagagaggccaccaaagagaagcacagctggaagagatccatcagggaagagatagggtgtggcaccaagcagggaggggccagggccccatcacagcagctgtgatagagaggtgaccagagtggaccatgaagccagacagcctggcttcatgttccatctcctccacttactagtgacatgactcagttgtcccacctgtaaaatgggaccaaaaatggtaggataagggttggaaatgaaaatagctgttgggagaattaaagaaggtcagtaagacacatatcaagtgccca

SEQ ID NO: 100109 - DNA, 518 bp, Oryza sativa
tatgtatgtatgtatatatatatacgtatatatatatatatacgtatatatacgtatatatatatatacgtatatatatatacgtatatatatatatatatatatgtttaatgtttaggataagattcgctcataatttgtttataaaatgtaatagatttatgatattatgatgctactttgcgaggcagatccatctaaatcattttatttgtcattaaactaaacatttgatacactatttattgcaagaatttcaaaagtttaaccgattcttaccttaaacatcaaatactattttttaaccggagggtggacataccaatgttcaagaatggatattatagtatcaatgcttaatgtttaaaatttaattatgtagccgtggactgtcttgtcttcaccgttaactataataaatttgagttcacaaatgaaaacaggaaagtatagtgactagtgagtgggcatgtcaagaaaagggagggcatgcacatcaacgttgcaggatttaatga

SEQ ID NO: 100110 - DNA, 1082 bp, Oryza sativa
tgtatgtatgtatatgtatgtatgtatgtatgtatgtatgtatgtatgtatgtatatacatatatgtatggtatatacgtatatatacgtatgtatacgtatatatacgtagatatacgtatatacgtagatatacgtatatatacgtacgtatacgtatatatatacgtacgtatacgtatatatatatctatatatatatgtatgtatgtatatatatatacgtataggaaggtaggtatggaggaatggaggaaggtatatatatatacgtatatatatatatatacgtatatatacgtatatatatatatacgtatatatatatacgtatatatatatatatatatatgtttaatgtttaggataagattcgctcataatttgtttataaaatgtaatagatttatgatattatgatgctactttgcgaggcagatccatctaaatcattttatttgtcattaaactaaacatttgatacactatttattgcaagaatttcaaaagtttaaccgattcttaccttaaacatcaaatactattttttaaccggagggtggacataccaatgttcaagaatggatattatagtatcaatgcttaatgtttaaaatttaattatgtagccgtggactgtcttgtcttcaccgttaactataataaatttgagttccacaaatgaaaacaggaaagtatagtgactagtgagtgggcatgtcaagaaaagggagggcatgcacatcaacgttgcaggatttaatgaacatgatgaaaaataacttttcttcaatatctagcaaaaatagcatgttgataccactattttccattggcttttattttttctaaacaaattggctgagagccctggaagcaattttacaatgaacaacaggtaatagaaatgatatagacattctatcttctttttttcacctaatcaactgtatctatttatacaactaactcaaattacttgtagtaaaactaacagagaccatcacaaatcagtgacacaaaccgtttttacaagtagagaccatcttaaagtgatccgtggttatctgcaaaagcataag

SEQ ID NO: 100111 - DNA, 762 bp, Oryza sativa
  unsure (1)..(762): unsure at all n locations
cgcgagtgagatttaccactatcatataatcggtatcgtcaccaagtaaatgcaatgaattgatgtatatacaataatacatggtatctatcaattttactcactaattaagccacaactcacgcccgctgattcctatatattttatgactagtattatgccaggtccctctgattcctatccattttataagtagttaatttgctccaaatatatatatagtacagtagtatatacttgtgttttttttacctggggcacgtgtaatacaatctagagattatttggaacttgggattttttatagtaattagtttaagactcataaagtttatgtaaatatcaaacattaaaaagtatccactactgaaaaaacgatttttttttacgagagccccctatgggttgcaaacgtaccgtaactggcgacatctgcaaaaatcaaccttcattatcgcatacgactccttaagagacctcatgttcagtcttgcggggggtgcgcacgactctaccgcgcgcgtcgttcgctgcccccctctccacgcgcgccacctgttcagtcttgcggggaggtgctgacgactagttgtgatttagccattccaggttgcatcggcatccatagccgaaggttgaagacggcggtgggctatacgaactgggtctgtagctctactaggctgggctggatcgaagagagacagtttgaacagagggaggcatggtgngctnctacanggaagtcaatcaagccagtg

SEQ ID NO: 100112 - DNA, 786 bp, Oryza sativa
  unsure (1)..(786): unsure at all n locations
agtgggatttgattcccnccctgagaaacgcctcttacaggatgnctcatctacccttctgttgtgttctaaagacgctagtcatttgggttgggcccatcctaatccaggttgctctcatcctgagatccttaacttaattacatttgcatagacccctatacaaataagagcactgttttagtccgcctgggctgctatcacacatgccgcagactgggtgtctaaaagaacaaagatgtattgtctcccacctctagaggctgcaagtcccacattaaggtggcaggatggtcagattcatggagtgggcccttttccaggctgcaggctggtagctttacactgaattatcacagggcgaacagcaagatctccgatgagcataatgaggctcatagagggtgggcgacttgcctatggtcacacagcgatacagctggaatttaagccctgctcaggagtagcccctgagctcaaactctctgagactctgtgactccctggaagacccacccgttggagacccacttgtctccactcagtgcattagatttagcatgactctttcgtgagtggnccttgctacattaccccacatctgctggtgaagataattaagctgttgttacccaccctctttattcagtgagtgatcaacgacagagcggctgatgtaagagcacagccacactcaatcttgatgagggctaggccaacagccccattttccatgacttctgaagtagctttctttgctctgggtccctacgaaaccgaatttat

SEQ ID NO: 100113 - DNA, 1270 bp, Oryza sativa
gcgttcgcgaaaaaatttcgctataatcatagcccataatggcccacttacgttcggcctattattgtcacttccaggaagttgatttgggctggtttaggattaggccatgatccatgttgaggctgagctttcccactgggcccttgtttattgaacacttcaaaatgttcatttattatctctacttacaataattagatattttaagaatttttcatgttaatcagagaaaaaaatcaataaatttgggttccaccttgcttggaccttaacacaacatattttagttccatctccttttacattgattgacagcgtaattcatagctcttgagagcaaatgtgatgtggtgaaattctataattgcattaagaggtagaggtggataacgagtcagtttggctcgtttgagtttgttattttaatgagttagtttggttcggtttgttaaggttaacgagctaaaaacctagcccatctgaactcgcgtgttggctcattaatgtatttttaccacctttataattttaaattgactattttaacatatgtaaatttaataataaacactacctaatgaagaattcattaaacataaatagtttaggtggaattaaaagactaatcactagctgagaaaagctctaattatgtgaagaagatacgatgatctctagtactaatgagctaaacgagtagctcatgagctagcttgttaagagctaaatacctagcttggcttactatgagttcagatctatcaagactatgagtttggttcgatccgagccgagttcgctacgagctgatccgagtcacgagcttagagctttttttttcacccgtattaaaagacaatgagtggattctttgatttagctcgtagttttccatagctgagactaacaacatattccaagtggtttacatggcgatgagagttaatcattgcacaatgctgcaggggctcttgtcagatcaagatgtttgatcttggacgctagatttattttttatctgctcctataacggaaaagatcagagaagagaagcatctttcaaccaaaacgccctgcatttcctccatatcaaacatatcgcggcggatgtccctgaatcgaaaataacgtgacgcgatcagtttccctgtcctcgcgcgcacgttcggcaatacgagctcgtagcagtcaatgcgaaagcaaaagacaagaaaaataatcgaacagcgcatgtgatgagcttctgaccagtgatctactgcgcgcg

SEQ ID NO: 100114 - DNA, 1374 bp, Oryza sativa
  unsure (1)..(1374): unsure at all n locations
aatcagatgacaggagtttcgttttgtcagtgcctccctttgggcagtgcgcacgtatgtgttgtctgttaacctttgatgcaacaaactctggggcgtacgtctgcaaaccgcagcaactagaggccgtgagatctggcagctactagcagttggatgtggtgtgagtgtgacgatcgacggccaactgacgaagagccttccttttatgggtttcgcttttgcataactgcatttgctgcctttgtcgttctagatagccaaggcacgtttgccatctggtcatacactcatacttaacttagtttgcccaactttgtagaaatcgggaaattcatgcttcaaaagataacacactgcagtaattaaacccgggctccatgaaacggccacaggatttcgcatgcaagtacgtcactcatttagtaaaactcgaaaaagaaaaaaaggtttctaaaaaatatacatttgaaagtttttcacttaaaaaatatacatttgaaagtttttcacttaaaaaacactacatttgtaactacaacataattatggtataactacatttgtaacaagcatgtaactagatataactatactgcaactagcatgtaattacacaaatctacagtcaacatgtgttggtgtggctggctagcttggctggcttgtgattggagctctcaggttaaaaccccagcaaacgcgtgtcaatattttttttctctcccctcactactagaaaaagcattttccctaacgttgggggtcttattttcacagtcggacgcgattttttggagccaaatgaccgcctacaaaaatataaattggggtgatgttcgctgttttcgcagacggaccacttaagcagatcattttcgcaggcgccgcttaagtggtgcgcctgcgaaaatagacttaatataaataaacaggcgggcctaaattttttctaagtccctcacctcttctcctctcccctcccctctccccggccgccggccggagacggcggcggctcccggcggtgcggcggcgtgtgctctcggcggcggcggcgggcggtgtcggaggaggcgaggcggcgcggccgaggagggcgacgaaggagggcggcgcggtgacgtgtgctcccggcgacggcggagggcggtagcggcgggcgagggcggcggaggacagcagcggcgaggaggcgcggcctaggagggcagcgcggccgaagtatgggcgacggcgtcggctcccctcccccctccctcacagatctggccagaggagggaggggggaggccggcggcgatggcaacggcgtggagtggtggcagcgatgagcctgatgnggtncggtnccagccgtagtctgtcatcccg

SEQ ID NO: 100115 - DNA, 1385 bp, Oryza sativa
  unsure (1)..(1385): unsure at all n locations
cggcgncatttgatgactgacctcgtctgcaacnagcncatcactcctatcaaatatactattactgttgagttccacattgttgtttttggttattttgtatgacatcctcttatttatctaagttaccatataaattaacagcgcattcaaactacatatggacactaccatgttttttttccctgattaaacgttgttttaagcattgaccacagtcctaccctgtccggttactactgtagtaacttactagtagacgtcacccgctcactgcaggatcctttcccctaataaagtaatgccaaccgaatcaggggcatgtcacaaattggagtccctaataaatcctcaagaaaagaagggagcgaacttgtactagtctccaaacatcagtcaagctcatcatgtagtaagtagtagtaatagtagtacaacctacataattgactatattttgttgaatgtccatacacgtgtagtagtattactattatgttgttgattgcttgattactagttgcttacaacttcctccactgatccaatccaatcacccaaaaaaaaaacagaaaaaagaaagaccagagagcatgcagagcagaggacacggccgctcaacccgcggaacaagccaaggcctagctcggtgttccgtttccaaggatgagaaatatctctgtgtgaatggttccaactgcatgccacacccacaaaccacaacacacaaatgcaagcggccgagcgccgcaaacgcaaggcccaaccgcgacgcccgccgcggtcgaacgataccacgacgtgtgcgctccagctcgatcgcgaccagatcaccagaccagccagccaacggaaaggcttgtgtaccggtacaccttgcttacgcatgagttcacaaaaccatacgattattacgtcatacgattattacgtggttatcatagttataacgtgtggtaattatcccaatttttaaaaccataacaatttcgatggtaaccgtatagttttcacggtaaccattttaccatggataatagtaaccacatccaaaatggcttggtgaaatccttctacgacacgtgagagtaataagagtttaatgtgttaagtcagtgtcaaccacggcaggcagaaacaataagtacgaaacgcacacctggccttggctttgcagcataattggcactggcaattaaaatcggcggaaccgcgccgcgtcacatacgtgtcaccctgatctcgtgtcactttcgccaggtttaattcgtccagttttcggttctctctcgcatccctgctctggtaaccaaaaaaaaaaaatctgttcaggtcgggttcttttnctaattcgttgttgttnctaccagtagtcaacaaactct

SEQ ID NO: 100116 - DNA, 770 bp, Oryza sativa
  unsure (1)..(770): unsure at all n locations
aggacgatgacgatggctgnaccnatcacacgcaggcagtatccaaggtcgctgtcgcggggatctaggacgacgagacgcgatctgctgctgctgctagcgaaggcttgtcgatcaagaggccgcggctaagcttagctagagctagagacggttgggagttgttgggcttggagaagtgtggggagcgcgggagccaggatttatagggagggagcgaggcgggcgggcgcgtgcatggccgcgcgtcggaggaggaggagatgatggtggtggtggtggtggtggaaacnagtgaacggatgtggaggccctatcagaggcttgttatgtggctggtcttcgccatttcgcgccgaagggcgcccatatttataatgggagagtccggccgaaccgaccttacgtgtgcccatgtgagaaagacatcttttttgatcgattgctgggcacccttcggacaaataggacctatcgagccgctttttttcctccacgacatgcaagggagcgtgcctcgtacgtacacgcccgagacgagtcgacgacgtacgtacgacgagttcctactaactttccacttctacttagagaaatgacagcggcagtgcacggagtattagggctttggaacactcagagtttcaattctacttctatgcgggggttgggatcattcaaagggtgcactcaattgctcggcttttaagctagcctggcagagatcgaaaaaaaacgggcacccgcgcgtccatcttgtaccaagagtt

SEQ ID NO: 100117 - DNA, 833 bp, Oryza sativa
cccccccccgaaagcgatacgtatgctgaccgatccatgcgcttgatgcgaccatgcgtcgcgttacatcagggaaaacgtgagcggaacagcaaccgcgacggcgccaccaccgcgcagcagcagcacgtacgccggcgacacgcgcgcgcgcgcgtgcccgtttctctcgatctcgccacggctagctaaagagcgagacagtgagtgcaacctttgatcgatcctacccccaaatagaagtagaattgagacactgagtggtgcaaagccctactactacgtgcactgccgctgtcatttctctaagtagaagtggaaagttagtagaactcgtcgtacgtacgtcgacgactcgtctcgcgcgtgtacgtacgtgcacgctccactgcacgtcgtggaggagaaaagcggggctcgatcgtgtgcgatgtgtgtgtggcgtggccggccagcgatcgagcgagcgcgctcggtgaggcgcgcgcgcgggggggtgggtcggtcggtcgccgccattagaaaaatgggcgcccttcggcgcgaaatggcgaagagcagccacataacaagcctctgatgaggcctccactaccgttcactcgtctccaccaccaccaccaccaccattatctcctcctcctccgacgcgcggccatgcacgcgcccgcccgcctcgctccctccctataaatcctgactcccgcgctccccacacttctcctagcccaacaacttccaaccgtgtctagctctagctaagcttagccgccgcctcttgatcgacaagccttcgctagcatcagcggcagatcgcgtctcgtcgtcctaga

SEQ ID NO: 100118 - DNA, 543 bp, Oryza sativa
agtcaacggcgtcaaacattttgaaacggagggagtattatgattccgcgtaacacgggcgagagagagcagtacataacagattaacagcagattaacatggtcatcgtttggattattccaaacggtatatttgtaaatgaaaaatagtttatgaataaaactctagtatacgtgtttttagtgatttaaaattatgggctgaaaaataaactacgatgaaaaaaccctaaatcaactccaattttaaaattgaaaattcaaattttagctttataaacttaagtaattttaaaattgaaaattcaaattttagctttataaacttaagtgaaaagatgaggttgtaagctaatcatacgatatattccaatcgtttcaaatcggaataactatacgtacgaccctgcatgtccgacctacgtacacgacgcatataaacatggttttggctaaccccatgtgaatgataatagcttttgtgattggttgttggttcagcacggtcgtatgtgagttggatgattgagtcgatcggatgta

SEQ ID NO: 100119 - DNA, 697 bp, Oryza sativa
atagctcgatctggtttttgttctgtttctattactggtatttaattcagcattttttgtcgacattttagtggctttcagagctactcttcttgtaaaaccaaaaaacaaaaaagcaaaataattaaagtgggaaaagcacacaggtgtccaaaagttttaacttgacaaagtaaaagaaaaggacagaaggaaccttagcttagctatcaggtgtggttaataaaaattaattctactgtgcccaatcattcgcctttggtttgttaatttggaggtgagatctcaatgtgggtcccagctacatgctatacactcatctcgtatcaggtcaggacaaaccaacggacaaccgtccatggcgaatttgattttctccttggacattttcacacgcggtgacttaaatttatcctcgcgaaattcaaattaaactgtttgccattaaaaaagttttccctgaattttgtacggttgtagtttattccaggggataagaacaacatgaccaacaagtgtgtagcacatcgtttgtctgacagcttgtctttcttctcctcgttgtttcagaagagttttgtgagttggatagcagcaactagcagcttgtcacctctcactcacaattaatagataatttcagggtgttatgctccctccgtcccctaatataaggatttaaacattttacttgtac

SEQ ID NO: 100120 - DNA, 1623 bp, Oryza sativa
attttgtatatccctcgtagatatagaggccggactaatgaaaatcaattatctaaaaaaaatatggttgtaatcatttcttaatatttagcataataatcaacattattttgcaaagaaaaggtaaaacctagaccattgcattattattgttactaaaataaaagaaatatagtgcagaaaaaatcatgatgaggattagacatatattcaggaactagagtggactcgaatccttatatacaaatttttatatactaccgcattattatttgtttatatttaaataagaaataagaatggttccagggcggcgccgtacgtagcctaaagagagaaaagggagaaattggtggagagcgcgtgggaagcggcgggcggcggcggggctgcacggatcccacccaatggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacatttt

SEQ ID NO: 100121 - DNA, 1404 bp, Oryza sativa
atagctagacatgtatttgtatagatgtgtgtgtgtatgtatatttatattcctacagtggaataggccatggatgtgtaagctagtgcagctacaagtctgcaactttgtaggacacatctggctttgtactgttgtgcaagcaagcatgctctcaacaagttaacaaaccagatgggccagacaatgcatgcatgatccacacggatacaatgcaagatgtagaagaagagaagaacaagcaagaaatagtacatggttatatgttcagggaagctcgaaattctgagaagcagctaagatgagtagctagctggattttgtatgaatgaatgaatctgaaaaagtaaaactaaactggattttgtatttcctgatttctagtttatttttttagattttacaactataaattcttggaattttgttaaagaattaattaggattctgtttgagggagtcgaagatttcgagagaagccatggctccgagaagctcctcgaaacagggctacactatgtgctagcttctttttttttctttttttctttttttttcttttttttatgccgggaacactatgtgctagctgtgtgtttacgaatcatgtacataatacatgtggggcaagagcctgaaagatgcagggtttgggcttttcctgcaagcacaaggccacaagggagccccttttgttctgaaagagtgaaagaaattggagatctctgcagggatccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagaggcagtcagtacagacatggaggcagaggaaatttatgtgatggttgcagaggaagccaatccaggggactggaaatctgaagtttggtgaaggaagcaaagagaatgatgagtgagctagtagtagcaaagctaggtcactgagcccagtgagtgagtgagcgactgactggatgagtgaatgagcatgtgcagaagcaaattgaatgcatgaacacaagagagattttaatttctcggcatcattctcttcctcccattgagatcatttcatttcatctctctccctccatagctggcatgcagcacggcagccaagtcactgaacacagggcaatattaagccattgcaggggatgatcagttgttgcatgcaatattca

SEQ ID NO: 100122 - DNA, 695 bp, Oryza sativa
cgggcttcctttggaatgcccgtcaggtggatcgactttgctgtctatagagacaaactcttactcctcttactatcacctccaactagaacatcaaacgaaggtccatcatatcctgggccaaggagagatttatccatactcctctttcctagcacaggttttaccccatcatcgatattttccttatgtccctcaccaagttcctcatctctaagctggtttataagagagatatcttcatggatcgttgataggggtggaacatgttcgtccacctcctcacggccattcccagcaccttcatcaagctgttcgtactgattgattgaatctttgctagacacccaagtctcccctgcagtctcactccttatttgtccctccttagcttgctgtgaagctgcgtggaaggtaggctgatcttcttgagttttccccatatgctcccactgttcagctagcttcctgacctcaccatcctccctggattttcctgggttcctagcatttaaacccttcaactcttcctgcaccgtagggatctctgcctctatctcatcccggttagcaaaattttcctttactggagcattttcctctggcgagttcttcttcctatcttccttgcctgatgggccatctttattttggcttcccgcaggagctggcttggactggttctcacctgggaa

SEQ ID NO: 100123 - DNA, 615 bp, Oryza sativa
ctacaataaaatatgtatattgtttattgaatacaaacggctcagataacattatttggaaatgtagaacacatatacacaatcaaatagagggaaaaactatttaaccgatggaaataataaaccatattttaacctaaagaattgtgtagtctacagataattcgtatccgattgatacccctagtttggttggacatctgactaactaaattatttgacatctgaaatagaatggatgcaaatatggtggcttgaccacaactgttgtttctttgttgtgctacccaattcataagccactcatctagatttgacagatgcaaatatggtttaatgttttccattggatatgttgtattatgctcttttctattttaactagaaaatgcaatgaagatatatgtggcatgtctaacaaaacagagtgaaaaacatttttgccactccacagagtgtactttcagtgcttaccaaatactccataggatgcacatttcatgttctggcattttggatcatttcatgttaaaacaatgatgatatctagattcaacctcagatatgagaatattcaaatttgtaatcgatgtaaaaacatggacacgcatgtga

SEQ ID NO: 100124 - DNA, 713 bp, Oryza sativa
ctgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaatcaataaagctctctattcccgcaaaaaaaaaagtagtaacaaataattggggttaatgatgagcagagcgatccatggttggatcgatcgagctacctaagctatcatctgcattacggcagctagcccgatcgatcgatctatctagttgggggcagatgatgacaagagatgctagccagctgcagactgctgctgctaatctcgtctcttctgatatcgatcacccacagaaaaggggagaaaaaactcagatcgggacagacagcccaaggaaaacaaaagacgaacacgcagagtactctggtgataatcagccacttgatcattaatttcttcgtgaccgttggcgtagccctgcctcaaatcaaatcgatatatatatattcttcgatctatctactctctctaagcttctcgaatctcgaaagacgatgatttgtactccctccatcccaatataaatgtaaagcagatataaccagcttata

SEQ ID NO: 100125 - DNA, 756 bp, Oryza sativa
ggtaaatgagcccctaaaaaaaaaaaaaagagacattttgccgggtctaaaggcaagaaagaagaaaaaccgccctctgaagagcaacattgaaagctggcaaggaccaacaactctccaggcccaccatgggcagcacgctgcaacctccggtgtgaacctagacaaccgtactgttaaaaacagcccccgctcaaggtccagaggtgcctataacagccgttggtcgaccccctcgcccttccgttccccttgaattcacacaccgcggcggcgccatatcaaaggtacaagagcaggctacgcggctagagaaacaacgcctggaccccatgcttcgctgcctggatcctctccttgccaccacggagtgaagtaaaggggagagagataagggagagaggaggaggaagaagggcaggagaaagaggatgacatgtgggccctacattttgtgggtcccacaattttttttgcgtgaatgacgaatgggtcccgcatatttttttaatcttattgccacattaatgccacgtcaatgccacgtaggacgaatactaggtcaacaccgccacgtgtgggccacgtcagctaaaacgccctccaaaaccgccaagggagtcaaattgcaccgtttttaatagttgaggtgtcaagatatctggcattatggttgagggatacgaatctgattattcggtcacttgttaagggagtcaaagcgaacttattccttttcctttcctttgttttata

SEQ ID NO: 100126 - DNA, 672 bp, Oryza sativa
aataatgaaatgtagggaatgaaggggattctaaaggagagagttattttaccatggtgaagcaggggcgaaatgtggccgatcacagtggcggtggagaaaaaataggactgcatgctcctggatgccaattaggtgttcaacagaatgtccagtacttgtcgcagaatggtggagccgagctagtgtaagggaaggttgggcaactgtggcgatggtcttttggaagcttggggtgtaggtggatgaaggaaaagagagatgaggcagctaggtggtggtggttaggaaggtgaccatggatgctcgcttgagtttgagctcggtttgggccgagacacggagagtttgggaatttggtatttgtaggctacgaaggcttgcttgagaagatgtggaatggggaggcaacgagacggtgggttccacttgtcggtgacggataggaagcttctggattggattgatggtgaagtggcgtggttgtggtggtgaaacaggagtgttgggtgtccgctttttggtgttcgatgcaatccattggcgccgaggagggggttggctactcgaccacaaaatcactgatcggccggatggacggtgttgcaagatggccattcttgggggtcgccctttaagccgcttattccgtgctgtaccaagggtaaagcg

SEQ ID NO: 100127 - DNA, 610 bp, Oryza sativa
acggttattattcaatttgtactagtatacgacgggtatacgtacatgtacagatgtacaggtataatgaaggatttttgttgtatctagcaacgtcgatgtcaccgtacatatgtacgcacatgtattattgtacgtatacgcacgaataggacccggaggtgcagagagatttttcttttcagataatagagagaattttgtttgtcacctttacgccatgtttgtttggagtcctcgttaattgctctggaatgtaaacaatatatggtacacggatattaattgcattctgttttgagttctcataaaagaacaaaggtcttctgtttttttttctctttgttaatctctttgccgttttgcaggcaaagttggttgttttcatccctttttccatcttcgtctaattcaggtagagcccttgcttattttcttagaaaacatggtaatatggtgcttcggattgtatcttcacatctttagaataaaagccagcgtttgtttcttgcgataattgaatccatgtcattacaactttacctaattaaaaaatatcaccactgttcatgatatcgattgggtgccatcaatattttttgaaatttga

SEQ ID NO: 100128 - DNA, 651 bp, Oryza sativa
aactctttataaacacacgtaaataaattagctctataatctttgaaaataaaatttacaacatattatatgtttacctagtaaatcaataagatagtttccacttaaatcggtgtactcattactttgtactattattttcaaataatgcactattttaaaataaaatttacataattatattgtgtacctattaaataaactatttaagatctatattaactaatatatagatgcacttaaacagataaatccattatttaaatcattggatctatttttttaattactttggactattattctcaaataataaattgttttaaaataaaatctacaccattatattgtgtacccattaaattaacaatttaaaatatatattaactaatttacatttacactagaaccagtggacccattatttaaatcatcggatctattgttaataactaaagtgtctaaagttctctttttggcccgctgcataatgcacgtctacacctttgcctttcggacgtgtgacagaatgtcatgtctgaggcatctcaggtgatcacgaccattgtagtgctaccgattttgttaataacatgaaaagaaaattaaaggtgtgatgccgtgagagaagaattaagcaccgtgggaaca

SEQ ID NO: 100129 - DNA, 618 bp, Oryza sativa
tttgtgaaattgactatatttttttttcagtttctggactacatttggaaggaggctttctttgggagcaaataagtttattgatagaaataaattcaccctatacttcttacttttttccttaaatccttcccatacataaagtagatttagcatctatctctttcatgcgttacacacttttcatcaaattgtggagcgaaattatctttggaagtatttgtcctatatctcttttctctccataaatcttgcaaaacggttggatttatttttatctctctcgcacacagatagacttttcaataattctagtagtctaactttggaagttaagcatctttagcagcacttaacttcattagcacactaactgtttccataaattttgggcatgtgagatcttttcaaaagttgacttttaatgaagaagctgatcacttccccacttttcctgtctttcatgtcgtcctatataaaggcacaacttaagctgtcatctatcaccaattcatagcttccaacattttcatttcattcgtaatcaggttttccacagggagatggcaatgaaggtgtatgggctgccaatgtcgaccaatgtagcccgcgtactgg

SEQ ID NO: 100130 - DNA, 533 bp, Oryza sativa
gtacaactccaggacaccttgtgcaacacagcagcctggtcctcggggccctggaagatcaagctcaagacttttccaccccaaagtaatagtggtgctttattaataaaaacatagcagaaggtgcaatttatttagaagacactagccccaggctgttctgagttcataacatttacacacacacgctacagaaagtcagatcgctaacggaaatagtgaagctgactcacagcatcagtttaaatgtgatcacaataggatattatttttaaatgaaacaatttttttccagctttattaaagtaggattggccaataaacattgtatatatttatggcatccaacgtgatgttttgatatgtgtacacactatgaaatgattaccacactcaagctgattaacccatccaccacctcacacagtcaccttttttgtgtgtggtgagaacaccgagttctactctcggcaaatttcgagtacacaagtcgttcttaccagctgttgtcaccatgctgtacattagagccc

SEQ ID NO: 100131 - DNA, 533 bp, Oryza sativa
atagagcaccgtcgatctgtggctgccgggctcacgatcaattgggcaaaaagaattttcgtttcggtttaataaaatttggagtggactattaggctattattattattaaggaatagttgaatagatgtgtagtgtaacgtttcagaatcaaaatgaatgtaattcgactaatcttgctgaaggtcaaaaccgtgcaaacctatgcatacatattttggtacacacgtacagtcatgtggcgcaaaaatgtttatccaaagtttcaaactatctctcgtcaaatttagaagatgtatttcaagagcaatatcttaatgtgatattttcactatggtgttttaacacaaagaaagaatatatgaatagtaataaatcattttcacctttacaagaacatttagccttctcgttaagatgaacttcccgtctgttatgataaatataattcgtttcctgctgctgttcccatatagatacagggtttcgccggtaatcatttccttgatttcattcagagcagcgggcaaatt

SEQ ID NO: 100132 - DNA, 621 bp, Oryza sativa
ggctgggccgaccgtaaaatcggagggtcgtggtggctattgggctgccacgtaagtacccttctgttacaagaggaaggaactagtccacattgcgtcctcctctttccgtcgagtttaatcggcaactctaaaccgcaatacgagaaatcttcaccccctaacttattaaaatcgttaaaatcagatcctccggcagtatagatggctgttttttttatgactagacgtttacgtggggaaaaaatgagccccacgtgtcatcctcactctactcctccccctttcttctccatctcttatccccttttctctccaactctcgagaggagcaagcagcgcgcaggtgcagcttggagagctgatggatagtgcagttgaggagcgacctaacatggggggtggtgtgcccgcctacgtgtggaccacgatgcccagtgaggggtggggatcgaaggtgagggcgaaaggcgggcggtggggaaggcagccggcgagctcacctaacctttgttaggggcgagtccttggcggggaggtgggacacgatgtcatgcaagtgcacatcggggaggcttgtgatgcgggttaaacttgcacgggtcgctttcaatgcatagg

SEQ ID NO: 100133 - DNA, 737 bp, Oryza sativa
accgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggcccctgaattgtcaggtaataaccctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatc

SEQ ID NO: 100134 - DNA, 558 bp, Oryza sativa
tgtgatgtaacacatcgcattgtttgatgtactctgtctccaacaaacaataattttgaagtaatcctataatttggcaggaataacaactaggctttacttctaagttcttagtatttcacttctcctgtttgagaaattttggaacctgagctggtttcgtggtgcatacactccctccatcccaaaatataacaacttctagccttcaatatttgtcccaaatataacaacttctccacctacattctcttctcaaccagccacaatcttccaccattcaaattctctacctacctcctcttctcaaccaatcacagccttctcccatttagttccactttcataataaccgagtccaacgtactccttatattttgggacgtaggtagtaactaagtttccatgtagacagtaattcagtttcttttcaccatatttggtcatttgttgtcttgagtcttgacattgaatttcccctcagatgtatacgtagatgtgccagatataattgatatctcgcacatgcgcagcaaaggcatacagcctggtgaagag

SEQ ID NO: 100135 - DNA, 586 bp, Oryza sativa
tcctcactaagatccttgaccgcactaggccaccgccgcccctagggccgcagttaccgaagctgaggaggtcttctacccggactcgcaggccgctatcgcccctagggtcgctactgcctacgaaaccacctttaccggattcgccttcttcttgccgaggactattcgtcgacgcttaggacgccgccatcctccgccgcacccttcgctgtcgtgctccgcagcacctgccacccaaagagacatcgtcgccaacgtcttgctgctacctgccgcagcgccgccctcctgaccttctccgctgcaacgcgtggcccaccgccgcccatggccccgctgactacaaccatatgttattacatggggaaaattcagacatgctagtcatacgcacacagataccccgtatcttagaatgccacgagagatgtattttgtttcgaacgtaaagggggccatttgccggtacatttccatatttcacaatcaatggagctccggcgaaaagtcccgttgggcttttctcctatggggaatggaaagttgtaaacctaatatcttttacaagtcatatacagctcaa

SEQ ID NO: 100136 - DNA, 1058 bp, Oryza sativa
cggtcgattatcatttccatatggctcggccggtagaaagtcgaaaacgaacgcttgtcggccggtaattaccgttaccgttttcacccctacttctaacacttcactaagagttacaccttcttaattcattttgtaccttgtatgtgcacccaacatgatgcgttccccctagttgcctcctcgctttctcttctagtactgcatcaaaacaaaattgtgaaaaaaaacataactatagccactgatgtcaaattggaaaaaattgcttcctataggcatgtaactgtaaatgtctaaaaagttactgtcctatttcatggtatttacttccaaaactgcactgacttacttccaaaaattgacttacttccaaaaattgcactgacttactttccaaaatgcactgacttaattccaaaattacactgacttactcccaaactacactgacttactcccaaactacactgacttacttccaaaaaaaaggtattgtactgtaagttacttctagaacatgctaagttatttttgacaacagatgaagttacttctagaacatgttaagttacttctaggaaaatacagataaaagtcatatgattcaatcctttagcaaaaaaaaagtctagtgcattaaaaaaaggcaaaaacacttccacttggattttacaagttttctaacatgtagtgcaattgtatggggacatagtcatactccttctgaagcaaaccaaaacttcattcaatactggattgcaacatcataaatctggattgatttcgaaaaactggttgcatttcatacttctaccataaaaaggattatgggtacatagaacaaggatagacatgcaatctcacataatgtgacaggaattagttaaccaaattttattcaatactggatcattctgatttactaaccatccggttataactataggtagtacacatgtccaagtccatattcaacatcaaaataccgtttcaaaaaaagtaagtgttaagttactttttatggaatattaagttacttctaaaactagttaagt

SEQ ID NO: 100137 - DNA, 2499 bp, Oryza sativa
ataaagtgtatatgcatgcaaatctataccttggaaaggcacgcaaacagcttcttttgcttggtttttctcagcttggaagcaacaggtagctaagctagagacaggaaagaaagccaagatgggagtgaaaggttgtgtttgtgatgttgcacacaagagaaaggagatgatgtagtttgtgttatataaaggagagcttgggggagaccagcagagatagctagggtttgggaacttgagatgatctgatttgagatgctcacccaaaggacatgacatggggttatataaagtagtactatggcatgtagggagagtgatggagattagctgttgtgaataatgatttgatttgtgcatggtcagtcagtgacagtgtgtttgcattggtcatggccggttttggaaggactaaaggaaaggaggagcgttgtctttggaccaggggacgcaccggccacaaaaatggcctcataaggagcaatgacatgtctccatctgcaaatagtgatgatctttttttgcatatatgccctctctagagatcattaattgctacgtgcaatgtagtatatattttcttgaagcttaatttgttttattgtgcgtgacaactgacagagagctagccaaataggtttggatttattccttgaaaggagaagacgttaggttctatatgatatgatggtccatgcgcatgcatgtgtaaagttttatatatagttcataaataaactaaaacaactttagatcatcctttgaccagccttgtgggagtcagggaattaagccctgcattccattattccatattccatttctattctctcttctattccctacatgttgttcattatctattcctaaaggctactagtaatttgttattgtttcaagtgaggattcaacttttgcattggttatcactcataataatttacttatcccaagtagagatcttgtgatggttcaaacattgcggttagcgcgcgtgtgatacgatctgaaattatattcaaacctgatatttgacttcttgtgaattaaatggggggtcatgtgacaattaaaaacccattttaatttgtcatccgttgaatgataaatgccacatcgattttttaagtacaattggatacatataaatatgtaaataaatgcaccgtattatagctactacacacactcatacacatcgattctctacacatgcctgaatattgtcataggcatcaaaatgcatggaaaaaaatttagcatttgaaccctcgtgagttggttgaagatacctcaaaattaacctagccattaagctagcttaattccaacaaatgccacacatcatattcggtttctaactaagtgtgtactgcttaattggtttgtgttgccagatattaactattttctcatatgaggtgttttacaatgatctctagtggtagtagaaataaatctataccatttatcttttctaatctaatggatcatatctaattatactttcatctcaattattggtaatagaatttcttttttatttacatatagtaagaatgttgaagtcacttctactagctataatacccatagagaccacccttggtactctttccctatatattttggctataagtttatctttggaagagcttttatggtagcctaactactactacctccgtcccaaaatataacaacttttatttatgaatctagacacatagttgtctagcatttatagctaaaatacttatatttgagacggatggagtagctagtatagtagaataaaatgatcttaattgattgttgatttataaattgtacgtactataccagtagttggggtagcataggagtactatatattatactccggtgctctctatttatagtattatatcactagtacgtattattaggggtaaattagtaatttactaatacaatgattaagaattactttgtcatttatgttttttcctagctaaatcgatatatcatccattgcgctagcatcactcgtatttcatcgaaaaagccaaaaaaaggaaaaaaaaaagtttagtcactgctaaatgacaattatatctccccacacctttttttttacaataatatccctccatgtctctactaccgctaactagatggtagtataaatagatttaaactcttcgatcaaatgatcaatggtttatattgttttctactagtagagagcaccgtagtgaggctaatattagtatggtttattagataacaaataacgaaaactctaggtgaattcattcaacaatcaataaaaatcatcctaaaatttctattctgactgtgtttagaatacaatttcctgattagattgaaaagtttgaatgaacattaatcaaattagatttggacgtatattttcaatcggagcagaaaaaaaattaaaacatatgggttcgatcgatcagctatcacccttggatgatcaagctagcattg

SEQ ID NO: 100138 - DNA, 1456 bp, Oryza sativa
ggttgtaatctgccagccaatccttttcttccttttaagaaaagaaattttggttcactggttggtaacacagcacaatcgtttctttttcagttggtgttgtatcgcatttaaattgaccaccatacgacctttgcttatgtagtcttgtgttcatcatccatctacctggagtatgttctaagctctaacagtttatgacagtgacacattgttaaattgctatgcacaatgacaacgcattttaggttttctttggagcaaatgggatatattttattgatccatactgaattgaattatttcatgagaaatcccccgcattctagatacaatcttatcactaaaccgatcaaactaccgtacttaagtattgatacacaacggtaagaaaaaagaagtattgaagggaaaaaaaactgtaaaatgatgaggagcaatctgcgcagtgattaagggaaaatgacggccaaatcgaatgcaacccaaccatgactttgtctattaaatttcctgcttggatgaacatattcggcaacacgtgccattttgggcagaactggtgtcaaaagttgttctgttggtatgcactgaagttttttgcgtgcggatttgcgatgctaaaagttgtcactaccatggttttgctgtcaattctatacttcgttagctaaagaggtgcatcatgatagatctcattaggtgcaattgctgatggaaaattttagtgtggaccaaccgattattactcaattgagttaaagccagaggtattactctgattaaaaaccagaacaagtgcttgcaacttataatactctagctggataaaaccaagtttctcagaacgaacttctaacaacttacaaataacacgatgattataaattaactcctatcaatttggacacaagcatgcccccactgcattttggcaagaaaaatgcggtcacacttatttgattattctacctatttataatgtcggatataggaattctttcgagcctagatgaaactcgttacaatataccaccataccattttatacaatgatgtaatattttcatctcttatgccagtgaattaggacaatcggccagtattatttaaacttttaagatcgaaaatgtatgacataaataatatactagaaaaaaaaatatgccggtccaatatttcggagataatcataaggatatgatgtacgtgtgtatgtttatagtggtgaatgtgcacgtgttataagcgcatacgtttatactgtgtttctataataaaagtagaaatacgaaaacatgagttcacccaatccagagcttccaacctcatatacaggccgagtttagttccaaaattattatttaaacttctaacttttccatcacatgaaaactttcctatacacataaagcttttccgtcacatcgttctaatttcagccaaacttctaatt

SEQ ID NO: 100139 - DNA, 705 bp, Oryza sativa
gccacgtcatccctttgattctcccatggctcccatgcgattgtgtgcagcagtactcccatggctctaccacacaatccccaccgcacgtcagctagggaaagcgacggtctggagtgccgcctcactcctcttcctctccctttgttgccacacctcctggaaaccgtcgacacccaccaacaagtagttttcgtggctgccatgaagacattaactctgtgcgcctgtaacgtcgtgccaaaatcatcatcgtcctttacttattaccggtgaaacgcatctaaaatccacacaaactccatgccttttaatcgatgttggactcctagagccattcaaaggcttccccaatgttagccttggagtgggagagtttggttgttttgggagtcatcctttctacggaatgacggttgaaattgattactcatgtcctcgataactgctgtattcgtttgagaacttcagctgccttatcgttagattaagtcaatccgtgctagcactggacataagctttattgccttcttgatttgaggtaggtaatttaatttttcatatttattcattctttgttttgatcgttggttggctcagattgacctttatttcaccagtgattgaagaggttcaacattttccagtgattgaagctctggtgacttttgggaggtcagcctcttttttttctagctcataca

SEQ ID NO: 100140 - DNA, 1811 bp, Oryza sativa
tccaacagagcgcaagggctccccaatcgtaatggggttttctgaggactataatgtgattttcctaaagacaattaatggtctcttcatggtccatcttgagtctatggagttcaagagaattttgaaagactgtgctgcccttttcatttatccatttgcaagtgtttacactgcaggtaatggcatgatttacatttcatagttggttgatgtttgcctttcatatccttgagtactagagtagcaatttggacttctaattattttgtcgatgtatgcatgaatatcctcgattgctaaagtagcaatgtaaactagggtagtatcactctcttgttttgctgcttgatgaactcttcaatatattttgatgtttttctttttgttattgttgtttctgtagcagttgaagtatatatacagattgaaaatatgagtacagcatttctttttggtactgatagaacttaattattttgatctctatgaaagtcaagttcaagccaaccgaaatgcaaatgtgtactcaagtggctcattttagtgcttaaatagtgccatttcactgaatacctttatctttactgatcttgctaataatctgaaaaccataataacaccttggtttggtctttttatgaaacaacagttcgttatgtcattggcaaaaaagtcgcgctgcaagttgtgagtccaactgtacgggatagtagataaataaataaactaagttcttttttcattttcaaactaaatctcattctcatagttgccccctaatatttaattgttttctccatgaatctgagtctttttttttacttttaaacgtttgtaggcatgagcattggtgatggacatgatgaagatggacagtctccagctatgctagtttataatccccttaaccccacattttccattgcacatcttctattttgtccgtatcaaataaatcctctatacccatttgtggctagattgggccatgggctagttgtcaggggtttatcggtcacattaatattttaatatagaaactggtttttcttggtaactatctgctactccattgcaaatattcgtgagtgcagggagtaaaaatacctgaacatgacttcaaatttcaaacacacctttatttgtacaaccttgtggctatgacattttatatttctgtttttttttgtatttattattatgcataaaccacctagctagcaaagtaccaactggtgtagtactcgaagataatgcctcttcaatcatatgctattactgatcttagcagttgcaatgactgtatttttttgaatttattctagtgttttcagcagtttccttgaatatttctacagcatatttttctcttttctcagttacatgtgtgattgatcattagcctctgctactctggtatagttttcctggtccaaaaaatatgctgtgacagtctacttgaggttaattagtttcttttttcttcttgggaaaatttcatctataccacaaagatttcaccagcaccaaataataccacaagattcttgcacctccactcaataccacattgcagcaatgtctcttccaaaaatgatacagatttcaatggatgttacccaatcttggacaaactaatttgtccccgttaccagtgtttgagaagatcactgagctacccttatgaagtgtggaactacattgggagttctccaatctccatagtggccgcagcagcagcataatacagaagatgtatttggtaccagctagtggagctcatcatccagaaccttgctcaggcatgt

SEQ ID NO: 100141 - DNA, 539 bp, Oryza sativa
cccggtccgccgtggaccgcccccgagtcactgccatgtggggcccgcatgtcggcgccgccctctctctccccgggatttatttatcgcgcaataattcaattaaggatttttccgtttatagtaaaaacatagtgaatcttctaaaattcataactaattcatccgagctccgtttaagcccattcaagtctcagtaaatcaagaaaaatgtgtagaacccactaaaaatggttttgttctctgtttcagtagtcttatagcctgtttgtattgtttgctttgtatgtcgcttagattccggctctcccgacgctccggtataccttgaaatagtcgccaaagttcctccagctgcagagcaaggcaagtcatgcttgtctcttgaacatgttgatcctatattgcaaatgctccattgttttccttcaaatactgcattgttttataatatcactatgggatgctcttacctactgtcatagccatgctatcttgtaccatgtttcctttgttagcttgggatataacatgactag

SEQ ID NO: 100142 - DNA, 503 bp, Oryza sativa
acgcaatccctatataccgtcggactgccgccatctccctccccaccactggatacgccgccgccaccctccccaccctcggatccactgtcgtcatcctccccatcgcccgattttccaccgccgctgccattcccaccattggttagggactaaggcagtggatggtcctgctccatctccatctctcggactcctcccgccggcatcggttttgctggtgtgggccggtttcagcgtggatggcatccaaagccttgtggctgccttcggagttgggtgacatgaagctcacccgctgccacaggagttgggcggcttgggttgcgtgtggcgtgagcgaatctggcggtggtggtgtgctaattgttgcggtggcgaggtctcggggatggcggcaggacggcgatgttatgattccaattttataaaactctagtggcactcagtagatattatgaatagtaatatcgctttctagtttggcacatacataactttat

SEQ ID NO: 100143 - DNA, 520 bp, Oryza sativa
tgaaactcccatgcatcttcctttctcttgccaaacaggcggtttggggaagttttttatcaaatccgtgaagaaattactaaaagggattacagaaacttacggtcggtgggttacaaggattgtacatgcaccggtattaaggtgcaatcatatgggagcatgccccaaccacacaatctcctctactacgcgcagagggcgacgccgggcgccctgcttattgcagatgccatcgcagcctactacgctgcgttgggacgatccaaggactactctgcgaacggtccaattcaccgccagcttacaggtccccctggctttctttttggtacgaacttaacagactataattcagctacacatggtgtcaaatcaactgaaataagggtaaatgacctgaataaccttattaaattgtggctcatgtcacgcctaaacgataactggaatgctggtggtgctgaacaaagccactacacgctatcgtcgtgcctatacgcgcctggattttggaaac

SEQ ID NO: 100144 - DNA, 590 bp, Oryza sativa
tcatctctcttttccttcatccacctacaccccaagcttccaaaagaccatcgccacagttgcccaaccttcccttacactagctcggctccaccattctgcgacaagtactggacattctgttgaacacctaattggcatccaggagcatgcagtcctattttttctccaccgccactgtgatcggccacatttcgcccctgcttcaccatggtaaaataactctctcctttagaatccccttcattccctacatttcattattcatgtttcctcgaccgattgcaccatctagaaccatcaccaccctggagcccttcgctcgtgtcgcttcctccctagagcgacacaagaagcgaccgaaaaacaccgccgccgcttctccttcttcctcctcccaccttgccgctgctcgagtggcacgtcggcaaagtcggccgaccatgaggatggcggcatcagggctttcccctctctctcaaggaaggatgaagaggtgatgccgcctagatccaggccctgctcgtcctgatccggcgaggagcggtgagagggcccccatcagatgatttggatggtggccaaggcat

SEQ ID NO: 100145 - DNA, 851 bp, Oryza sativa
acatttacaaaaataattttttggaatctaaaccctatactttacttcaaaaccagaaaaaaaacaacctgtacaatattcccccacaaaagtgtgaaccgttttctactgtctcattgcttatgcactacctgtttctggcaactgccaatgtaatgttggatacttcactacttcagcgaggaatatacttttttttcgccttctctgttatccttatcagtcgtaggtaaaatttaaatttgaaaaattaattttttagagctgatcattgtaagagggtttgtttatttttcaacatatattggcttctgaatatgaataatacatgtataaaagttttactcataaatttttttattacttcatccattactaagccatggatcaaccaattagagacgatgatcttctttttattccttgtcttcgtcctatgtcttctttgtgtgagagaggggagaaggaatttgaaagtgctagcattatattgttccttcccaacaaattatatattctccctcagctcagtctctcctctctcctctctagattaattagcagtcccagtggcactacataaccagtactatatatacaataaccttgtgaacaggtttgcatatactccctccgtttctaaatatttgataccgttgactttttagcacatgtttgacattcgtcttattcaaaaacttttgtgatatatgtaaaactatatgtatgcatataagtatatttaacaatgaatcaaatgataggaaaagaattaataaatacttaaaacttttgaataagacgaacggtcaaacatgtttaaaaaagtcaacggcgtcaaatatttagaa

SEQ ID NO: 100146 - DNA, 905 bp, Oryza sativa
gtgattcactgagattttacaatttgtgattcactgagatgtataactttgtgatatgttgtatggatctgagatgtataatatgtgatgtatttggtttgtgtataatttttttaagatttgtgatgtatttgatttgtgtgtacaagtaacttaagatttgtgatgtgaatgttttgggatgttgggtttgatttggaatatgcatcccacttgatttgggagaaaatacagggattaaactctggctaaaaaaaacaatgaaaaaaaaagaaaaggagacctaatgggactgccgctaccctctcttaggtatctttagtcccggttatttcaatcgggactaaatatggacatctttagttccgcattgctagtctcggttggaaaaccgggactaaagtagtcccggattgctagtcccggttgaaaaaccgggattaaaaagattggaatcgggactaaagaggggttaccaaccgagagtataaatggtttctccacccgtgcatgcaagcagcaggtggtggactccacgtcttcacctccgttctgcattgccatcttcgatcttccttgggatcgatctagtaaatcgacagctctaattaattaaaaagtttatagtaagaataatgtcaagcaactctgtggtcaacatcagtcaccagcgcggcggtacaggtcatcgaaaccctcatcagcttcatctggcagtttgactttgtcagtttcatcaatggagaacatctcgcatgatgctaggattgaaaagaggagggagtcacgggtactttattttatggtttcttagggagattgttaattttgggttaagcttgattgattttgtgcaaaattagctattgctccgttgcgattgctgcgttagttataggtataag

SEQ ID NO: 100147 - DNA, 613 bp, Oryza sativa
atacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacactccaaaacaagttcgagaatccgaaaatgcattttgagagtttcgggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagttggttggagggaaaaatagtactgc

SEQ ID NO: 100148 - DNA, 713 bp, Oryza sativa
agtcaatcatggcttgtttcacctcctcgtcagtctctccaagaccaagcatgatagaggacttagttatcataccctctttgcaactttttgcatgcttcagaacagctaagctctgatcatatctgtaagaatgaggtaagaaaaattcttacaatgccagaggatatgaggaaaagaactgtgcatagtacaagttattaactgcacattgccacgagatactagaaatatagtgtatgcgcaaaatcgaggataaactggataaactatatcctaccactatacttccttcgaacagattctaagggaaaggtagttgatcaggcaaaataaatcatctcccaagattatgatgcgagaaacgttcagaaataaataagagtaccacaactcaccaatcaaacagattgcaaagctttgatatttgcaaaactattgttatgtctcatacaataaatacagcaaggaatatgcaggtcatcagatagaaaatatctatggctgtttttattttgcaatgttacagtctacaatatagtttacacttcagagacaacaatttgcaacctatatataagcactattacactgtaaagtatgcatagctcaataataattagattcatttttactcggggcgaatttaagattaatcacttaaactaagacacaccaatagcctgagaatgatcatatagtcaagctgtaag

SEQ ID NO: 100149 - DNA, 1809 bp, Oryza sativa
tgtgttgcttaaggaacatttgatttattgaattacatgctgcatatacatgcatgcacatacatgctccccccctatctgcagcctctgttctctgaatgtacgtcgatctctgcagatcgatgttgatctattcaatccatgttggttgttacgacttgaaacctatgtagctacccatatttacactgtgtatgaaagcatggaaacctagagctatcaaagggcacacaaaacccctggtaaaaaaatggcagcacaagtacacaaaaaacctctgttctctgaatgtacacaaataacataactgaatattagcatctacaattagcaacatggtaactgaagaaaaatcacactgggtttacattgtaaatgaagcatggaaccctaaaaaagctatcaaaggggcacaaagaaatcctagtataatggcaccaagttttcattatgctgaggctacaacatgaaatctgactcatggcctgtgcaagcaaatgtgcaaatgccaaaatagagaaaaaaaatagaaataccttcaaattgagcaagagatccaccaccacttgtgctctctgagaggatgcagagagggcgcagcaaaagagagcccgagatccaccaccagcactagcccctggatgaggaagagagagggggaaatgaggggatagagctagagaaaaaacaaatgccccaatcgcacactgatttgcgcagttaaaatgcccaaatctctccacctctcccggcacaaaaaacgcacacaaatcgctccacctctccacctctaccggcaaaaaacacacacaataatcgctcccccctccacctctgctggcataaaaatcacacacaaaaatggatcgctcctctctctccggcgcaaaaaaccacaaccacctctgcacgccgcagcttaccgccggatttggtggagaggaaaccgcagcctctgtttccctccccccctcccccacaactaccggcacgatgagagaaaacgtcgcctcaaccgcggattccgccgcctccgccgttgattccaccgttggcgcgacaggacgaaacagccgtaaccttcccccctcccaaaccgcccccgcggctacgtctccggcagggatttggccggagattctcgccgcctccgctctctccctctctccgccgctctctctctcgagcgccacaggaatttttgaacagtgccaactctctctctctcggtcggaaaaagtgcgactcgcggtcgggacaagccgacccgcggtcaggacgcgcacgcgtgccggatgaaggccacgtcgcccgcgcgccgatcgacggctccacgcgcgtcgcgcgatagcgctaaacggagaggcctctccgtttagattatacgatttaatttatgaaaaggtataaaagtaaaatattgaataataaatatatggaattaaataaaagatttaatatcttagatcccgtatttatgagatagatcccatatctagacgagcgaaaaagggaaaatacgaggcagaaagagtttgagaacgaacccaagctgagcagcagcagcttcagacgcatgtgactgttagtatgtgacgatgacgtcacggccccttgctttttccagcttccaaggcccaaggggtcgcttgccgtgccgtaatatccatccatcggattccaacggccacgattacacgtgcgccaccgcctccccccctctcttcgtcacctcaccccccaacccgaccaacaaaaataaaaacgacgaaaagaaaaaaaaaaaaagatcgcgcacacgaccccccc

SEQ ID NO: 100150 - DNA, 1308 bp, Oryza sativa
tcctttcccggctccggctaccaccgccgccgccgcctctccctcccctagctccgacaactgccacccctccctcccatggctccggccaccgcagccgctcgctccaccggatgcagctaccaccaccactgcccctccccttcctagctccggccaccgcagttactccgttccctagctccggccaccgatcgacgcccctcctttcttcgttgatgtatcccccaccggcggctcggacgcgacgcaccgctgcctcgacacgacacagacgaggtcctcgacgtcgcaggggctcaccgtgtagggctcgtcgccggtggccgcgtcctcctctcgccgagcaggtctttttccccaaccgtgccgaaggtcctcacagacaggcgacagcaacctcctccttacggctcaggcgctcagctctcgcttctctttggataggcaagaaggacgaaggatcccatgccgacaggatccccgtatgtagcattcccgaaaaaaaatcgcataggagaacactaaacatatggtagaagatggattttatcggtcttacggatctatatttggattatagccaccagatatctctatctctattgttataaaaattgaaaatgtttttaccggtattttggtacatcattcgtatttgagtcgggttttaaattttgttcgcttttggaaataaaaatccgtgtttgagtcagattttaagtttgtttgcttttaaaactacagaaggagtcgtatgagaaatctctttagaaaaactcgcatgctaacttgagatgaaagtcagacttctaattgcagctcatgattttttttaaaaaaatatccaagcgaattcctaaagtgaatttcatcctagataaaccgtataacaataacatgattaaaatagcattcacccgttgcaacacacgagcatcttttctagtaaatataaaagtatagtagataagaacggaacggaaaacccttcaacggaaatagaagatgttggactttgatccaagaaagacagtgtcttatctacccgtatctcacaagggctgctcgtggtttacttggacaagttatctctacccacatataaatactccaaacttctcccgcgcctcaaaagcacttcaccatcgcccctcaaaagcaccttgccatcaccacctctacaagcaatcccccctgcccaacacgtcatgcagcgcaaaatagagttagatctggcatacctgttgttgacctcatcctctctctcctctctgattcctccttcaaacatgctgccctaggcat

SEQ ID NO: 100151 - DNA, 649 bp, Oryza sativa
agtcgagctttaatgagcccagctgacttattgccttttgaaattctatgtatatttcttcgtttcatgtgtaggccacacaattttggagtcgcagacacgtgcacttctttcatttgagatttatagaaaatgagatttagctactcaggacaatctgtttttcacaattacatgaaaaacagacaggcgcatacaccaccacacacgcaccaccgcctcaatatcctcagatatgttcttgtcacctttgacaagaggttctgctcttcccttaaatcacatgcaagtgtttgcaatcgtaatgcagtgtgaagttcgtttacttcagaaatgtaaagaaaatttcttgcctgatatgttcccattattttcatcaagatgatgcaactaaggaaacactgaatctgaatggtgcggactgcaaagacttacatttagtagacagcaaaacttactaccagagtgcctatagaagcttcagaaggaaataataatgtttcctacagctgggtatgattgcgatgtcactgattatgaagttgaagttgagtcacccgactgatcacatctcacactgatcaatcttgctcttgaccagctggaaagctggattcacccaggctccgcagctgcactgcattcctgc

SEQ ID NO: 100152 - DNA, 914 bp, Oryza sativa
agcaactaaccaataagctcggataccatattagactagagatatggtgcacactgatgcatagtatttgatgaaaatagtttgtggaatgtatcagcccaggctatcaaccggcctaccagctctgagagtttgatgaacacataaaaaaatgaagaaatatagggaagtgctttgagcatatatttttaccattgtaacatacccaccaaaaattttatgggctcacgatgccataaaaaaaaccttgtaatatcttaaattctgaaaagaaaactatttaagtaaaaggttctaagtgtctagaagtgaaataaaagaatttcatgacatcacactaagtgatggatgatgagtcaaatcatggaaaggtctctatccaccaaaaaataaatgtttacccccagcactgcatagtaatttagaagagaaaaataagcaaattaacaaaagcagcaaaacaaaggggctacccaagacagaaaacttccacaagagacaggaggctctcaacagcaagacttcaggaagacaataaatggttaaatgatgtatcagcctttgtacattcgaccagtcactgccttcagtggtgtcattgaggacatgacagcaataacagacgaaaataagggtgatgataagggacaagcagtagcagaggtggctcaaaaaatggcagaccaccaccactgaattaaaatgagcaccccagaaactacgatggggcagggtaaggtgaatgggatgaatgcttggtcacaggtagtgctggcccatctaatcccagcacaagaacgatcatgggccctctatgcagttaaggtcagtttttctgattcccccttgcagaactgacagtcagacaacctgaggtcactagcgatattaatttttagaagtctttgacataa

SEQ ID NO: 100153 - DNA, 565 bp, Oryza sativa
cttgaactgtactgtgcccactttattcttttggttacagggaattgttgcactccctgcgtaatccatcaagtagccccaattttagtttcccattggcaagtttattaaataattgaacgggactaattaagaaacacactgaagaacatcatgaaaaatatcattttaaaaaaacattaatttgatcgcagatgcagccgcagcaaaagcaaccttagccgaagccttcgtattaacatcacaaaaaaacattaattcgtatttcctcctccacattgttgattgatttaatgctgaaaccttcggctgatatcacttgttataaaacctgtccggttagcatatcggaaactaaacacgaaaggaacgactactgccttgctccaaacatgtggtcactggtcagaggtcccaccatccccgaaagttgcctcctcttgcaagatggaaaaaaaaaacctattaccagctaattgttgtgcttcgataatcccagagcaatgccaatataatactaactgcgccatccatcaaaacttcaggaaagagctcagaacttgct

SEQ ID NO: 100154 - DNA, 716 bp, Oryza sativa
atacaacatctggttccatagtgtagtggttagcactccagactttgaatctggcaacctgggttcgaatcccggtgggacctcttttttggtattgccatagtcctcaaatgggatctatatagccaattgcttgcagggcgaatacatgattcatgcgttgttatacatataatagttttgttcaccatgtttttgtttaatgcggtgcatcaacatgtggcatatctggccactttaatggtatcagaacctattgatcatttgatcttctcagtatctcaacttctccaaacagcaacctttagtgacaaaccttccatcaacaccattaccatcaccaataaatcagacattggtactcttggccttcaacaagctattttccagttaagagttgtggtttcatgctagatggtaatgacaattttgggtgaacataggcttttaaactcatgattgcagatggaggcaaagaaggatagggagaataagagaaattagtcaatacactataataccatggaagcagaaaaccatggctgacactaacacacagcatttgataaaatatgcatggaatacataaaaacacagtctaagggcctgtttgggggagctttagattctgagaagcagctgtttggtagccagcttctgagaatctggaaaagctctgaaacccagcttctccagcttctgacttcttagttcat

SEQ ID NO: 100155 - DNA, 721 bp, Oryza sativa
ggatcccccagtttttgacgctacccaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccaacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatatgaactttttttatgattagtattttcattattgttagatgataaaatatgaataataatttatgcatgacctacctatttaaatttcttcaaataagacgaacggtcaaatgttaaatactagaacccagaaaattgagttcttttttgggacgaagggagtatccgctaatcgttggccaccagtgttcgagagagatagggatactgacactgactg

SEQ ID NO: 100156 - DNA, 704 bp, Oryza sativa
agtggatcccccagattttaaaagaatagacaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgctgcttaccctacag

SEQ ID NO: 100157 - DNA, 569 bp, Oryza sativa
ttttttaatcagagaaagggcaacaactgctgatgaaatagcaatggtaacacagaattatccatcatgatgattttgcgagaactagatagtaaaattaataacctaaggaacatgaatatgagattagaatgcataaagtagcaaataggttcatcaattttttttatctcacatcacagagctggaggattgccaaacctcctcctgagtgctgacatgacgctcctcatcctactacttgcctgggcagatgattgtgcattgctggcgttagtcgggagatccatggctgccatctgatcagtaagctctgtaatttgcacctgtccagcctcttgcccgccattttcaattgcacctccagcatcacgctccaatacaatatccaagctgatagagaatgagccacccctaaccaccttcaggttctcaatacattcatacgatacgccccggcatctcttcaatttcaccttgaccaagctggggcagcccccattcagtgcccacatcccacggtctgagactgggcaaccttgatggaagcttcttaaaacagcgcagcg

SEQ ID NO: 100158 - DNA, 704 bp, Oryza sativa
ttacatctgtgggttaatgcttcatgcttttaggattggacaattttaacacgtctgttaacttgatagattagttgatgacagaagtcagtagatgtcatagaaattttctataagggcatgatggatttcttcagtatgacatggaatttcataaattaggaatttgagctattacatatggtctaccactcttaccatgagtggatatcgtcttctgcatgtactttttaacacttggtatatccagggtgaatttttatgccgtggaagggcataacattcctcacaaactttgatatgaaataagcacatacaaagttacaaacaacaaacttgatatgaattgacaaatcaaatttttgagtctggaaaatgtaagcttaagaaaaagtattagttgtaatcctcagatgaagacaatgagggttaaaccacacagggatacaagcaataggagaaaaaggaaatgattttttaaaacataatgttgcaccagtgaataaccttaggagtcttttgcatcatggatgggctaggcaacacatattttccttcaccataggactttgggttattggatgttgttacaggggaacccttcctcccgctcgtttccatcatatccttctccagaagcaagtcagactttgaacttatggtgcctgctttagtaattctacattcatatagatgatttcagt

SEQ ID NO: 100159 - DNA, 671 bp, Oryza sativa
tttccccccacaatcttcatctgggtcattttgggaatctgattgggccgtcaattttcttgagatggaggggcacgtggtgctggtgttcatgaattgtgaactaactgattgcccactatcattattcccccttgagatatgaactttactaagttccaccaaaggagcttctctacagttctcagcaactgctgttgtagtcacgtgtgtaggatcttcaccaggtgtagaactgcaaggaagattctgagaaggcttgttaacagctgctcttgatgggtgtgtctcattagatttctcttcatgtgtatcagttgagagcaaatctactttattttggtccattcttgcagggctaaagctgaaaaaatcatgcataccgtcaaatgagttagaggaataatgtttgaagctgcacagttatcgttctttacattaccctaccttcccaaatgagtaggcctcagagtacaagcatcatgtgtttgcttttgttccttactaatgttacctcccagaacatcagagcccttaactgaaagaccttttcttggatccttgtcaccctctgaagagacagggttgaccttttctacaaatttactcagaccattctcctcaattcccaagttagcatcaagattgaacttgcccagccttcaagtaaa

SEQ ID NO: 100160 - DNA, 661 bp, Oryza sativa
aagtttcacctcttaataatgagacctttgctgtacttttatttagtccttgggaaaattgccattttgttgtcgattaattctgataccgtggatgtgttagacacgattggttttaaagggcactttctgagctggaaaagcaacgaattcccttggtagtcaatgatgtcctcttcgatgcttcgtcatggggggctggaaattttctttgcctttcttctgtgggtaactgggtactggatggtaatgaaagtaggcatccaaaggctccaagcagtacaattgagtttgggagagtatgagtcttgagaaacaatctagaagaagaaaaaaacttgtttctagcttctagtttattttctagagttcgtaaatataagggctcgtttggattaaaggataggaaaaccataggatctgaaaagtataggaatagagaaggaatttaagcgtaaaacagaataatgaaaaacaaaggagtacaaaagttgagggcatgcggatcacagtaagttgactgtctaggacttgcatgtaggaagcaaaaaaagagcttgtgatggatgattttttcctggacttttcctgtgaaaccagcaccaaggaaagggaattttttttggatagtagttcctccaaaaaaaatgggggatccact

SEQ ID NO: 100161 - DNA, 711 bp, Oryza sativa
ttttccatctcacagacgacgacgtcgacgacctgaacccagcagaaatcagttcagagatgcatactggtcgtcaggatttggagcagggcgcgagaaattacggagctgagggaggcgagagaccgtggcggtgacctcgccgtggtcacccatggtgggttgtctgcagggtggggagtgggactactagcagtggctaggcttcatatttgtggttgtcgtcgtggctatatcctccttctgcaaggcctcgtgctgcagtccagctaagttagcagccgcaccaccgctcgggcttgtgacgagggcgccgcgccgtgtggcggaaggcacgcgcgcggcagtgacaaactgacaacgacgagggcggcgcggcctggcgggaatcgcgaccggtcagtcggtcgcggtttcatggcctcctctcactgacaggggggagccaaggcctccgccgctgagctaggttgtgttcttcctcttattttctcaacccacatctctcgttttccgtgcgcatgctttgatttataaaaactttctatataaaagttattttaaaaaatcaaattaattcattttttttaaaaaaagttaatacttaattaatcatgcaataatatgaacctcttctcctgaacacagcattaatatattaagaaataaaccaaaacagtatattaagaaataaaaaatcatttataagca

SEQ ID NO: 100162 - DNA, 2386 bp, Oryza sativa
tggttagcttagttcttgtgatgcgatcctacaatttaaacaaagtttgacggatttcaattgatttaggccaaattcataaaaaaatccaaaaatgttggacgagatagttgcgtgcgtccgtgcgtgagtgcgtgtgggatggtggggattggaaaatttcaaaccatgattggccctgaatcagataagtaccaatgcgattgtgcgattggagagtgcatgattggcctatcgatgcaatgaggtactgatgttgcttttctaatgctgacagacggtatcccttcttcctataaagttatcacccactaagtgcaattaatctcctaaaacacaaaccacagtgctccacgtcatcattaattgacagccgttggatcacttgattacattgcatctcaaccgttggatgaaaaggcggttgagttcacatgacgtgatgcattcacaggacgtgtgaggcagcgaagaaggcccatgttagcgcagcaaaggaggcccacgtcagtgcattgcagcccgcggcctaatcagtggtttagggttcggtgtctcatcctcccaagctgacttctcaataggagcggcggcggcgtagtgcggcgaaccgcctggtgcggtgcggtcgcgcgtggctgttggtagggacagcgcgctgcgcggtgtggtgcggcgcggtcacgcggaggtgttggtagggacagggccacgacgaggtgtggtgcagcatccgttggcatcggtcgcgggaggttgcgacggcgatccatgcaccgatgcgccgatgtggagaaatatcgggagtgatccatgcagcaatgcgccgatggggaaaaacatcgggaaacctgacgccatctatggtgaaatcaaccgccccctccctcatcctcaaccggtagcagagacggtaatcgcttcctccttctcattcccctcccttaatcacgtgcatttgcattagaaaccaccaaaatcattatgggacaggaggcgatggttaatacaatttatgtgcctcttgcaatttctcttgataaatctcttccaaaccttttgataatcctattgcaatccccagcgcaaccaggcctctcctcaaacatgtgtctccgtcagatatcacccattcatctggaagcgtcagatccataccttcctcgacatcatcctttcattctgcaaacatctgtactacactgccaaatttttatgtaagcttctttactgaatttgtatgtctgaattgaattggttctttgctgtcagtactaattttagtttgtgaagaaaaaaagtgtgtgaatttattatatttaataagcctggatttgacatgaattttttccatattctatttgagcatacattgtgatttgaaccaagcaagatcagtatgaaggttttgtaaattggtttctccaaacctacagaaataatccctatcgtatgcactgattgttgttccagttatacttatatgttctatcacttcaatttatttgagcagttggggatgagccaaaggattgctacatagatgtcctcacatagcaagaagctcctaacctgcttggtatgtcttctattgagctcacccatgctattcatgttttctgtgtctttttgatacaagctattttggtggaaaccaagatggaagggttagctactactgtacaaactgttttgaaagacactgactttgagttgattctatgtcagcagcacccccattcaattccctgctaatcccttcaaaacattcagaggactgctgagaattgcgcaggcaattgaattgataagacttgaagatcctcaggttattcttcagccattattatgttatgatgctttttttgccgcataagtatgatgaaatgagaatcttatagaggcgacctccttgctccgggtttcttggatgattggggaggcgatccatggagtcctctgagtgcatccatggtgacgccagcacccccagggggttgggatttctcctctggtgaccgttttcgtgatgaagtcttctccacgttctcttccccggtgcacttttctcgtttttttctctcgtcgtccttttcgtcttgtggtcgatttcccccgttcttcttttcggttgtgcacttcttcggttagtctagcgctgagagcttgtattgggggatctccgggtgatctgtttgtcgctaatcaaaaggatcggagctattcctttttggtttgttctaaagccatgggtatttggatctataatcttcattctttcatctgtaaagactatcatgctcgtttccatctttggagagaatggaggttcaaattggcagaaagaatgaaggctatggtctgctgaacagaattctgaatggac

SEQ ID NO: 100163 - DNA, 806 bp, Oryza sativa
ctgctcttgaggtccctaaaagaattgtgatttaaagggccgctgcttttgggggtgttggaagatcttggactgtttcggtctttctgtgtcatggggagatgcctgatatcatgcctggggatgaagatcttcctcctgtgaatcatattcctatccctgatcctgtcctacagccggcatctcatgtggaagtctttggggataatatgcaagaggatgcccctgctaatcagcaaatttctcaaaatagtgctctgtcagtggtggctggttctcataacatggtgctgcagaattaggggattatctcttttgaacatcttgtgcagcctcagtttcttattaatccattctttttgaggattctgtctgcttttaacatagctctctctacttgggaaggctctttgtctgttcagaatcagagtcccttcaggttgctgtagctctcacctcagtggtctctggcattgggcccccctcaggaccttcagattgtgcccttctctttgcctgttattcatattgttcagtttgctcttctagcagcagtcctgctggtggttggggttgaagacagtgagactcaacagaccatgttgggccaggaagatttggaggcccaacattttgaaaatgctgaaataattgagcccattagctgtgtcccccctgtgtaacatgtctcagatctgcccctggacccttttcagcagaattggtcctcttgtcggccttccttgaagaaaagcaaaaagaaaaaaggtaaaactatggttattgtggacactgatcgtaggagg

SEQ ID NO: 100164 - DNA, 1652 bp, Oryza sativa
atccaacctcccgcaccaaatcccaatccggatcccccacgctaaaccctagctttaaacccccgaatccaaccaatccccgcgccgattcccgccatttcgcgcacctcgtgccaggatctgctcctgggcggcgctcttttagaaaaaaacctggcagatttcgacttctgcaatggagcccgtcgatttcggtgggggcaaaggttatggaaggaatctctgtctgagcaacgatctgatccttctggagtaaggttttgtgctgggtggatttgggattcgatgtggctggagttgagctcatctcggggagaagggattcggacggtgtttgatctttctgtcgtgattgctttgcttcgggtttgctcagcgctagaagatttgctcgcagaatcccgcgcggagttttgaagaaagcttggtatttcctggttcgttgtggtttgtaagcgatgcagttcgaggacgggggagatgttcatgttggtgccggtgagggtgaagatggtggcagggtcacagtggatgagcttaccaggtgaagaatttttctttcttttttatttttaccgtatcctacattcagcagttcagcatcgagatttcatatgtgcaatgtttgggtgaaaagctaacgtgccaagctagttataactgtagctagggcctaccctccataatatagttttttttttttgaaaccgtccctccataatatagtgacctagtaacggacgagacatttcatagtacaataaatctaacatgctcttgtctagatttattgtactatgaaatattgaaatgtctcatccagtactaagttgctatattattagacggagggagtacgagatatcacgagagaagagagctctggatgttagtactatttagtacccttttgcagttcttttcttttcccaattctagtcttctgtagttatggttaagcgagaccggattcaaatttagaagagtaacacttcctcaagtcagtattacttgtcgtttcagacagggaaatactactaagtgcaaatcaattccactacctgaaacatcatatatttccgtccggagggagtagtagctgatcatcaatgccttttctcagatcgggttatgaaagcaataaaattatcaaaggctgtctgtcggtccatgcatatggtggaatgttagtattgcacactgactacttagcaggttggtgactactatactactcagtactatcaacattcagcagcatgctggaaattgatacagatcattttctcttgaatcaaggactcaattattcatggtagtgagacgattcctaacttttatgttatagtttttcagatgtctacgttgtggcatcagtgcaaatgcgacgcctcatatgcgccgtggaccagagggacggagaactttatgcaatgcttgtggtatagcatgggcaaaggtattctaattgttctccaccacttcttgtttatactcgctccaattccaaatgtaagtcgttttggttttctacatgcagggaaaagtgcgaaaagttattgattctgatacccccatggataatgccatgtttgcacaaatggttccagaacttagcatggaattcgatggcggagataaagcatatgagt

SEQ ID NO: 100165 - DNA, 695 bp, Oryza sativa
cccatcaactaaaaacgcaactaataattcttatgaagctcttcatggccaggtacgtggacacctaaaaggccaaaagctaccaactttcccatttcccatgcctcaattccttagggagaggctgtgagaaatgcactgcctaattcatggaagaagacaccatcctatatgggtttcttcatttcttgacttaatggctactaggaaaggagagacctaacaagccaagaaacggcaattcttgggagggatgagcattttggtcagaatacaactcctaaatctacaacgcccaacatttgtagaggggctcttaaaccaacttctgttagttatttggcacagaaacgatatttaatgtctcatacagtcacttgcacgaaaatttccatgagaaaaaaattctccagcaaaattgtccttgtcggaggtctttggtctccaaactaagtgaaggcgttgattgacatagtaccttgaggttaccaagaaggaaagcaatcctagtacgcgaaacaagaaaccgaaaaaaaagcaaaggactaagttacacctccttgttgaggaaagaatttcttaaccgaaggattatcccagaaaagaaaaattacgaaagcaagacgcaagagaacttaaaataatctatccacagccttctctaagaacttccatttacccaatccgcgtggttt

SEQ ID NO: 100166 - DNA, 638 bp, Oryza sativa
tgacatagtctcaaacaacaccctgcaaaatatagctggagttcaaacaggactgcttggcttgaagctgatactgcaggtagtgttgaattataatgcatgttttttcatggacctatcacagcatacatgcctatttaccttatggttgaacttgtctgtgatgacagcaaacatgtttttggaatcaaaggatgaagctcatgattttgcaagcctacggcatgcgcttctggaacaggtgcatatgctctacttttcgatactaaattattgttacatattttaaaaccaaattattgtgcatgtgagcatgttgttaaataaatattgacagtattattattctattttaatgggactaaggttgtaagtatcgacaatattagtaatcatcaagccctaaaaagttgtaattgagttacatggttggtaacataaaaatactagcaagaaaactacttcatatcttgtcaatgtgacaaaaaagtgctctgtatcaaatatttcacagaatgagttcttttggtgatgtggtaggcttatatgttatatgactagttttcaaatccaatttggtatgacttttttttttttttggggggggggtgatggtggcacaagattattcattggat

SEQ ID NO: 100167 - DNA, 533 bp, Oryza sativa
gatattgttgcatataggagattcaggcacgcggttggccatgtgaccgtatcctcctttttttttttccgcttttgttactgcacgtgcacgcacaccggccagctgggccaggcccttgtctctccgagccccgcctttcgggctgaattctaagccaaaatggaccaggccgtacctggcctccatgctgatgggccggcctctccagctcggaggcccatatttgttctgccgtcgccgcgtcgtgcggcccgggtctcgatcgctttcgtgcgtgcattcctcggcgagatacacgcgcagcggccactggcttagctttcacagctcgaaagcagcttcccccccggagctttccagctgcacacacatcaggatgtcactgctgcatccatccgatccgagcccaccatctctgtgctttgcaagctcacgcggtggtccgtccagccgaaagcttcatcgacaaaaaaggtctgatgtcacgcaggaccaaagaacagcctccacctaattacctctgttaagtt

SEQ ID NO: 100168 - DNA, 691 bp, Oryza sativa
gtcacagtggtacaagactctaaaatgtgattggcatgtctcacttgagctctccaaaacgatgccctcaatcccacatgaaatatctattttttgatgaatgaatgatcacggattagttacacataggattaatttatagttgtgtacttgtgttgagttgtacttcctccatagaaatatattatgaagtatgttatattttggaaaaggtatagattttcatcaacaattaatcttaatcaaattataagtatatttagtatataacaattatatcaatcaaaaatatatatcggtttgtaaaaatgttggctccatatattgtaagaaaatctatttttatgaacaacatctaaaaacttattcaaactgaaatgcatctatattttttcacataggggggttttattgagtataagtcggacacaggcacgacagttatatttttaattttatgtagagatgaaacatataattatggtttgtattacaaatcatattaattttagaccaaatattttattcatctatcatgcccttccaattgtttcaaaatatatgcaataatattgttggttatatctaagatataaaaaaaatattgtgtggataagccaaaatatcataagaagttgtacaaattatcgcaatccacctcaatggcaaacagtcttaacctaccaatata

SEQ ID NO: 100169 - DNA, 921 bp, Oryza sativa
ctacacatggcctaatttttggtttactctggccggctacggctagcggggcatgtacagtacgtacgcacgcacgcacgcacatggtggttaggtttgggcaccgtttgggccctcatgtatgctccatcgtgtgtaaagaaacgtgtcaagcaagtgcgcccgtgtgcacgttgagtctgaggctggaggctgtgcacgatccaaaattaggtgggggtgaaaaagattttcttttgactatccgtttttctacaggaaaccctccttttctttcgtctaaacaatattgactgtgactaaaacgtgaagattggttgaagatggcattttaatcgattgtagtatattttttcttggcatcaaaccaacttatatataacatgtgttactgtgcatgtggcacctaggtgcattgatggaatgtttacaatgaacgattcttttctttattttttttctggttatgacctcctatgattgtaatcttataattttttctactctatcaatataaactttgcactgtttgatgtgagccgttaaaaaaaacagcctacgcaaccaagcaaatccatggttcagagacactaaaaaatgaaaaaaaaaatccaattccgtcatacatgcataatatagagttgtctcgttgccttaggaaaaacagttaagctatgcgtcatgtttttagaataaaaagaaattatttgatagttgtactccattttttccaaggtttgacgagaactggcaaactgttataatttctcagagagtctatgcatgcgaaggattatttttcgacgagaactggcccgacgtaaagcttctaggaaatgcatgagtgcacgaccagccgtctcgatgaatattttgtacttgcaaggttgcaaagtgcacgttctcttaataaaatacttc

SEQ ID NO: 100170 - DNA, 698 bp, Oryza sativa
tgtcttgctccttgtgatgtgattctgattttgcaggacaagttgctggaccatacgagcgtcacgcacttgttcccgatcaccaagtacatcggtctgctcgccactggcctcacaggtttgtttgctctgcagctttgcttcactgtatataactagtgttatgtttttgtgcgtgttgatgatgaagaaaaagttgttttttttttgtgtgtgtcttaggtttaagattaagttattccagatatcaattttgagatagatgctgtggaaatagaccacccacagtgattttgccggttaattttgcgatgatgctagagctttatatagggcatggttctcctggttgttttgggttgtacatgaggcactggatggtatatcagtatgtttagctctgtttgttttaactcttagggcaatggtagaaagcactgccctttttcttttggggactgcgaaaacaccacaaaatttggatcaaatgcaagcataccatattaattaagctctttcatatttgccatcagtttccttatgaaggctcttgctttctagtagtatatatgttgtagcattaggttccacataatttgttctgctagtgataatttggcattgagaccatattttcttattttgtttttcctgaataccttcattcttcattgatcataaactttgttttccttttt

SEQ ID NO: 100171 - DNA, 652 bp, Oryza sativa
ccgggtcgcgtactcgcgtcgcgcacgcgggccatgtgtgtgtggatgcgatcgcgcgcgcgcgcgcgcgcgtcgtctctcctcccgtgtgcggtgcggtgccgggttgttaggcagctgcacggtggcttggccgcgtcgacgtcgcggccggacgcgggtcgcggggcgagagatgcccaacaattaggcgctcgcgtgacggaaaggcagggctggcacgggaggatgccatatgcagatatgctagctgcgcgatgattattgatgagtgttgagtggtacgcccagctggtgcatatctgctttgtcgcatgggaaacaaaatctagcaccgatgggaactcgagagaggtgccggccggccggccgcgcgcacatgtaacatgttgcccatgatttcgccagttgattaagttattaattaacttcccccttgttgatggattattgattggtcccgtacgtcaagttgggcagagaaaattagcgagcaatacacactgtctagcgcatggggcacttccaggagtaaggctaactgctacaattaagtgttaacaatgcaggagtatgtatgattgtttggtattagcatctgttgccggcaatggtcactagcaataatatcaatatagcagaacaactatga

SEQ ID NO: 100172 - DNA, 570 bp, Oryza sativa
cgaccggcgtaacgcgtactcgcgtctcgtctggctcggcacggccgagtcaccgtgcaaatccatccttttccagacgaaaggtagggagatggagagggagagatagtggccggccggttgcttcgatctctcggcaaaaaactgcaactgtggctgaaaattatctgtcggaagaaagggaaagcacccagacccgagccataccgatctttccctattgcacatgctgtaattgtaattggtctctgagtctctctctcgcgcgcacacatgacacagctagcgccacctaaagttgattgcaattttgcaacccaactagcagtctcaggctggtaccgaaaccaacaagaggtgtttcagctgctagatattttccctcggccctactggattacagtgtcagttttgtcacgtatttggagcagtatactactaactccgtttcatataataaattattttaatcttttcttgatctaatcaaatttatttaggtttgattaagtttataggaaaatttgataacatatatagcaccaaaattagtttcattagatgtaacat

SEQ ID NO: 100173 - DNA, 644 bp, Oryza sativa
acgaatcgataaaatcagaaatcagggatttcataatttcattagacaaagctgaatacccagcttttgctcaaatcttaccacaaatttaattaaacctaaacattagactcctatggattggttggacaacttaaaaagaaagttctcgtggagcagtgtagatcttggatgtcgatagttttgtatgcgagaactaatttcctgagttttcttcaacatttttatgttgttgcaaaactttggtcgattgtactgaatattatgaatattattattgtggcgatacatcatgatagttcacggattagagacaatctcctgtaggccttgggccagtctccaagggttgaattaattttcatcatggagataattttggcaaaaattaggctgggcctgcccgtaagagggatcagaaaagttgggtgatagtacttcctccatcccaaaatgtttgacgccattgatttttttaaaaatgtttgaccgatcgtcttatttaaaaaaataagtaattattaattcttttgctatcatttgatttaatgataaatatacttttatgtatacatataggtttatatatttcacaaaagtttttgaataagacgaacagtgaaacatgtttaaaaaatcaacgg

SEQ ID NO: 100174 - DNA, 1276 bp, Oryza sativa
gccatgcaagtccacgtataggacaaagactcagtcaaaaccggcacgtaggcgccacatcagtcaaacccacctagggatattgtttgcaccagttttaatagttaaaggagtcgatatacccggttttatggttggaggatatgaatcatacttgagcgatagttcagggagtcaaagtatactttttccatttgttttctatcggttgttagtatatgctctgtttctttgtaaaagactctgtttcttctgtttttttttctcaagaccacgattattaaattttggatatgacttgctacatatgacagctggacaacatctagcctacaaaatgtaccatctgcgagcatgtgaaatgtttgcatcacttattgcctgatgtggtgcaatgcgttttttctttaaaaggtattttaaaaggtaggtctgacatctgacaggccacttataattaaatcttgattattactccctccgtcccattttaagtgcaatcataagtttctgtgtctaactttaatcgtccatcttatttaatttttttttataattagcatttttattgttatgggatgataaaacataaatagtacttcgtgcttgacttatgtttttaaattttttttaataagacgaacgatccaaattagacacggaacattatgactgcacttaaaatgggacggagggagcagtgatctttctaaaaatgtactgcacgtgctctcgatcgataatatgaatgaacctatgatcttttccttcctcatacaccatgcatttgtgatccccctcaaaaaaaaaaacttaacctaaattaagtgaagatatgagagattagttcacatttattgtaataggatggatcatattaccatctaggttatttttttttaagaatggagtatgttttatcaatatatttaaagttaattatctcgttcttcgtgaggtcctggaattatctcgttcttaataatattcattaattggacgaccttttcaagttagactccacattttgcaatatcagagtacttcttgtattatttctatatatgcactgggcctgccggtttcattttaattatacgttcacatatattgtatattgtatgcacgttcatcctagctagctttggcaataattaattaattatcacatcagctgtatttttagataatgtatactcctcgatctgcccgttccctttcatatatattatcatgtgcccgtataaatactcatagacgatgaaccatgatcgtc

SEQ ID NO: 100175 - DNA, 675 bp, Oryza sativa
aagcagcacaggcgcaaggacgaagaaccggcgttaggaaagtagcgtgaagatctgatcgtggtctcaagtttcttaatagcacaggagaggaatccgcccgttgccgcagtaatggcgcaatcaatgcgtattgaatcgcttgcccattacagaggcaatcacgcggggttggattccggtccgttgcaaaatgagagagagagagagtcgcagtcgcaacgcacgcctcgcccacggccacgggctcggctcagcgcgcgcgcgcgtgtggctttccgatccccacctcaaccggtcaatagggagcctccaataactccctatttaagttcagatactccacttttaattctcaggatggtattgttatccttaacatttattatgggcccttgagattttaatagaaaaacgggcctagcccatttattctaacaatccccaccaaatttcatggctcataagaaatgttctcaaaattgaacctgtttgacagaccagtgttttggtggagactgttaagttgaacttccacctaggaaaagagctacatcagaccataattgaataatggactatgccttaaattgtcagtcttgtgtgatcaggtttcagtcaaacccttgactggtactgggctgccgtttgcatcccctctatttggagcatata

SEQ ID NO: 100176 - DNA, 577 bp, Oryza sativa
gcttagttatatacgccctcggaatttgatgcagcgaattatccaccctgtacatttgttcacgaatgctggtgcgaattgaatgcatgtgtatcacaattaattcacagacctgcgggtctctcttgtactacatccgtactaaaatatagtaatttttagctatatatctaaatttatagttaaaaatatttacgtttgagacggaggaagtagtcttaaaaaaaattagtgatcggccgttgcacacttgtacagctgactacagtggctgtccgccatgcttgtacccaatatttttatgtttataacaaatttttgtattgttcttttcaggccggtactacaactaccaaaaaggtcaaccgtatggtgctggtgcaaacaatgtggagatttttacccgtgtgccattaaaaaacatgatgcctgcctctgtgccactaaaaagttcgagcctctttttatgccatcgtcaaactttatcgcgccctccacaccattcagtcctttttagtcctaacggtgtcaaacagcgcaaccaaatgactttgttgcccttagacttgagagccca

SEQ ID NO: 100177 - DNA, 1235 bp, Oryza sativa
acaatggctattgaaaggggaaagatggagatgcaagagaggagcggtggtgccgtggcggcggtaggtggaggggaggggataataacaagaggaaaagtagcctattagggttaggttgacacatcatgaatttcatacgctaggggataatctgacggttgaaaaaacaacccgctttttgaataaataatttattaattgtggcatcatttcttccttgaaaatgtatttaacatttcaccgttgtattgtaatgattatggtttctaaaaaatatgctaatatgaaaagagtttatcccttatcagacattgtcataccgattcatagttgatcgacttgcccttcctataccgcggatgtagcagttactttcatttttctgaagaagtgttctaatgacttataactctcgactagaaacttgaaacttgaaattccaactgatttaaactcccaattgaaagatcttaaaacttccatattatatgaaaaaaaatcataactttatctactccctccgtcccacaaaggaagtcgctttgctcagtagaaaatgccccaaaatactcgacgctgaactttcccatcagctagtagtagcgcataaaagtgacagtagctaatgaagttttttaaatgatgggaccggttggattactataatccataaagttggtaccaatgtgtaccgctgctgcaagcaccaactattaattttatcatgatttaaatgttcttttttaagtagatgtggcagtataactgattattgcagtgttgtagcgtgctactctcaagcctccgcatgattagctgcaatcctataaaacatgagcaatatgtcattttcacctaactctaatttggctgacaatacctagaacgacatacttcgtgggacagagtaagtagttggtttgaaagtttgaatcaaaccttggactttcaaccaacagatttgatataatctgaagatacattatttggaataatgaaaaagagaatatgaaattccactctcaagtctcaagttgtgatttttcaaccatcacttgcggtaataacggcggaggcagtgaagagtgaagaccgaagaacaggactagaggagtcgcttttgttgcgagatcactgcgccgtgggcccacactgtcagcctctctctctctccctctactcccaccatccgggcgaaatcactcgagcttcacacctgtgtcagatctcgg

SEQ ID NO: 100178 - DNA, 890 bp, Oryza sativa
ctatacattggttgataaattttctcctaaaaatttatttgggaggtccaaatataagtcaatcatagagtaattaaattataacgtatgtataaccacaaaataatttgtatgtaattaaaagtctcacacagtaacatattattttcatgaagcagaggtcgctatgaccaaatctccttacccatgtacacgctatgatattttgtattcctaacttaacggttttaacgtacaagttacattgcagttttatgtaagttgcaatataagtaattttagtgtatttatatatgatgaaattttagaaagagaaaatttatcgacaactatatagaaaaatcattctactgaatattattccagtcatacaccatgatacttcagggactacaaacgcatgggtaaattttatagtgcaaaccataaatacattgaaaatctgaaaactatatcgttggatcgaaaaatagacatttgaggataaatttactcctaataaatttttacttaggaataaatctgcgagttgagtaaaatttttacttgtgatgacgtggataaatctcagacatctatattttatccaacggtagttttatgtttccactccatatgtagaagatgtggcgtctgcccaaggaggaggtggactggatcctctctcagttcaacgagcctgtctgcgcctggttccgggagctgaagcgcgccaacccgtccactagtacagatccttccatctgtgacggcccctaacaagactggaattcgcgggccgtcacaaggaagtaatctcaatcgggccgaagtttcgcccgattgaaatatggtcgcacagccatggtagatcggcataaaactaagggtcataattgaggcccgattga

SEQ ID NO: 100179 - DNA, 915 bp, Oryza sativa
gtgacttgattcatcatcaaatgttctttaaacatgacataaatatttttatatttgcataaaaattttgaataaaatgaattatcaaacattggttaaaaagttaacggcgtcatacactaaaatatggagggagtacataagcacaattcaataaaatgaatggatgcaggttaccgattcaacactaggaagaagctaatttatggatcaacaaacagttcagctgtgcatgacatctgttgaacaaaatttaagtgtgttgttttgaccaaccatcattgttgattattaattcttctaaactgcttggtttacgtgctctgttgttagtggttagcttttttttttcttttgttgcaggaagcctcgtacagttcagagcttatgtaaaagcaaagaaaaatctttgactaatcgtgattagtctgtgaatgggattaggactgatggcattaagcattttttccaaactgtgctgttttcttcaacctgaattttgcaagcagagcgagctgactatgtcaccgagcagatattcagcagtgtcttcagctcttagcgattgcatcattcaaatgaatggtgttcttgcgacaaaagatggacatacttcatttttaccttctgtacatgctacccaaccaatcttcgaactaaatctcaaattacttgcctcttgcttctgtttatcaacaatcctctgtatttatgtgcttctgatgtgatagatataactgcattgacaagagaataaggatccactctagtcattggtaccctaaatttgtgaaaaaaaaaaacaatttctgtttgtaccccaaatttggacccgttcatctccactgtatttcttggatttttctgctgacagcgaggataacgaagtttggaagcatatcaagaggagagcag

SEQ ID NO: 100180 - DNA, 589 bp, Oryza sativa
atatatcccaacctcttgtcaagtcccagatatatcatgttcctgccagataattctatatgcgacctaactagcctgcactccaacattcgcatatatatctagtaatttttcttatgggtttggatgtagccgaactgtcttggagaactgcaacaccctagtgtaccatgtgtgatgcggttgttttcctctttcttttttttaaattccttcacagcagggggtttccctagcatgcacatatcaaaccatgttatattgggcgtatgaacaagtacgcgctcgaacttaaggatggatgtgacgagatcgatggaccctatccaaacaaaccagatatgcatgaacatatgggaaacatgaggggatcaggtggcccagcatgctatagctagaagtcacatgtttactgtagcgtcacatagcctcacatatttactatagcatcacataggctagtcatggattaattaggctcaatagattcgtctcccgaattagtccagggttatggaatgggttttgtcaatagtctacgtttaatacttctaattagtgtccaaacattcaatgtggcagggactaa

SEQ ID NO: 100181 - DNA, 1706 bp, Oryza sativa
  unsure (1)..(1706): unsure at all n locations
ctatattggttggggaggagcgcccataatcagagccccgaggatgtaagcttcggctgaacctcgttaacaaatattgtgtgttcttgtgtcgtcatctggcatgtcttgggtgatcaatgactgaagcgatcaggaaggttagtcgtcgttccgctatatcgactaacttttatatcaacgaagataaggtaaggttcttcaaaatagaaataaccctttgcacctttgcatcaaggagaaagcactatactgtacaccacctaggatttattcaaaacatttttaaagagccaataattccgcgagttaaccaaatggcccagcacacagccgcacccacgaaagccgccttggccagcagctccagctgcactgggtcgtcgttgttgtcgccgctgaggagtggggaggtcaaaagggtttgcagtcgccacactcgccgctgagcttgatggaaacaggccgccgagttgctccccaattcccgcgcactaccactgaggttctcaccccacccaatgataggaaagaagtacatggtcacacaacggtgaagggtgcggctcgccagcggatgggagggatagaggagagcgcctcatgtcgagctagaggaggatagcggtggagaaaaggatgttgccttcaagctcgtccttgtgagccgccccattgaggtctgaggtattgttatcgtctctagccacgccatccaaagcagttgcctccgctagaaagtggaagaggagaagaggagacgaaggtgctggagggaggacgagtggcggcgccagagcccacgcatggtgcatccactgttcctgctcccctccgatggccttgctcgtcatcaccgacaaactccacattgtccccatgccgactcgagggccacgaggtcctccgcgacgctgacgtccacctccacgcctccttgctgaggtctaccgtccaccttcctcgatttgcaggaggcggggacggtggtaggaggcgtgaccgaagaaaagtgggtggcgggaggcgaggatctgggagcaccggtgtaggataatcccgcgccagcgtggggtgagggtggctcancggtaatgcttacacccatcgtctcccttgtcagcaagtccaccgctagactcctccccttagaatagccatggctggatcaagaaggggaaagagcagcatggatgccaggacgaggagggcgtgagcttaaggggttgagagagcaacaatggctggtcagctaggggaggcataggcggatggtgtatgggagaaaggcagggaggtgttgggtgtagggatgggtacggtaggcgctaaacaagaggtgggataggattgatgttggattttgatgtatttttatgagaatgtcctgatacttttaagatttagtgcgatataattagaaacggaacttccgtttcttcgcattatatttcactcaaggtcaaaatgttttaccataaaaaagcacaacgaggtattggtgataggaggatttcttcgcaattttctagagtatcagtagtctttatgtaaaaatatgaacatctacttgccccttatatacgggcaaaccgggcatggtcgcttaaatgcattaacacgagagcaagcgcgcacacaaccacaatagcgctttgaccagagcactgcgaatcgcccgtttcgctctgccatacaaggaggca

SEQ ID NO: 100182 - DNA, 568 bp, Oryza sativa
ggctccatactaatgcctgattgagatgacattcaggcccgtcacggatgactcatctttgacgggccctacgataatgcccgatagagatagattaatctctatcgggcttaaaataaggcccgtcaccgatgactattttctatttttcccgtcaagtctttatatttgtgagtgcaaaatatatagctgctatataataattcaatttattagtcataatacattttcggatagtaaatgatttgaaatcgaaatatggtcaacaacaaaattgtagagcttatcaagatctacaacttttattttggtcatttgtctatataactttgttcccaacagcttgaaattgattttgaaaatatgacaaattaaaacaactttttgtaaatagtaaatgatttcaaatgaaaaaggcaacaacaacaaagttgatcctgtcatcaagatctataacttttattttggtcatttgtctctataactttgtttccaaagcctgaaattgaatttaaatatatgacaaatgtaatcaacatttgtaaatactaaatgatttcaaatggaa

SEQ ID NO: 100183 - DNA, 602 bp, Oryza sativa
gcagtcagaccgacggcggcgacaggcggcagaagctgatctcggcggtcagaccgaagatacaatctcagtcaaaacgacggcaaccaggcggtcagaccggcgcatctacttcggtcagaccgcgatccattgaatttgagggtaatttttattttccgctaaaagtttcggtttttgggtataccaaccattcacttttgggtataccaaccattcaccccccctctggttggcttagttgttgtgattcgatcctacatataagacgatgacgtgcatggaggaggaggttaagatgtacgggagcatagctgaccatagccggtccaaaatgatttgggatattttgggagattttgatgtctacagtagcaatagggggtaagtacaaaattagtagcacgttgagatatggagggggctggatgtaagatgttgcctacgtgaagcaccacataggcggtcagctctgatcaaacgcgttttggaccggctatcactactagagaaaccctcatctcttttggtttgcaagccccttaagtccggtttagcatccgggagagagaatctaggacaaagatggcgatctttagtcc

SEQ ID NO: 100184 - DNA, 1245 bp, Oryza sativa
ctttttaccatcagaaaatcttagcaaagaatttttcaaataagaaacctatttttccaaattagcacaattttcacaatctaccatgacacctttgcttttacgacacttggggcaagaaagcacttcattgtttttcacaacatcttccttgtactcaacatgacctaaagcgtcctttaacttcaacttattcaaagtacatgttgagcaatccaaaacactatgaggttgttttaactttttagcacaaatcatgttaaacatcaaactagcatgaaaagcaatttgttatttttacaacaactttttagtcaaaaacaactcatccaaagtgcgtgtgtgcaaagcaaatccaagagctagagaagatctatttttcaaaccatgtgcagcattaacatctctaaattttgaaatctcattcattaagacctcacaacttttgcaatcatcatcattgggaataagatattttaatctagcaaattcagaattaagagattcgataataaactcttgttttctatacatcttctcacacaatatattttttgcactcaaaatattaatagctgcctcaagagcacttacctcattgtcttcacactctgaatccgattcgccacgcgccatgaagcaaacaccggagatgttctttcccttatcttcatctctactctcaccatctacatgcttagtggctcaaacgcggcgtagacttgatcaaaagccttcttgagagtctccttgatcttcctccctttgaatgtaccctttggcttgttgtcattggtcttctcatcaccattatcttccttcctctctcccaagcttaggacaacgtgaacgaaagtgatatgtataaccacattcaaagcagcgatttgttccacctcttttgctgtacctaacattggacacagctcgagaaagtctgttatttaacaaaaccaagtcctcctcctcgaactgttcaagttggtcatcggacatggcattaaacaaagcaaatacagaagacttcgatgaagaagcatcaacatccaaagaagttgaggaagaaaccaaagcactcgacttagaatcaactttacgagaaagaaccgtcatctcatgtgttttcagtcttgtgtaaagtgaatccaaagtcaaagtatacatatcaaccgacttctgaatagatgccactttcatctcccaaatagtcatgtcaagaccattcaaaaagtggcgagaaatctc

SEQ ID NO: 100185 - DNA, 728 bp, Oryza sativa
ttgtatagatcaacttaatctgcaatcaaaaatgatgaaaaatttctatgttaactttgttttgttatgcatatgagttgaggatgatttgtgccgggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggac

SEQ ID NO: 100186 - DNA, 679 bp, Oryza sativa
gggggggggggggtgaataggctttcctgaaattttctcaacaatcgcacggttaatttaacagggcccggaacctcctggtgaagaacaccggaacttcctggcagtgatgagcagcccggaacttccggagttcttgggccagggcccggaacctcctggtgaagaacaccggaacttcctggcagtgatgagcagcccggaacttccggagttcttgggccaggaacttccgggcaacagaaaaaattgaaatcggggatgtaaaacaggtcctagctagagacaatcaggcacaaggtagcacaagatgtaaatcacaagataccagcagattcaaacacagatcatgcacaagagagacaaaggcgattttttcccgaagttcggatcacacggatcctactctccgttgaggtgttcaaagagccgggtctcgattaaccccttgcctcacttatgcaaagatcccagaagaagtccacagccttcaactcaacacttctaggtcattttagaattgagtgaccaccaagatccaactcacaattccttctagaaaagaccacaagtgcaagttgctctacttaggacaacctctgaaaactcagcacaagaatctttactcacttacctcgtttccttgcggaggtgaggaaaaccttcacaaacttttccg

SEQ ID NO: 100187 - DNA, 1027 bp, Oryza sativa
tgcttgcaagccttcatttatccttcaaaactgatttcatcagtaggttacttaaactacaaatgctattgagcaattgtagtttagggaagatcaagttgctccttaagtactaaacaattgaactgcaattacagaattgctgatactatggtccgaacagatggactctagaactagaattgcaattgcttatctctgctattacacaaatacatcctccttcccttcccactcccatcccacggacctgtttggcatagctccagctccaactccacctctcctggagctggagcccaaccaaatagtttcagctccatcagaaataggagcggagctgggtggagcactcttacaaaatgaactagagaggtggagctgggtttaggctgctccacaactccactccagacccaactcctggagcagaatttaggagttggagctctaccaaacaggccccacgtatagaaaaacccgctccaaaaaaaatggtgtaccaaaaaaaactgaccaaccaaaagaattatgggagaacagaaaaaatgaaccacgttcctaactaaccaactaagagagagaaaaatacgggagaaaaactaaaaccaccccgttccattgcaatagacaggcatctaaatagtatatcataatttgggtaaatctgtattccttctgtcatgtttcttatatggacatttgactacttctcataaaataagaaaatataccacataactgcgtattctctataaagcagatgccatatattagagtacgttctagcttgtcatactataatgttgatctatagaaactaatttcagtctaaatcttgcagctcgaccaaagtttattggttttgcaaaactttgtcttgaagaaaaacaaaacatagctactaaggtatcatatgatctataatgaacaagtaattcgctattcctatcatgcataattggaaactattatgatcttctaatgacatgaaacaatttggaattctcaaagcagatagacagag

SEQ ID NO: 100188 - DNA, 673 bp, Oryza sativa
aaaagatagtcttgactaattattatccgaaatttttttgaaatatccacccaaagtgcttcagcaaacacaatcagggtgaataaacaaagaaagattgtccagtccaatgataaaaacattgaagttgcaggagccagttccctgcttaaattcatgcacaaaaggagggggaaaaaacatcatcagagatgatgtgagtgaatgcaagagggaactattaagtcaacacttgtttgggaacaatcttaacggaaataaaactgcttctgcaacttcactttgctagctccaaggtctagtttgccccatcgctctcgtaatagcgtcgttcataatcttgcccaactaggcgtgagttgggacccaggtcactctttgtgtagaccccctcacagattttgtaaatgttttggtgattcgttatctcactgaatctacccagtaataagaatgtgtggttgaagctaaaaaaaaactgattcgcctgagaataaaattggtcctgaagcttgcttggatgatgcatatgggcacatgggataccttcagagccctcttataaaacttgtgatcatcgacataacctcctcctgacaaagctctctacaccaataaatcagatactaatccttcacaccctataccatgcgagtgaacctaaagagagcat

SEQ ID NO: 100189 - DNA, 538 bp, Oryza sativa
ctacacagtgtgccaagattgtccaagtcaatctcgtagggaatgtcattctctgccactgagaaaaccctctcggcgtgctcaaacacaccggtattactcatgtttctaaacaccttgccaaacctcagctacagcaagatatgcaattaatgatcagtgtcacttgaacactacgtaactacggtgccttagcatatgacactagaacagaagaaaatgctattatcaaatctttatgacccagagggtactatggttcactagagatgtgtggtagtggatcaagggcgaaaatcaaagaggacaaaattgaaattgtgaagttgcaaatgtttgtcaacatagaaaatactccgtgtttgtttttataagacctgtaattttttcaatcttcctgcaaaattgaagtcttgcaccatgagtttgttgaatatgttcaatgtttggacatggatattacatggcctctctcctgcatttatcagaagaatctcactaaccatgtcacttcagctatctataagaagtatgagaa

SEQ ID NO: 100190 - DNA, 1002 bp, Oryza sativa
gccttgcatggtcaatcacccgtgtttgtactttttaatactaattgctttcaatatgaacaggaattttctctgtcaaaaggggaaaaaaaacttgcaaaatgttgtaaagaactagaccgtgcaaaatttttgaacatgttggcatgaaaaattgtttatgcttacttgatctaacttgggaccttgatattcataaagaaatacaaataagagacacaaaattacaagttgatgaaatgagacagaagcaggtttgcaagacctaggagatcttattttgcattctggttcgctttgagctagggcagtgtgcctatcacgttgttgtggtcgctctggttatcttggacctgcgataaagatagcaatgtgcattctcttagaggacatgtaaattgtgttttgaagcacacaacgacatgtattagacttccaatgaagttaccccttgattcacagtatgacactttgaggactaaagtacttaaatggactatacataaccagtaagttattggtattttcttacaagaaaataataataacaatgtttcttttcaggtccttaattctgaaaaaaaaatggtgatacatgtagaactaatgttgggaaggataagaaagctgcctatctcaaatttagtgtaaggtaagatttaagtatataagatgtagtaagaatcaggaagagcaaacctcaagggggaaaccccaaacctctataaagtataatggatactaaaaaagtgcacaaaacagtggatttacatttcaacaaaacacccattgcactcatttacagaaaaagtgcacaaaaacagtggatttattgatgaaatgtaatttaatgttttcatgttggtgttgctctataatatattataaagagtaaatttcacaaaatcccaagatttagggcattcgtaatgcaaacccccccccccccattattgtgatttgttttaaggaatcacatgttttggggtaaaaatatttcaa

SEQ ID NO: 100191 - DNA, 681 bp, Oryza sativa
caataaaatgaagcagggtaaggctggccaaatgattaaatcgtctgtatatgccggtgcattaaccccaaaagagagcataccaagagaagccaaggaggtacaagaaattctgtcctaaactctaaacctactcattgtttttccgtactagaagaaacaatctctaaaataacagagtgagccatgccattgcgtgcaggttgaaaattttgctgaaggaagtttaccctcaaaactaagaacaaagacaggatttgatgcaaatgatgatattattctagtaaaaaggaaaaatatcccaggaaaggatgggttcaaggtaagccagataactgtgatttctataatagctttctttaactattggaggttactgaattttatcttcgtattgaatactgggggtttaccggaagctgtattacacctttttttttgtttacttgaattttgcgatatactgtaactattttaaggttgggtgaaataaatattacttacaaataaaaaaggggatagggtggtcttgcctactaacaccctgaattcgaaaccctctcagaggttttgtacatgtggcatgctgacccaagctgtcgtatgatctaaaagtgtataacttagtttgtatacaaatgtataaaaagttgacacagtaagttaaataaaatgaccaaa

SEQ ID NO: 100192 - DNA, 1106 bp, Oryza sativa
cagattatgttatattggtaggaacatgtgctgataaatattatctttagtttttgtatggatattcatcttattatttgaaatcttatctaaagttcagtctttatactgttgttttactcttcttttttttttaatagattgtttcagttcttggattagcatattttagctttagcttcactgtcatgtgttgcactttctgaaaatattgcaattcttgcagtgttggcattatcttcatttgtttctttaattcttctctttcttgctagtttgtacgatctattatttctatgtaacatgacttgaaaaatcacattttgtttttttgcagaatataatttgaaaataagctgttttctattgtatttactttctcaatgactggaatgtgaatcacaattttcattgcccctttatatctgtcatagctatagtattacactaaaaaaacatattcgcacgttttctcttgcatggcatcatttcagcatatctgtttgtagtgacttttaacttgtcatccataaaataacagattttattctcctggcaggaacctcatatggaagtattttcacctgggacaaaaaatatgcagaattatattctgaatcggattcttgtgtatgtatatcgtgagttccgtgctagggagaagcctggtattattcctcagattcgagctgatgaattacctattcagcctcctataacagaggctattgtgaggaaacggttaaagcattgcgcggatttaagggttaaaatctatcactcatgttattattactcttgtagctccttctgtttctctggtgctttgactttcgatgttgggtgtttggtttaaccaaaattaatgctgtccttcattgatttttacagaaaggaccaaagggacatttgttctatattcagagacctgattttcggattccatcggaggaagaactgagaagattattgacacctgaaaatgtgagtttcccaaaattacttccatcacttgtatcgataatgccttgtatgttacatttgtgacttttgatgcattaatcagtcatcacattgcattggccgtatgacagttgccagcatgt

SEQ ID NO: 100193 - DNA, 617 bp, Oryza sativa
ggatcccccagtggcttaaagtacaattcactctttatcttatgagtattataataaaaataaaaacgtattaatttattatatatatattataatagaaaaatatatttaaacacatatttcgaagatcgtgttactatttaaagcgtcaagaagaattatggaacctggttactagtacaagtggccggtcttgtctcatgagatggagaaatatggagtgttatggtgtctgtggttgtggatatgttatatatactcctaacgtacagctgcatttccgtcaactattgagcgacacatgtattaatttatggtggaaggcccgtccctaattaaggtccctaatctggcctctagcattatcagattatccatgctcgctacatctcctggatatgggtgggggttggggttttcatttctttcatccacaaagggccctagctgctgctgctgcatgccgcctttgccgctatgatgcatcctgccgtccagtttacatgcgtgttgagcgtacattaccacgaatgtccgtttcccttccccctaaaaagcaatgcatctttttcttcttataaaatgctacggctgctacgcatcttcaggcataccat

SEQ ID NO: 100194 - DNA, 500 bp, Oryza sativa
actataggcgaattcgagctcggtaccctatattttcaaaagcgaacaaacttaaaaactaactcaaatatgaatatgtatttccaaaagcgaacgaatttaaaaaccgactcatatacggatgacgtacctatcatgattacggataatacatacttcctatcctatgacctatgaaatatacggatacaacatacctttgtatgtacgatatacttctatatacaataaggaaattgataagagattatgaaaattatcctccggagcttcgattctcttatccttctggtcacttggaatagctttggaggtagcacaacgcgcgcttatgtctttgacaacatcttttccccagtctaggtgattgacgatattccaagagcggtcgaatattgctctccactggcaaccttcacataggggtgtatacatggatccacactccgtccattctataatatatggtatcctactttttttttatattaaggagaaag

SEQ ID NO: 100195 - DNA, 511 bp, Oryza sativa
tggatcccccatgagtacttgcattagttgcatggcctttatggttcaagttcgtgatggtttcatttaagacctaaattaatctcatctattcagttgagattttcttttcttttctttttggttgtaataatgtcactacttgagagtcgatatggaggcaggatgatggccgatgtgttatgtggaccacgcatggcatggtatggtcaggtagcatacgtaaatgctgaaaggacgcgaataaagcggtgacaaagtgtggcaggttcagaagatggtagggactgcatgtttgttactactgttgctgttactacacgttcacgtcggattggcagtaataaaatcacagagagaggccataaattacatgaaaggatgtagtattatttgctgatactactacagtattattataccatcctagtactactccctccgggttgataataattactcgttttggacaatggcatagtctcaaaaaaaaaaaacttcggccattatt

SEQ ID NO: 100196 - DNA, 638 bp, Oryza sativa
ctcccctatagagggggcgctgcccgttgttctgccatcccctgtttgtgagccggtcagaggtccatactctattctagatgatgagcatgcatgaagcttacattttccagacacccaagctctccaaattaatgggtcaaaggtcgtgtcaagcgtgccaatgcactgtgctttgtaggctgacgaagccgagtactacccgtgagttgtgaacttccatgtgatttggtctggttctccttcatccagatgcatgccatggactgcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtcacaaccaccgccgccgccggagtgggggcttgggcggcggctggtcgccatagcttttttacggcgatcacggcgcgcgtgccggggagctgatcgggctttttagactacaccgggggcgcccatgcccaccatggaacacaaccc

SEQ ID NO: 100197 - DNA, 546 bp, Oryza sativa
ccctcaaattatcgctgagtttaaaattcatcaatcaaccacaataatatgcatcgttaacattgaacagtatgcaatgagtagctagaactgatccttccaacgcagcgtaccaagaaaagctaccagaacacagaggtcgaaacaccgtgaaagcagcgaaataaacgaaaaatatacgttcatgaacatgatttagacggcttccatctaatctttccacgctacatctaaaacagatttaaacaacctatccaatgtcacaccattgctcacgatatgaaataaacgcaaaattacttaaccgcaatgaacagcaaattcaaaatttgcaaaatatctccaaactacatactcctagggcttatttaaatcaaactggtttgagctgcacctctcagaaaataaactagagaaccaagatgtttcagcttcgccttaaaagggatcagaacagactggtatgctctcaaatcatatgctttgtttagttcctaactttacttttccatcacatgcacacataagcatttcaaaacttaaaag

SEQ ID NO: 100198 - DNA, 1144 bp, Oryza sativa
tggtttgtagatgtggttatatataaagagatttggtccattcgacacggagggctccatgtatcttgcaacagattaaccgaacaagttcgatcatggaattggataagaaaaagtggtttgtagatgtggctatatatatggagatttggtccattcgacactgaggactcctaagtatttttcaatagattaatcaaacaagttcgatcagatcgatattcagatggatctggataaaaatttgacgggaaagcaaagtgtgtttgtcacattttctcgtaaaaaagtggtttgtagatgtggctatatatggagagctttggtccattcagcatggaggactccaagtatttttcaacagattaatcgaacaagtttaatcagatcgatattcagatggaattggataagaatttgatgggaaagcaaagtgtgtgtgtcacattcgacatggaggactccaagtattttgcaacagattaatcaaaaaagttcgatcagatcgatattcagatggaattggataagaatttgacgggaaagcaaagtgtgtgtgtgtgtcacattttctcataaaaaagtggtttgtagatgcggctatatatatggagatttggtccattcgacacggaggactccaagtattttgcaatagattaatcaaacaagttcgatcagatcgatattcatatggaattggataataattcgatggaaaaccaaaatgtgtgtgtgtgtgtgtctcactctggtagtgctaaagacaaactaaatgtttgagcacattttctgagacacattttttttaaaaaaaaatgtttgaggcacattaccaaatttatttagagtttttatagcgaaaattaataaaactactacagtttgggaggaatatgttggtgatagtgtgtttggtttgctacattgccgaattttaataatgacaaaatttagcaaggttaaaaatagtatcaaagtgaacacacaagatatcaaaacacgagtagcaactcatgggcaatttaagataaaaaggagtgatggggcaaatttctagcataaaaacttaagagagttggtaagagagtaaggtttaaaaaacaactcgatctaaaggtaaaaccatttgcatgatccagat

SEQ ID NO: 100199 - DNA, 536 bp, Oryza sativa
caatattttcatatatacaaagaaataatggaaattttcaacacaaaaatcataaaaaaaaaatcgtaagcacttatgagtaaagattcttattaggttgcatgcctagaagaagtagggacgtgaaaattagattttaatcctataaaacatagtggattgtaggtggcatttagacattttttgataattcggtctattcggttacccgaggagactaactgaattgaccgaataaaattcggcctttcactacctaggaccgaatttctcggtctcggtctcggtcttttcggttcggtctttttctgcccacccctaactaccaatctacattatcttaaaaaaacattagatcctgcatgatctaatatctttaaaaatatatgtaattaatgtggtaattttagctctttaggatgatcaccgtgtttgtaatgcaataaattgcatagaaaatatagaacataacttatcaaacaaaattcctatattttaaaggagctctccaggctagagctttcagctgcgagggg

SEQ ID NO: 100200 - DNA, 717 bp, Oryza sativa
ttacactataatcatataaacttttctttaataatgtctgtcattctatagtattatcaattataattgtattatttctttggtactaagtcataacttttcttttataatgtctgtcattctatagtattatcaattataattgtattatttctttggtactaagtcatctactttgagaaagataaacttctatatcttaaatagaacagcaaaactcagtttagatcaaaatgaaaaattattgtggccctgtttggatattagctaaacaatgcaatgtgaactgaaagtagcattagctttatttttcaggcactggtacatctgttgaaatttgttaggccaagacttaaaggtagctgctaaatgtattaaaatattgtactttggaagtgataggtagagatctgagctttatttgtggctttaccttgttgcacgtaggaccttgaccagctaggcagctagacccatattcagaaaggtgcaatggagtggctgctaagctcatattggttttccttgcctaattctggtgatgagtgttgcaaaatactcctttacaaatgtgcctttcctggatgatgttgccaataacagtgaaaaatggtggttacatacatcataactctgtagatggctcttcacaaacagaacttttggctgtatggtcatggtctatattattctattaaggatatagtcaagattacg

SEQ ID NO: 100201 - DNA, 673 bp, Oryza sativa
aaacccaatacgagagattaatcaaaattcgaaataaaaataaaataaaatctaaaattaaaaaaaaaaggatagtccaagtaggaatacaattttaaaatagctaaaattcggaattaaaaatatgaaatattaaaagaagagtccatataagaacacaatacgagattaattaaaattgggaataaaaataaaaataaaatccgaaattagcaaaaaaaaaaaagagttcaaataggagtacaatttaaaattagctgaaattcggaattaaaaaaaataatattgaaagaagaatccacataagaacccaatatgtgattaattaaaattcagaataaaaaataaataatatccaaaattagaaaaattaaaagagagttcaagtaggaatacaattttgaaacaactgaaatctgtactattaaaaaatgaagatgtttttgccggtataaaaaaacagaaaaaaaggagaaaaagaacttttatgtaaaaaaaaacgtccgactccataaaaaaagtccgactatctgtggagaaaaaaaggccgaaaaaattatcaaaagagaaaaaaaaacctctacccgattaaaaaataaaaaggtgcgatttctgtacgaatgcctcgaaaaaagactttttggccgaaatcttctcttctcttctactccaa

SEQ ID NO: 100202 - DNA, 673 bp, Oryza sativa
atttctgcgtacgattctagtatgatttctaactgatggtgaacgccgtgcgtgcatcactagaaaacaggagacaaacgttacgggctttcgctggaaatcgttagtcgtacaagtatcgtacgtgaaaaatcgtatgtgtagcagctctcgttatagtttaggcacacagtaaattcaatcaaactcagagaggaatctcatgattccacacaatagaatactactttagccacagataaattcgatagaactcagaggaatctcatgatttcacacaataaataaagtaacacaagctcacaagcactactgctagacacgcaactccgcttgattaaaagcagcgccatcttaacctgagctttataatcttttcacagcaatataaaaatataaatctctgtgctgcaaattccccacaattatatcaatcttgtgctgcaaataccccataattgatgctcggataagctacttttgaacatgttcacgccacaagcaaccaaaaaaaacaactaaaatagcaaaaattagcgccagtcaccgctgcgacggcacgagatctacacaactacgcgcgtgctcagatcccacccaaaaaggcccaaaaaaaaaacacgaacagccaccggggtgagtaagcccccttccctaacttccgagaaggcgg

SEQ ID NO: 100203 - DNA, 688 bp, Oryza sativa
  unsure (1)..(688): unsure at all n locations
gcgcccccnttttgttgcttgtactctaggcgaattcgagctcggtacccgtactattcacgcctaaaattctctcttttttctgaatgtatatcaagtccgaaattgattttctttcaagtaatagatgtcactctgttgtcaattgtttctagaaatttgcattaaattgaagagaaaatgccccatgtaaggctcaagggtcgacaaattagataggtgtggtccagcacactcatactgtaagagctagagaagcaaataatgtgtggctcgcatcatatcccacctcacctaagggtaatgggcccgtgctctttgtacaacccatcttagctcttaaatatttttagcttaaaaatctattaaatcttatcctaatcttttttgacacaactcttatatatgtttataggctaaaatgttgggcaccttacaacccctaaatacattatgttggtggtacataattaaacagcatgtgtcctatgttgtatatacagccgtaataggatgtgttccatatatatgttcgacctgtctttgagcaaatagtggtcaagattatgcatattttacaaattaaattcaaatgtaatgtgaggcccaacttggtcctggtcgttggtctaatataggactgattgctctttttttttccaaaaggaaaaaaggaacttcggatgat

SEQ ID NO: 100204 - DNA, 830 bp, Oryza sativa
tgtaatcttcggggctaatgtctggaatttggtgtctacttccactcttttgctagttgcaattatcagtaatttgctattgaattggaatgtgaaaagttggttgtattcttgcatgtcggcagaagcatattaaccacagattatatgtgggcatgtgatgtgtgcggcgtctgtggacaaaactttgtctgtcggtagaactaaaataataacgtcaaactgtctgtcggtagaagttctatttgtcggtaatgccttatcccgacaggctttccaccgacacaccctctctgtcgccaaaggcctttgccgacagactatttgatgataaaggtggtcttcgccgacagattaattgttgccaattttgggacatggtgtagtgtacatgggtaatagtgtacataacatcgtcatgtaaatatatatatttttaaggggatatcccaaggcaaccgcctatgcgcatcgtgttattatgagcggccacttaagccagccacctgggtagattgaaatgattttcatgggtggctgctgttagctgtcccccacagtatttgtttacatgggcagctacttaaagcaacatttttttttattcttgtctgcccatgaaattaagggggaggggcctttgaaaatcgtttttctactattggttgcaagggtttcaaaaaaatacccatgtaaatgggttacatactgcttgtacacatgttttctgtaccggtgcaaacaaaaattaaacttgagaaaaaagtctaattcaatattgggcctttataggtacaaataaagatcctcaattgtgagattgtgggttt

SEQ ID NO: 100205 - DNA, 683 bp, Oryza sativa
attcctgcagccggttacgaaaaggaagagaggaatagaataattcatattatctaaaaatattcaatgttacatttaatgaaactaatttagtatagtagattttgataatttttttataaacttggttaaacctaaacgacctaaagtagtaaaatagtcaaatgacctataatatgaatcagagcgagtatatattaatattatttatcaatcaatctatctatctatctattatgtctttatctttatctattataaaaataaagatgattcgttacacacagttggttcgtttagtctgtcatctacaagtctggcttgggaatgcacatatagcgtgaagtccgtccatggttgttatcgcgggagaagcaaaaaaggaaacataatcgtatctagaagtccatatgccaccttcaaatgtactgtcctcctctctcctaccacaaaattttcatcgttgttcctcgggcccactcaatttgtccctttgaatgatgaatcactctttccaaggcgtgattttcttctccccttccccccttcacatctgctgcagtttcgccaagatcatttcctcggttcccctactcctaggacaacgaggatgagcaatccatgcatccagtaggtttgtctctaattggataatgacgaggaaaagccatatcattagcttg

SEQ ID NO: 100206 - DNA, 684 bp, Oryza sativa
attcctgcagcctagtcggcgaagaacttgacgctacccctacctagcacgccaactatcgaaacaagatttcggcaatactaaaagggggtggctatcaagctggaaaagtggatgggtttagaggcaaggaattttatacaggttcaggccttcttaatcaagaagtaatacgctactcctgtccggggattaatccgccgagtgtattattgatcgtatgatctgggagaaaaatcgtgttcctagagggacccggacccctccttatataggggaaggggtgtccgtattacaaaatacagtccatatccctaacggaatatgtaattacagataaaatataatcgtaaccgactaggatctcaggtatttccttgacatacaagtttaaaacctaacccgagtcctcttaaagatattctatctatacatggtaccctgtacccagtcggactatacatgccgtgtagatctagggtatctataatctccacacctctctagcgcaacggtcaagcataggcattgcatgcatatatgtcattaccactcatactctctcccgttccataatatattctagatggttcagataaggttgaggtcaaacatagaactttaactatcaattacttttagttgaagacactagaacacgagtatagatttctcttacaaatg

SEQ ID NO: 100207 - DNA, 678 bp, Oryza sativa
atattttttatgaaaagattatctctagatatgacataaataatatttatttattagttattaaaaaaatgtttatgtagcatataaatagatttgacctatacactgctatcatagaaaaaatgctacatatacatttttaataattaaaagtaaatattattccttttatgccatatgtaaagataaattttttcgtaaataatatatcccataaatataagagtcgcatacaatgaatatcaatattcccataatatactttataaatgtatatgattctccgtacacaggaaaaaaatatggccaactaataaaaaggtatggaagtgatccaaactaaatattgaggtatgcaaaggaattagtaaaatcagggacatacaagagattaggcaaagttttagaggtatacatgggatttcctcatataactactaacttatcctgaacctttgggatatttggccattcatgacttgttgaggtcatgtactactgtgataaatattatacacacacttcttcctcctcccttctccttctatatcaatagtgatccagcgtgatgggggcttgaacacccagcactcacgctatatctgcccgtgcacacttataatcttatatggcagctcaaaggcaaacaaagctatatttatttatatagatttaact

SEQ ID NO: 100208 - DNA, 673 bp, Oryza sativa
gggccgaaggcggttgtgatggcgcagatgtggaagcgaatggtcctcctccatcttcggccacgggcgccgaaggctctgctccctcctcggcggccatgtccggtccggcgttgctttccttccaccttgcaaccttctccttcacgaccttcttcggtggcattcgctctcagtggtttcgctcggaggtccccacggtcggcgccagctgttgtcgaaatgactaccgcatacgtcgaaagacgtggttactcaacggtggtaggaagaaaacgaagtgtattaaattttgagtttcccttctttcctttttttcccattacatggccctaggggactatttatagccctattacaggttcttactactagggtttaggttatacaagggaatttacatgattacccttatgaaagggacatttacaggggtacataatgatataggggctcatgggcccctgatgggccgtctggcgatcgccggccctattgcccctaggcttgataggccgaaaaggcttcttcggcccttgcgggggtgaacttgccaacgcgaagtcatcttccttcggcagatagtcttcgccttgcacccttcgcctgagacgcctctggcctggcaaggcactcgtacgactcttcgccttccgccgttcttgccccatag

SEQ ID NO: 100209 - DNA, 703 bp, Oryza sativa
cggttttcgaatcccggccatctcgggcgcgggcgcgagcgggagagagaggggaaagggcgcggagagcgcggcgcacgcgcgggcgtggtcgacgtggcccggagaaggcggaggcgtgggcgcggcgacggttgcgggcgcggcggcgcgccggaatcggcgggaggagggagacgggtccgacaggtgggccccacctgtcggcgaccccgagagaggaggcagcggggcggcctgggctgccggactgggcctcggcctgcggccggcccagcaaggaggagggaaggaaaaagggaaatgggccgacggcccatttgacaaaaaggaggaaaaagaaaggaaaaaagaaaaagaaaaggaaaaaggatttttccctggaataaaatattgcttgctcaattttaattggttaaaattatttctagagagctctgaaaattccactaaaaatcctgttaatgaattttgacatgtagaactcaagaaaaattccgcatgtcaagtctgattattatttgcattactttctttaagggtttctcctgatttcacctgcattttcttagggtcatttgcaaattaccattttgacttgggaggaaaactttcggggtgtgacaccttgcttgggtgaacaagcactgatcctagccccagctgtgaagtggaaaacctaatttccgatcacaccgcttgg

SEQ ID NO: 100210 - DNA, 559 bp, Oryza sativa
agctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaaatccttttttcaaaaaaaataattttatct

SEQ ID NO: 100211 - DNA, 668 bp, Oryza sativa
gtataaaacttttatcagtgattgtataaataaaacaactggcaaagataggtacgattttaaatcaaataaattaaaaagttatgtgacaacttaatttatttggaagtattttttcaataaattcaatttttaagtacttattttgaaaatatactagcgcatatttgtataagtatatttatatttttatcctaataactaataactgaaggtcaactaaactggatgtagaaatttttatatttcagttgatatttgagaaggtgaagaccacaaaaaaaatcttaaaggtaattggatgtaaattgtactactatgtgtagtataataattcttaaagattaaatttaatattataaggtaatatccatatgattactatgcaataacatactgacatcgtaaaaaaaagctcacctagcatatgtttagccaagttgatacatcaaaatattaaattgttaagttcttgtactagaacacactcacatgtcaagttgttgcattcggacgttcaattctcaagttcttatactatatcgcacccacctgccaagttattgtaccgtaggtgcaatttattcaaatatcaatctactaaaaaaatctagatagaaataaaaaaacagaaataaataaaagggaaaggagaaaaaggaaaaaaa

SEQ ID NO: 100212 - DNA, 581 bp, Oryza sativa
actccaattccatacaacctggaaaatgacaagttgcagtttttatttcagatgtctatgtgctttgcatgcttaatattctgttcactgtctgtccctttttttttttctgagaattgtacttctattttgactggcaggccaatctcaaaagttgctgaaaatgtctccagtaacattggagatgtcctctctgtgagtaaagcttctatttcctgaaatcattcattcctgtgatagaagtagaagttactgataagaaaaaaaaatactggattgcagtaatattattgggctggttagatccacatgcttaggagattcattgtgcagctttgagtggctccacttttcagtactggcctgtttccttctgtttgttcagatgtgcatgatttggactttttggatggcagctgggccaaagtgttgggtggggcttctgattgctttcacctttacctgatgaaccttgcccaattaggtccccttttactggtgcccattcatgacaaatctagattaagtgtggccacttcacttcccacaagatgttaagctttggtgatgtgttcatagga

SEQ ID NO: 100213 - DNA, 567 bp, Oryza sativa
atctgatttagctggaaaattaaagatgttttttaaggtacttttacactgtcaaaatcagagtcataagaaagtaatttcaaacatgaatccaataatatccttttcttatggtaaaacctaaatattattggattaatagttcgtcaaagctcttcaaaattggacagtcaaaatacaccttatattcctgaacggaagagtaatgaccttcttgagggtcaaactactatttacatgaaaaatacccacgggtgtgtatagcagcagtcttgagttatccctataaaaggtaaggtttctgcccaaaccctagctaatcaaagcctctagccgtgccaggacaagcccacacgacctgagaagatcgcactatccttggtcttatgatcaaccatatcattagtgtgcaaagcaaaacaacaaaagaacacctcaccccttcattctctctctcaatttctttagttaagtggggtacaaacaggtagcattaaattaattcaattgtcctgcaagagtgattatatatagataaagaaatcgcttgttgatctagcttgtgta

SEQ ID NO: 100214 - DNA, 608 bp, Oryza sativa
agcatgatttatacagaagataactgacagtgtcagaccgtagtcgatttaacatcgggaacactcgcataattgatattgtataaaaattgatattgtataacagacagcgtcagaccgtgcttatccctgaagtcaatatccggcggcgtgtcttggcatatgtaggcttctatgttggggcttctatgtcgattgtgttgggcgttgatcccttcatggtggatgtctgtccccctgtcctcctaggggggcttggatttatacccataggtgttcccttgtccaagtggaactagggaaaccaatatggatataattcgagtagcacttgtcctttccatgtagaactctggctgcctttccttatctggaactccttcgaggtcagtttccgcataagacatgggatgtgggggatcctgccgagatttaatcaactactattaggtatgtactagggatgtggtatcataaccctgacaaaatgtggggaaaaactaattgcgcagtttgcatgtaaattgtgagacgaatcttttttagcctaattaccccatgatctgacaaatggatgctactgtaaacatttgctaatgaccggataa

SEQ ID NO: 100215 - DNA, 595 bp, Oryza sativa
acgacgacgacgatctggacccgacgatgacgacagtgcaggcaccgaaatctgcgtcggcggaagtcgccggcgcttcggcccagcgggaggaggcgagctcggcattgagagaggaggcgagccggcgacgagagagtaggcgagccggcgacgaccggatctggtgggcgccggcgagagagggtgagcggcggcggccggggagagaggaggcaaggcggtggcgggagagataggaagtgcggcggtggggttgccggcgagagaggaggcgaggggctgccgacgaagacctttggcgaggggcggccggcgatttcgagaagaattttttttcctttttctcctttcccttttatttatttctgtttttttatttctatctagatttttttagtagattgatatttgaataaattgcacctacggtacaataacttggcaggtgggtgcgatatagtataagaacttgagaattgaacgtccgaatgcaacaacttgacatgtgagtgtgttctagtacaagaacttaacaatttaatattttgatgtatcaacttggctaaacatatgctaggtgagctttttttta

SEQ ID NO: 100216 - DNA, 555 bp, Oryza sativa
acaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaagtaaaatgtgaggtatgggtagtcttatgtttccacaaatcttaaaccataacagcatagccatttattttcggtgcgcagctgca

SEQ ID NO: 100217 - DNA, 649 bp, Oryza sativa
caagtctaatgcaccaagtaataaatagtccaaggattaacatagaaccaaatatggtaaggatatagattcgtaatattaatattattgtacaacagcatatgcttcactaacaaaatataaaaatgatgaagggaggaagaggactagaaagtttcacaagtatgcttcaaacaccatcagcatataatgtaagtttattttaaacttaatttatatacacagctactaatcgattttgcagaaatactcttgttaattgtatgtaatattttttaaaatttccacactgcagaattcaatgatactaactactagcagagtttgtgaacaagacatgctgctgaaagacagaaacaatgacctattaatcccaagcaaacattacagttaccaagaatttgatgaaatctacaacaagtgcaaggatcacaccagaggtaaaaattgcaattacaaaaataaattataatcatttttaaatttgtatgagtagtatgctaacatttcatcaaaatatacagattccagttgacaaaactatggaggaattgtacaaattacaaaacacacatttgaaatcacaggtactttcattaattaataatttaatcatgttaaaatgatataggctacatatcaaaaattt

SEQ ID NO: 100218 - DNA, 1813 bp, Oryza sativa
tgtatgtattggtcgcgcacggtaagtacgtgtcggaacggaatttggaatagtgtcttggtaccctgcacgtcacaaatcacgatgagggaggccggatcggactttggaggcattggttactgggctgggccgaactgagtacggaagttttgggcccaattagtctcggctagttaatgtatagggagtgtctagcaaacaatgatttttggctagttaatgtatgatttttttgcaactcgtggaagttaaatttgatcagatttatcacatattaatctatcttgttaaattttattattttttttcataactatttggatgacatgcaaacgagtggatgtccccttgagagtaatagtttctcctcagcacggatatgattcatttagtctgatttgggttgaatttggctgatggaatttcaataaatgtgtccccgtatatttatcccaattataatcgaagtacattgtgtatttaacttattttcatcctaacaatggttccatatgaggatttgttaaacttaggagcttaaagagtttctgttttgtattaaggccttgtttagatcacaaaaaattttaccaaaaacatcatatcaaatgtttggatatatgtatggagcattaaatgtgggaaacaaaacaaccaattgcacagtttgcatgtaaattgcgagacgaatcttttgagcctaattacgccatgatttgacagtgtgatgctatagtaaatattagctaatgatggattaattaggcttaataaattcgtttcgcagtttacaggcggaatctgtaatttgttttgttattagtctacgtttaatactttaaatgtgcgtccatatacttcaaaaattttacacccaaagaactaaaaacccactaaagagaaaaaaagggcgatcagttaacgaggaaagctgaccaaattaaaaccatagggaaaaccgataaactctgtagaaaggcgaaaattaaaaaagcatgcgatgtgagtcaacacaagtcatcattcccaactctatagaagtcatcatcgccacattaccaagatgagaacattcgagagttattgttatcgagcttgtcacaccttgtcaagtagttccgattccatcccgacacactctagtgtgccgtatgaactacgaagtaaacaacaaataccaacttaaaatttgcagcagatttgccatcatatatactttactctaactcagttgaacaaattaatccattttagaaaaaaaatgaattaaatcaaaagagcttgataaacccatcgctaattaagagatttgcttcagtccaacaaaaagtttctcgaggtactgttacctcacggagtcacggtactaaatcgtttccgatcattagatctagctaggcaagatgtgcattgttagatccaaagatcaaaaacgatttggtaccgtgaggtaccggtaccttaaagatactttttgttggaccgaaccaaatctcgctaattaatgttcatggctatatcaccctcaacattgcatgagcaatgttttaatatttactctcgacgtgatcggacgatcctttcccacatgtctgcgacgaccaacggacacgccctcttgagattaattgctccatgatctaacaatgtggtgctacagtaaacatttgctaatgatggattaattagatttaataaattcgtatcgcagtttataggcgaaatctgtaatttgttttgttattagtttacgtttaatactttaaatgtgtgtctgtatatccgatgtgacacccaaaacttttcaccc

SEQ ID NO: 100219 - DNA, 1741 bp, Oryza sativa
tgaaacatttcatgaaaccgcaacaatagtaaatggtttttatcacaaaagtgcaacttcatacacttgatgaattttaggcccgttagtcaactctggcacgcgcaaaactcacgtcgttacgtgtcggacccacatgtcacatgcatggtgagttaaaggtcacagttaaatcgtttgctaaagtcgtagcttttcccaactaaagttgccgtgaagaaaaacaaaacaaaacagagggttgcagagatgctaggacaaatctggattcgaccgagccataggggtgggcgttcggtcagactaaaaaattccctttggtttctcgggtaattcagtctttggaaagtcaggaccgaatttcataaaaaaaactcaggactggcaaattcggtcttggactcggtctaaccgaaatttcaggagaatgaaaaattttgacagcacttccctctttttagaaatttttcacagacatatatatcacaaaaataccaaacaataggcaacatcaagcaccaaattatcacaggatagatctcaagtctgaacctcacaagtcacaacagccacagacccacggtacaaggcggaggcgggatggaggcccagaggtgggatggaggcggagggcggaggcggcggccgcggtgctggcgctggaggcgaagggcagaggcgacgtcgaggcggaggcggcgcccgtgctggaggcggagggcggaggcggcgcgatgcaagcgaaagcggaggcgtggaggcgacgcgatggatgcgaggcagtgaggggctgagccgctgagagacctgagagcgactttactcggttgctccctctagggtttgttctatttagtgggcttattaggcctcgtacacctgttaggccaaatttcagttttttggggtaattcggttaacggaagcctatgaccgaattacccgaaaaaaattcggtcttttgatggctgatatcgaatcactaaccgaatttctcggtctcggtctcggtcttttcggtccaggtcttcggttcggtcttattttgcccacccctaccaagccacattgcttcgatccggcttgtaccacctgtcacgtagcactaagcactaagcaggtagtaacgaacccaaaataaagtgtgttatggaaatagatgtgcagcggagacacgaatttttacgtggaaaacccttttgggaaaaaaccacgggcgccaaccaacaataattactattgaggagttggatacaaacgcagagatacattgggctatcgtaccctcctagtgcggcttacgagggatatacacaggagaaaactaggagtcgtcgtgaataaagactaagagttatactagaaaactaatctaatagtcaggttctattagaatactataatccaaatatattgtgaacccaaaattcaaatcacatatttaaaagggaagaaaaacataaacaaaaagggaatatgaaaagaaaatttcttggcaactccaacgtgtccagcgcctctggactcgtatatatgtatgttgggattcatcgccgcagaatatatcccaaatatattttgagattcatatccgaacctacttttgccgtcgtgactggttcgaactccaacaccagaaccgttctgacctaagcctgccctgccctttatattatttatatacacgtcggtccggcaagtcacgcagccgcgcaacaaccagagcaacaccagctcgatc

SEQ ID NO: 100220 - DNA, 644 bp, Oryza sativa
cttcttcttccactgaatacaatacaaacagaagtatcagatcacagaaagttaactgatgaaaattagccgataagcatggtagcatagctaagaaactgcaaaagatcacaacacagtagccttctctcaaagaacacaagggtgaacagaaactggaacgcagaagcaagaagcaacatagcatcacagcaaatttagttgatttaaattcattgcttgggtgattcaagaatgccagcatagacattgttgaacaaaccaactgaagtaggggcatcatggatggcaaaatggcaatacagattgacaaaatacagaatgacaatttcatattacaaagtctatcaaatcatgaatgaatgattaagatgtacttccctggataagctttgcaccacaaaaataactactatgaaatggtaacttaggtaatcaccgataatgcagttatgtaactgaatttcatgttcacagggaattgaaagcattcataatttcctactgaaactacagcaggaatagcatatagacagtgagcatcacataattactgatcaacttaacagctactattagtatataatagttataatttcctacagacagtactacggagtattatttaaacagtgagcaccaca

SEQ ID NO: 100221 - DNA, 649 bp, Oryza sativa
aatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgtaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctggcaagtcgactagggtgtgctctttccctagtttttccaactctcccatgtcgttttttgtgcacacgtttttcaaactgctaaatggtatgtttttttttaaaaaaaataattatatactaaagttgttttttaaaaaaatcatattaatctatttttttaaaaaatatttaatacttaattaatcatgcaataataagtgtttcgttttacgtgccgagaactaacccctcctcgcgaacgcagcctaagaggctctaccatgcaacatatcatgtgtttgttttttgacg

SEQ ID NO: 100222 - DNA, 545 bp, Oryza sativa
cgatagaactcagaggaatctcatgatttcacacaataaataaagtaacacaagctcacaagcactactgctagacacgcaactccgcttgattaaaagcagcgccatcttaacctgagctttataatctcttcacagcaatataaaaatataaatcctgtgctgcaaattccccacaattatatcaatcttgtgctgcaaattccccataattgatgctcggataagctacttttgaacatgttcacgccacaagcaaccaaaaaaaaacaactaaattagcaaaaattagcgccagtaaccgctgcgacggcacgagatctacacaactacgcgcgtgctcagatccacccaaaaaaggccaaaaaaaaaaacacgaacagcacacgggggtgagtcagtccccctccctcaccttcggagatggcgtgctggatctcggagcacttctcgacgacgttgtgctcgttgagcccctctcctcctcgatgaggtactcgctgcggcgccgccgtccttcccggcggccgcgccgggggacccct

SEQ ID NO: 100223 - DNA, 639 bp, Oryza sativa
ttctaccgtataaaaaaataaaaaggtccgattcctgtacgattgcctcgaaaaaggactttttgtccgtaatcttctcttctcttctacttctactatttttttaaaagaaacctctactattataaaaaatttaagatgttcttttgtcggtattttggtatgtcatccgtgtatgagtcggtttataaatttgttcgcttttgaaaaaatatatatcctttgagttgatttttaagttcgtccgcttttggaaatataggagtcgtataaaaaaattcgcatgctgactttagacaaacagactcctaaccacagcttatgattttatagaaatatatagatccaagcgaattctcacagtgaattaagactaaaatagttgtcacccgttgcagcgcacgggcttttctcttgaaaataaaaaataaaaatattaaaagaacacaatacgatattaattaaaatttgaaaaaaaaattctaaaattacaaaatgaaaaataagttttcaatttggaatacaatttataaatagctaaagtttatgataaaaataaagactattgaaagaaaagaccatctaaaagacatgacgagataaattaagtacaggcctataatagagtagagtggtggc

SEQ ID NO: 100224 - DNA, 622 bp, Oryza sativa
tttattttcaagagaaaagcccgtgcgctgcaacgggtgacaactattttagtcttaattcactgtgagaattcgcttggatctatatatttctataaaatcataagctgtggttaggagtctgtttgtctaaagtcagcatgcgaatttttttatacgactcctatatttccaaaagcggacgaacttaaaaatcaactcaaaggatatatattttttcaaaagcgaacaaatttataaaccgactcatacacggatgacataccaaaataccgacaaaagaacatcttaaattttttataatagtagaggtttcttttaaaaaaatagtagaagtagaagagaagagaagattacggacaaaaagtcctttttcgaggcaatcgtacaggaatcggacctttttatttttttatacggtagaagtttttttttctcttttttttattttttcttgcctttttttctccacagatagtcggactttttttatggagtcgggaggttttttttacatagaagttctttttctcctttttttctggttttttataccggcaaaaacatcttcaatttttaatagtacagaattcaggtggttcaaaaatgtattcctacttga

SEQ ID NO: 100225 - DNA, 548 bp, Oryza sativa
caaatatttttttaaggacggtaaaatttctcataataaaatttatggtctccttagtggttttcagtttaacagctttaagctgtaatttgtttctatgtatttgtgtatattcttctttgcgtctgtgtaggctagctgtggcgttcaagaaggcacttgggtctagcaattgccaaacgggccatagtacaaggaaatggactggattgttttttttttcttttccactgggcgatgccggccggaatttatgaagattatgagaaattggcacatatgaacaaacaacaagcctgatgtattcaatacagtagacaacacctatcaaatttgcaagatacctggctctacctttcatccttcgtttttgatcgtgtggcttccaatttcgactgtcaattgtcatatagtcagttactatgcaggatagtagaatggagaacgtttattcagttatactagtatcttgctaatacctgccttttgtttgaggattctaccaggtccaatctataatcgaagggtgtgtttagttcacacaaaaa

SEQ ID NO: 100226 - DNA, 694 bp, Oryza sativa
atgcagggggaggaaaccccagggaaaaagtcccgtacagggattttcccctgtaccaaccgatccccttccacctccagaggaatcactcctattaggggaattttctctactaccatttgggagtagggggagggggttgatgggggaagggggatttagagaggcaaactgctaaatagtgtttgaacaacaaaacatgtctttagaaatattatagaaatttcaggaaaaatagaaagaatatagaaaatccatataaataggaaacaacctaaaaaaattccagaaaaaaaaaataaaaacataaaaaaaatcaacaagtattagaaattcagaaaaaacaaagaaatatagattagtttatgtggaaaccaacttcgtgacatgacataagtcaaactttagaatcatccatatcatacaaaatttagaatctttggaatcatccttgcatccacaaatatagaactgtacatcatatttatatagggttacaatgtcttgatcaagaacacaatttaaatctttatctcttctatcttcttcatcatctcttctacaaatcttcatttgttctaataaatctgccaggatgaaaaagataatctgaaatttaagtaataaatataaaatagtgatacttcagcaatcaaatttgaaggacggccattgatactagcttaggaaaaaa

SEQ ID NO: 100227 - DNA, 1107 bp, Oryza sativa
agtgttttgaccaagaaattttatgtgtttccatgtgcatgttagaagttgaatcatttgataatgttaagaccagtgtcgtgttgtgttgtgttgtgttgctcaatattagctttggtactagccagtgattcactgagcaacggagtagttaatagcattggtcattatctcaaaaaagtaaactgaaacttaattgagctggtcaaaattggcatccttgtgatcgctatgaaagattatgtttgtaccactgaaaaatcaggaagcatatatagcgcagtttccatgaatctatgttcatctaaaaaattcaatcccaaaatctcaaagcgcactgttattacttattaatactagtagcagcactgcagcaacactaatactaacaatgttattatctgaatatttcaggtactgtggtatatgcaattgaaaaagctgaatccaagtgtttttcttatctgtgacttttagtggaaaactgagattctttcttttgtttttgtcccagctcatttacatttctcttggactgctgtctgtacacatcacatatcctatataattttattgtacagttcatgtcttggagttgtcattttctaatagtttggactgatggataaaactcaaacatttctatcattggaaggattcaaaacatatttattgatgtggattagaacacttgattgtgttgtcatagagatcgaagatgcagtaaaggagtatcctatggcaaaagtaaacattacacataatgaaattcattgcattagtgtatcacatattgaacaagtgcctttatgtgctaacctcctttgctagttgtaaatttcagggtttcaacaattgcatagacatcaattaaaaaagaaaaaaattgaacaaaatgtctggcctattttcttctgaaatcttgtaattaatcatgatagctgtgccatcactaaagtactgaaatatataatgagtcatttttcccacaaaatgctagatctactagcactaaattattttagtgcaaataatactaaaacggcatcacattacaggactatatacacctcttataactctatttatgctgtatagctctgtaga

SEQ ID NO: 100228 - DNA, 620 bp, Oryza sativa
tgcatacataatgctatacacaatagatcattggtttctgtgttatattgcattaagtggctgtcttgtttatcctataatcattttgctgcacatacatgatgcttgtccttattttagtggatatctcctgggatcttatagtagttacccagttcccgcaaataatttaattgctgcatacggttaatccatatttatcagtatagagaaccatgtaccagtcaatctagcagctgcaactgccctgttcttactgtttgcgaaaaaacattttagaccctttttgtttaacttaatgatgcattcttgcattacttatttctttttttgtgataaatcgatcaaattgattgtagaagaaagacattatcgactattgtttcctattctgctccatgtctagaccaccccattcatttagtcagaaaaaaactatacaactgtcacccttctctgcttgtaagttgatgttttcttctgttgaggatgtgtactgtgttgcgaacaggttaaggacaagtcaactggagcagtgtatgttgttgctgaatctaggcttgggcaattgccagccaaggctaaatcatctggaaagaagcaagcaccttctaagggag

SEQ ID NO: 100229 - DNA, 578 bp, Oryza sativa
acttaattagtcatgcgctaaatcttcgctctattttgcgtgttgtgggccgggggaggggttccaatccccacaaattgtacgggtaaaatcgaaccatgcttgaaaaaatcgactacaacacactgcagcaaccaattgttatatgttaaagtaaaatatcgaccacaaaagaagagtcgaacttagcgttaaaaagatggtttgcagctgttggttggctgcacaagatagggatgtacgcatgtgattagagattctttttctataagggtccaacgatccatgtcacatattgtagccaacaaatcaaaattttgttcgaccatactaatcgaactagaactgcaggtaccctaaagctgacaagttgtattccattcgaaagaacacccttacagttacatccactatccttgggcatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctca

SEQ ID NO: 100230 - DNA, 605 bp, Oryza sativa
ccaactgatcccatgtgcatattaaattgaaatgtacatttttagtgatcaagtatttttgtttaaagaagtttgtccaacttgttttaatgtggtttgttgtatagtcagtggttaatgaaatgatattatctaatggagttcatgatctgatcagatttatatcttcagatgatatgtcagtttctaaacattattgtatatgaagtttttgaatgttggtttttttttaccaaattgatgtttttgttctctgaaaaattagtgttagctttcatttcatttgtatggcgctacaaatagatttgtatgaagttacaggataaaataatggaaattacagttgtagttacattggaaatatatatgaattacaaatgtaattttaggtctgtggtgatgtaagttgttcttcaagtcaagtataattaaagtcaagttagttacaatatgatttgactgtttttacactgcagttacatgtcagtataactgaagttacaattgtaacttcacatatttcataatgtaactttctatagttctttttatactactgtttttcttgcaaaaatttccaaagttttgcttcttagtgttgcatg

SEQ ID NO: 100231 - DNA, 704 bp, Oryza sativa
attaaattgggctaagtgagtatgaaaacaaaaacacagcataaaaggcaaatctaacccataaactggcttcatccaagtgacatgcaaacatagtatgtaacacatatatgactactaaacatcagctcttaattaatacctatgaacatgcgagataatcattccggtcaaaatgatatataatttcagatcctactaaacatttggagttaacagccaactaaggtaagctacctgcctacttggttcggaaacaaattttggctttaccattccttcagagaccactaaccattatccagaaactaaacatatatcttacgttgatctacacatttttttgagctttcaacagttcaacttgcagtagccttgtctcaacatttaactctacgcaccattaacaactacggcccgtttggttggagggagttttaaagagggattgagagtttagagggatgaggctattaagtgttttgtttggttgggagacatgggaattttggtgggattgggatggagaattgaggaagaaactcccttcttttcaatacctgggtaggggcaggtcattgggagggaattcctcgtttacttgggctaagcaaatctcagccatccgttcttattaatgagctaatctgcaactaaacttcctatgaatttacatcacatttaccaaacaagacattgggatt

SEQ ID NO: 100232 - DNA, 641 bp, Oryza sativa
gcagaagttcatgtgcctaatgataatgtgttacctcattctcctattcataatgcttttcatgtaagttttttttgtcatatatagcataatttatttgcaagttttatttatattatttgttttttgagttcttgaattgaaaattttatagggaaatgaagatgcttttgtttctaaatctgctgttgaacttaatgattcaagacaatgtgatgatggtaattttgtaccaaatttgttatgttaaattatactgttaattgttttaatcatgcattaatatttttttaatttcttcctgttagatctgaattttgttacccctcaagttggtaatgctaatcattccaaacagtctgttgatgatcttttggatggtcagttaccttaagctttttttcttttcggttactgatttttttacttgtgaaaagttttttcaaatttatctgtttcaacttattcacttcggaatgttttctcaaatttaactttctataaatttttgtaggttctggaattgctgctgcagctgctgctattcatcgtgttgcaaaaaaatttaaatcaagatttaatgattatgggaatgtggaaaaatattttaataagtcaaggcccttatttagtttgctaga

SEQ ID NO: 100233 - DNA, 532 bp, Oryza sativa
ctaatgttatgagatacacttacagttatgtcttccgtgtaattgaatagggaaaagagaatcaaacgtttttttttaacctttttctatgtcatataggctcacacatcaaaatagcttcgatttgcattatccgaaagagccattcccatcccaagtggtggcccgattcggcctgctaaagagtgtggaggttcgagtcctcttcaaggcataatatatacacctgtcatcaaatttactagttgaaattagttaaaatcacacaaatttaaaatcacaaggcaaaggactcgatcccgcaatccccaacacacgcctatcccactaagctacgagcatttttgtgtatctatatgacactttacatgctagttacgagcataattgtactgtagttacattcatctgattttcgtgggaaaaaaatccgtccaatgatatatactcagatggtcctaaatttttatggaataagttcactcaacttgtggccgagtttgaatttcgtcatcaaaccataataccaaat

SEQ ID NO: 100234 - DNA, 549 bp, Oryza sativa
atgttctataattttccgtatttgaaggtttgatttcttagtgctacattgttgtcagcatatgatacaggaaatgacctagtcagaattatgatgcttggcctgcaaaaagtaaaatttgttggttaccagtattcagaatagatagcatggagactaccaggataagttttcaagtacctattggttaacttgaggtgcttgttatatagtatctaaggttattttcatctactgaaacttaggaatgtggtacgctttgcataggtaccactgttgtttgcttgtgaacattttgcagattatgttgataccacaaaaaggttgtaaacagaagcagtttgcaacgatcacctagaccatcgtttacatcctgttggattaatcattgcctttctattaactggagtaatcgttgtctttctatttccttgataactgcagataaaattttcttctgtcaaattagcaaagatgtacatgaaaagagttgctatggaacttcaatacatgggacctctgaacaaagatccagctttggagtatatg

SEQ ID NO: 100235 - DNA, 628 bp, Oryza sativa
aaaatatgattgttaccatttatttagtcccaacatgcatgctaaattgaccactaattctacagttccctgacagagactacaagaatggattagactaaaaaatgcctccagaaaaaaaaacttgatgctagcagctcaaccagtactaagatctacctctaggttaacagagctgacagcatccaactaaaagaactgcatctctaattaactgcaaaaaactgttactggtttgcagactaaaatttctcatatacctcaccagttgaatgatcctcactgcatgtgtgataattcctcatttcttgggactggtgcattgatctcacatatttagactgcactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatactacaatgtattagaaagaacaggagaacagattacaactctcccaaaccaaatcaagaaacataccatacatacaccaagaaaactgaagtactgaacgaaccccca

SEQ ID NO: 100236 - DNA, 532 bp, Oryza sativa
cagtatcatgtcatgtgcatgttttcaaaacaagaaaacatgttaagccatgcaaggtttgcttgttccactgcatgcgtataacaaaaacccgcagtcaggtaacataattaatctaaccaaggcggtgatgaattcttgagtacaattgctggaatgttttgtgttgcgtcaaacaatatatataatatgtgcggccatgaacgactccaaacctccaaaattaaggaggttactgccttactgatcacgttgcagtgtttcttggatttgcatggtagctgatctcagcaaagccctaactgaaatataccataacatgatgtcaatgaggggtcggagttttaaactccgaactcctttgggatctctgacggccatttgatcacgcttgcgtttgcgcagattgaacagtgaaccgatcgagtagagagagccacggcggactcgtcgatcgaacacatgtgacatctcgaaccactttacactgcatctctgacatgccgcgcgccggacttgtggcaattcgtca

SEQ ID NO: 100237 - DNA, 580 bp, Oryza sativa
cttttttttaaagcttttcttttcttctttggtgccatcgaaatgatttttaaatatttccaacatcttgtaggagctcaaaaaaataatccaaatttataaaatttatatccttccaactgttttcaaaatcctgcatttcaatccttgcaaaagaaaccctgcatttcatcgctttctccgtgtataaatataaaatattttttgaacgactataaatttaaaagatgtttgtctataagttgaaatttgtggtttcaagacatgtttttaccattcctcatctaccaactttatactaccccttcccaaactaaagtttgtagtttattcctcacctgccaatttatgtgcaaatttatttttctaactacatgtcttatgttataacttgttgtgtcaataatttctcattttttttaaaaaataatactatgatttcctaggattcgttcttatagcaaagcaaagatagaaaatatgtcgttttgtacgcatatgcttccaaaacagctaaatgatatgttttttttggcaaaaatatccattaagaaagttgcttgaaaaaaccatattaatc

SEQ ID NO: 100238 - DNA, 533 bp, Oryza sativa
tgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattgttagtggataccacctatatagaaagtatagatttattgtggtagtatttttatttcatatatatactcctcgtatgcgtcttaatctacgtatgtatactgttgtgtaaaatcttgtgttgaggatagtgctctctatccatttgcaggctgaaaacgtgtcctaggtaa

SEQ ID NO: 100239 - DNA, 1187 bp, Oryza sativa
tactgtagttagtatcagatatgtggataataaggcaataaataaagccatgtttgatgtccgagggactgtttagattgtagctaaaataaatcttaccaaatttaggtaaagttgttaaatatatgcatccatttagttcattattaaactctgataaatacataagaaatcctgtcaaaacttaacaatattgttaaattgctaaaattttagcattaataaaatttaataatatttattttaactataatctaagcaggcctgaaactttactgaaaattcaacgaaatactactgcctgatcttgttatactccatctgtaatcaatttgtgctcactgtcaaagcttcaagtactgtcctgtcaatctatcatgactccataaatgggtacttctaaatgctactacttcctcgatgccattttaggatttaaagtttgtcctaaaaaaacttctcattttagagtacatattcatttttgcaacaggaaagatttgaaatattattggtggaaattggctggtcacacatgtcccatctccactgaggttctctgcagtactgctcactaacatgtgggccccacaaatcctcgggcctacatgttagtctgcagtgctgcatgcgtagtactgaagaggatctgaattgtatctaattattggcaacatggaaattaatctcttggcaaattaagtcaagctgcaccgtctccaacacgaaatgtaatgccgacacgcaatggcaaaaataatttcagatgtatatgcttgatattaattaggacacgcatatttatattatgttcagatagagaagagagggcccgtttagtttccaaaattttttccaaaaaacatcacatcaaatctttagacacatgcatagagtattaaatataaataaaaagaaaaaactaattgtacagttatggggaaatagcgagacgaatcttttgagcctaattagtccatgattagccataagtgctatagtaacccacatgtgctaatgacggcttaattaggctcaaaagattcgtctcgcggtttcccggcgagttctgaaattagttttttcattcgtgtccgaaaaccccttccgacatccggtcaaacttctgatatgacacccaaaaattttctttttcccaactaaacacacccatagtgaaattgcta

SEQ ID NO: 100240 - DNA, 790 bp, Oryza sativa
tatctatataccatttaacgagggatatcatagtttttcttttcaaatcttaatatatgccaaacaacctagaattacaattattttagaatggaggtagtatttgatgagataagttgttgttaagaaaagaaataggaaagtggaatgaaatccatactatgcttagaagatgagtctgagaaattttcaaaatttaaaatttaaccaataagatgactgagagggacccccttaaccttagtatttaacatacaaatggttgcattttgggattgatgaagtatgaaatagttttctcacaacattgacttccgtgccaaacttgtccacgagtggtgcatggtaaacgcgcgtgtgtacgtctattcgtctactctgtaagttcacttttgtatatggaaattgatataggtgaacttattctgagatggaggtataccaattagtcggataaaaaaaaggtgttgcatgtatacatattgtgtttcaacatatttttgttccaattttgctatatatttatcgacaaattttctcccaaaaatttgacatatataattacactacaatcgtactccctccttttgaatgtgggcaatgctagaaagtcttataatatgaaacggaggaagtagtgtaattacactataacttgcacataattttccaccgttatattagtttcaagatttatgcaagtgaagaaggaaaaaggtcactacgcgcacacatgtaagaggatttgttccaacaactttcgtttcatcgaaatagcatgttacggaga

SEQ ID NO: 100241 - DNA, 550 bp, Oryza sativa
ggttaccaaccgggagtaaaagacatttccccaccagtagaacacagccatattgatagagtacagctaatgggtgggcctcaaaaaaaatatgtataggacatgatcaaatagagcccatgttggcaaaagaaagctccaaaaaaattactctcccaaaggttgcaaccccgcgaggtcttgggttcctgcccttcgccacgatacatcgtcttcgattatctagatgattattattggcatcgactataaacattttaacaacatatggtaagtggtaagacatagaacactctgattacacactgtctttggaagaatttctgcagagtactactactactaaacaagcaaaacatcaccagaattcaaggccagtacaagatcaggacacggccggaaccataataccagaaataacgagcaactaattaattgatcgactcgaacaatgaaagaaattaagcgctaactaagagcacccacaatagttatctatggctctctatgagagattcatgtcggtatatttttctacttagaagagatt

SEQ ID NO: 100242 - DNA, 715 bp, Oryza sativa
cagaagaagagataatagaagaagtggaaatagaagacccagatttggccaatactaaaggaagaaaaccaaaaagatatagaagaatagtggagaagatgatagaaacttcaaaaaggaaaagtaaagatgagcaacacacaacagaaacaagtaagtgtagcaagatcaagaatccacatataactataaattgtagaaataacaagttttttttgcaggaacaagtgagataaccaatatagggaacaagcaagaagagatgaaaacatcaaaaactacaaaaagaagtaataaacaaatcaattataatacatatacaaaaatgaaactatatataatgaaaacctaatgcatacttcttttttgcaggaaagaaaaacaatactcaagaggaaactcctaaagagaagttgcatgcaaagacaagctgaccaaagacattggaaatgaaaggacaaattgaataccatcagtaatggaagaaaaaaaaaagagatctttcttctatgtaatagcattcagactgtaaacactacaaatgttgtataattgtttttctcatactacattacaagtatgtaatatactgctagagtgctacattatatgtatctaatgtactgccagtagaacaaatatcctcgtcatacaaatttttgtcacacaactcatttaagaaaaactgtgaaatgtatactgaaacactggtcaa

SEQ ID NO: 100243 - DNA, 513 bp, Oryza sativa
cttctctgttatatttgaaattgcagccttttatttcttttcaatcactccctgaaactccagacaatgatacttgcaacactgtcattaatgaaaaccctggaactagtgcagcacataattctcagaattcgaacaagaggcttttttaaagatgttacagtaagttatacttttttttaatgttcttacttatgtttctcgtaacttcaaaattttctttattatgttttttgatctgatttttttttcaatttttcatttctttcacagaattctcctgatgttgtttgtttgggtgaaaataaaatttgtgattcatcaaaaagaatgtgtgttaaagctggacagttatataattcaacaaatcaactgaacaagtacattcgtggaatgagttcttctggcggaaagcttcctatacatggtccaagaagggttttagttcctgctaggcatgcttctgatccttttgtcttttctccaaggcgtcgttttacagtttctgatcaa

SEQ ID NO: 100244 - DNA, 640 bp, Oryza sativa
agatcaatttggaatggagggagttaggcataaccacttttcttatatgttacataatagtactactagtataaggcatgcatgcaagcatccaatttactatgacatcttctctattaaattactacttttttaaatcctctactctcatattatctaattctattggatgcatgcattatatttattaggatgatccaaactacaagataataataattatttcttgctctttgggttaatggaggttgcgctttatattttgaaatggacggagtacactgcactgataaatcttaattaatctggtttgcactgcatattacaggaagggaaaccaatatagattgtgtgttcggcacctcattttcccaatacatctccatcgtttttcgcgcgcacacttttccaagctgctaaaatgatgcgtttttttgtaaaaagtttctatacgaaaagtgtttaaaaaaacaaaataattccaatttttttaaaaagatagtgtaacacctccgcttttcttgagacattaaaaaactaattcgccaaatacctaattgcgaaaatttcgctcttggggtgcgagtctaaataatgccaaggatctaaattcaaattctggtgttccctttcatcgaaa

SEQ ID NO: 100245 - DNA, 946 bp, Oryza sativa
ggcaatgatcacaggaagaataagtaggagatggatagattagggactaattactcaatgacctggattagcacagtcaaaactaaagtgtactatgcatcaaattggacgcgataaaaagcatattgacacaaagaaatgtatacagtttctgcatacacaatttaacgtaatgttaagcacagcagtgctgatgaacactgaatgactggatgttgtttatggttatttggttttacatttctattgcattatcagtacatttaaatttactaactgtggaattagactgcttcagtcataaatcaccatacaacactgctcggcaaatgtcaggcagtatttcatctaaaaaaaatcataaatcaccatattacgatttcgattgttcactcttactggtgaggatgcaattaacaattgctagatgcaatttaatttcatgattatgtagtctgtctacgtacctccagccataaaattttttgcactcattttatagcttgctctttgaaggtgtcatacatattgctagtgtatgatataacagggccattaataatacagttaggtggtttcacatatgagcatgctgaaaagagggtgcactgcattcagagatatgaccatgttgggggagtacacaattcagtcttgaatttatttacttaagctataatttttttagtagtagaatgatataaaaggtaccaatcctgccatgtgctagataattcaaatggtgtaagcttgcagcaatgacgatttttctaggaatacgtggaaaactggaaacctcaattttatcaagattcatcattctctgattcattgaactgattggtctgaaaaattaggtcttgttagctcatgggagagatggccgtatgcgatattaatgaaaaattgggcactgaagctgacttccttaaaaatagggaaaatt

SEQ ID NO: 100246 - DNA, 633 bp, Oryza sativa
ggggatgcgatgtatccggttttgcggttgggggacgattttgtaactcgatgacaagttgaggaaccgagctttttccgagcggagaggatgccaaatattaagcccaacccagaggtggtgatcgagtcgagtcgaaccatccaaaagagagaagaagaagcaagccccccaaaatccctagcaatggagaaggagttagatggggagagtacatgtgctgctccatgcgagaagaagcggctgattccaagctgtttcgagtggggtacggtgccggcgacgaaaaagatgaagacggaggaggatttggaggtgttgctggcctatccatcgcttggcgaagggaagaagaagaagaaggtggtggtgaagaggctgggcaaggaggaggtggagaggctgcttctgtgagcaagaaggtgctgggcagcgacgtggtgcctgcacggcacaacgagatcctgctctaagagcaagtatacttgtaggctataagccaactataagcttatgtgaatgaaagagaatttgaaaattggagagggttagctctcatacaagagctagctattcacatacttcaagataaatacattaaatgtataggtaagagatagagagaggaggaga

SEQ ID NO: 100247 - DNA, 2721 bp, Oryza sativa
ggaggtgggtctcgggatgagagcggcggctggggtgaggctaggaacggggtggcttcgagctcactatggaggcggcgaggtcaacggcgagctccatgacctaagctctgccgcccctattgtccccgccttcccgagccgagcaacgcgaggcgcgagtaagaagaggagcgagagggagattgaagaagaagaggtgcaaggacctccgccgccggctgcccgagcgagctccgtccacctccgtctgagcttctcgcgaaaggccaaaggggagaagaaggcatcagcgaccggatttgagggaagcggctcgctccgcctccgcctccatcaccggccacccgagctcctctcccctgctctctcatccttctctcctcgaggtatgaagacaccctcccatcatcgacaacagtggagcagcgccctcccagcaactccgccgcctccagcgccattctcggtgcactcctccgccaaccgcagacgccgccgccagtcggccgcccgagctctttcctcctccgcctccaccgccggccacccgagctctctcccgtctccaccgccagctgcccaagcaagctctacctttgctgtcggccgctcaagcgagagagagagagagagagagagagagagagagcagggggattggggagggatttggttgagggaaagggatggcaggtgggtctagggagtttttttatcttctttgctgactggattgccacgttggcgccacgtgtgcaagctcaagttaaaaaccgcttaaaacagtgctcaggggggttatttgttcggtttgcatagttaggggtgaaggatgtctggttttatagttcaggggggtaattcgatcgaccacgatagttcgggggggggggggtaattcgtactttttccttaatgtgttcacgtgttttttccttgacgacaagatctactcatttagaagccaacaactacatcgactctggatttttactttgaatttcattgtttgtttactttctacgttgtctaaacctaacacggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcaatttcagtctattactcaagatgcataagcatgtctaaacaaactctctttgtaccataattttcaaaatcaactggaacaaaaagcgagaggtgagaacatgcatagcttaggaggagagggggtggtaatggttgaagatctcatccatgcacgtccatccattttagctttggtggccgctccaagaaacttcgggcagcatgcaacacaccatgcttactatctctatgcaataggtgtaggtagtagtcaacacaacttaatttggcagatactatatctgcgatacggttcatctaccttgttctcacctgaatatgattgatgacatattttgttttttttgccaagcttttgaaagtctagtgacacactacacgcgtgacttggtcgatactaataataactgaggtacgcaatcatgcatatttattatatatatatatttcttggtttggaactaaaaacaagtggagtactagagacaagcctttagtggcctcatcatcaatcgtttagtgattgaagtggtctctttatcactgtacataatggcagcaagcatcaagcatatatatactctcgtaaccatggtgcccatggaagaaaatggcttaaagaaagaatggaagaaaaatggctcctagatggctagccatttcaagcgaacaattgaacatacacaaagccaacacaacaaagtttttaaatttcaagttttgtatgcatgacttccatattgtgttggacttatgagtgatcagtgcaacctgctcgtgtggaagcatctttattgaatgttgatccttactgaagtttaggttcaaattagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaagcaaggctcgaatttagatgtcatatgtgccattgttgtattcttttcttaagggttcaaatttggaaacacgtacgttcaatgcatatgcgttgtttcgattttagttcaaattgcaggggaacaaaatgtgtgccaactgtcttcttggttgattatgttatgccactcttttcttggttgtgcatgaacaactaagcaattacttaaatcaaactatatgtgtcatgcttttgttgttatgtaattaatgagcaaatatattattttaattattcaattccaagcatcaaacctataaatgtccattcttaattcaaaatccagactcataaataatgatggaagacactattactttaacgagtagaatgcactgctctatgtagaaaccttaggtgtaatcaataaatcactaaacaatactaacacattgttttttttacacacaa

SEQ ID NO: 100248 - DNA, 667 bp, Oryza sativa
attcttaaaaaaaagttattttaaaaattatattaatttattttttaaatttaaaataattaataattaattaattatgtgtttgtgacttgttttgttttgcgcatattttcagtcctctctaatactcttctctctaacacaacctgctgtgagattgcccctaaattatatatggttctgcagatggcgggtaggtagggatgacagagggggaaattagttgtactaccttgtaagtatgattaggattctccgacaacgagtgatcaaattaacaggaattaacagttggatcgtgtggcaaggagggcaagcacgtgttctttgctccaacaaaaagttggactccaaccaaaagttggataaagattaagatttttatggccacgcttttcaaactgctaaacggtgcgttttgtgtgaaaactttctatatgaaagttgctctaaatatcatattaatctatttttcaagtttttaataattaaaacttcaatcaattatgcgttaatatcaccttattttatgggaaaaaaaacataatttttatcttcatcttcacaacaaaagaacaccaccttatgtgctgcaaatgtttgctatcctactaaagctttctatacttaatccattaatgggatgtttgccccggcttgctgcatg

SEQ ID NO: 100249 - DNA, 512 bp, Oryza sativa
acctaccctggacataagaaagaccatacaacactccaagcaagcaaggaaaagtaaaatactggaatctgttttggagatgtgttttatgccacttataccatatgaggaggcagccttgacacaatacggactatattccttgagttatggacactacattcaccaaagcttaaaggttatcttaatgcaatttacgtcatcatttcgagtatcatttctctcgatgaaacctttttctcttaagaacatttctgacagggggacatggggagtttttccttttcactgtatagaagggataattctgcctaattgcctgatcaatttttagaactcggagacacttgtgctattaaactgaagcctttttttttgacaatttttaggtgggagagcttgttaaaagagctgttccggttgcactctcaccggagaacgattcaagaaaagaagagccgaagaaagctcatgagaagaaagaagagatcgacaagctggcacacaagcaa

SEQ ID NO: 100250 - DNA, 587 bp, Oryza sativa
gccaaaattatgtgccctaccaaatttttggcaatttgaatagttctttggttagttttggtttgctaaaaaaatgccaataataacacataggttgccaaaaaaaatggctttggcactaccaaaattttttctaggttttgatattttccatattaattttgacatggtagcaaccaaaacgctgaacaaaaaaagaagaccagggcacacactacaagattcatcccagcctcccgctgtatagtaggtgaggtgaaatatatgtactccctccgtcccatcattttaagtacagtcatagttttccgcgtccaactttgatcgtctgtcttatttaattttttttttaaaaaataaaaacataagtcataagtaaattactattcatattttatcatctcataacaagaaaaatactaatttaaaaaaattataaataagacggacgatcaaagttgagcacgaaaactttgataatagctaatgacactcgatggttcagtataataatacagatacatcgatggttgaggagatcggcaatagcttatgacactcgatgattcacatcgctaataattaat

SEQ ID NO: 100251 - DNA, 958 bp, Oryza sativa
cgggagctcagctgactgctcctctaaactcctaatcaatggcgatagcagcttagcaagaggaagagcaactgatgcgtgtctgcaactctgcatgcatatgcatggtgtttatggttggggggtttacttgaagccagcttgaacacatgtgtagtactccaactacattggtaagagagtacaattggagtgagctgcgttggatggatgtgatgaagaagagcgagacggcacgaggcaagcagcaggtggtgaggctgcaaaatgagaaggaacaagagcaagtgacgaaagaattggacagggagggaccaacaaaaggagagacactttccaccccgaaaacaggatcgatgcatacatacatcgacgatcgatcctcgcgtggagtggatcgacgagtgaagaagacagtgccagaaagcctgcctgccttccggggtccaatgcacaaagcaccctctctacctactgccatctttgccccatatccccccttgacccttcccttctcttgttatgcgtaccagattacgtagcctcataatctctcatatcctgcgtcaaatgaacaaggcaaaatttgctacaaaacatccaaaaaatgtgtaattagctgtacgacactataaagacgtgaatttgcttgaggacactctaaaagtatggtaatttgcttgaaggacgctagacgtattaagatataatattcagtaaattgatgagagagacactacgtaaaatgacagttttgccctttttttcttatctacaattgtgtcacaagtataagcaagattatacaaagcagcctgactgatccagcaagccagttgctgctccccggcagcggcgacgagctggacgagccctgcttagagagtgagttgatgctcccgtggcttgatgctcgggtacatgatggcgcgcggcaacgccgagtggccgagcccta

SEQ ID NO: 100252 - DNA, 1008 bp, Oryza sativa
atggagataatagatggagatgttgttggagtaaacaagagtttgacttgctaaattagatggagagttggccaaatagacatttggagagtcagagttggagaggctgttggagatgctcttacagcaagagctcaaacttcttgagaaatttccttttgagtctatctctcatctgattcctatatttttcctacggggcgtttttcttatggtccaatcaaacgatcattcatatgttttacaattctttgttttacatttgcattactgtcaaaatcctatatttttttattcctccgttttttagccatacgattcaaaaggcctaaacatttggcattcttctcctcaaacatttaagggactgctaggaacatagaattaaaatatcatgacaccttaaatccagataaataaaaaaaacatagaaaactatggaacagtttggacgaagcacaggaaaacacacatgatttaaaatagagaggtgcctcccataaaaaaacatgcaatccatatgaacttcaaaggaacccagagacccaatcattcgtaccaaggagcctcataagaatttttctaatgagatttaaatactttgaaatttcacttttttcatgtgttcaaaaggagctctgaaagaaaaaaatagaaaaaaaataagaaatggattgattctagtgaattttcagtaaactcctcggtccaaaggagttttaaaaaatgttcatgtttccccttaaaaaccccctttcacacctcgtccatttcatttaaaattgaccagttgaactgatcaacaaaccagatgaactacatcagcttcttgattttatttatttatttatgtagtactctcttacttttacatttaaaatgtaatatgttatagtcttatcctaagtcaaaattctataagtttaatcatgttttgaaaaaatatagcaatatttttttatgccaagtaaatatattataaaaatatattcaatagtggatttaatt

SEQ ID NO: 100253 - DNA, 596 bp, Oryza sativa
  unsure (1)..(596): unsure at all n locations
agtgtgggaggttggtaacgatcgctatttttgtttttaatcggtggttacatgttgcggagcaggagattgctaattgtagggacggatttaactcgccacataagccattggatgaaaatatctaatggttaaaagagaattatgtacaatttagtggataaaactattacattttatatcagtatatctctactatattatacaaattgaagatgtttccgctggaattttgatacgtcattcgtgttggtttttcagtttgttgtacatcgtctatacacaattcgacgtaagtatagaataactattatacactctcctcctatctcaaccactcctnctcccagcccaccccaactggcccacaccatcctatcagcccatcctgcgtgccttcactcagagccgcaggtgccactccccgtatcaangtcttttttctttcctttttttcggtttcttttctcttgatcatactgatcctcttcctattctttcaaactcctctcttttctctccatgatctcttccttcctcttaggtatctctttcaaatttttggtattaataaaaaattttgttttgatattatc

SEQ ID NO: 100254 - DNA, 647 bp, Oryza sativa
atgatacctttgaagtagatccctggttaacaatggtgtatgttgattccttcacctgttacacgatttggatggatcttcttcacatttaccactttgggattgcaaaagagcagttccctggtggttattttttcgtataaattctttcatgtgtatctttgctcgttgtataagagctatactgtataacttgagtgttcactagcatggcatgtacagatgtcttgcctcaaccgcaagtattgggtgattttctttcttcttcaaggcctatgtaccatgtcacaccaatgtctaaggtttgagatctttgcattttgtacatcggaaggattcttgtatcatcagtttgataaaagataggacatagagctaaaacagcttcaacgtccaagcattgcaaaaccagaatagcgtgattgcatactgcaggctcatctacctttacattttggcttcagcactcaggacatcctgtaaaggtcactcattcacatatgcctgtttggtacagctccaacttctaaatataactttacgaaatgggtctgtaatggagatgtggagctgtctaaacctaacttcacaattctaggtcatttgtgagaaaacttcactcctagtttttgggggagctgaaactg

SEQ ID NO: 100255 - DNA, 649 bp, Oryza sativa
ttttttaggtcgcgatagatatctctatcctattatatggatataatgctcgggtagattaaattaaaaacttatgacaacaaaatatttatacccgcaaaatagtttgaatcgaaattgggtttgccttatttcgcgaataataaagttaaaataaaggaattgactttcgcattcgactttcatttggatttatttggattttatttgaattctaattgaattcaaattgttctttcgcacataattatagagaccgagggagccgcggatccgggtgaaggtcaagaccacgaagaccttgagcaaggcaagtcatcactattcttgaacatattgatcccaattgcgaaattgtttttgtttacaaataaaattgcatgcaaagatgaacatcctacttgtgattatgccatgccttgattattgtttaccccttattccttcataaccatgtttacgtatgagtccctagtcaactatgacaaatgcttagaaatgctattctagaatcaagcatactaatatttgtcaaatgctatatgcttgggcaattacctttgggaaggtaattgagatgccgcatgtggagacatgagcgccacattgccatgatattgaggacatgatctgtgaaaggagaaataaa

SEQ ID NO: 100256 - DNA, 1403 bp, Oryza sativa
agagagagagagagttttgtggaatccaatcaaccaatacgccgctcctcctcttcactctccaagcaagcagagcacaagaaagaaagcagagtgagtgtacaagcgcaagaacgcgctttgctcattaacacaccacactccccgaggatggaagacaagcgtcttcttcgtcttcctcgcttgttctctgcctgcccctgcctagcttaatgtggaactaactaggagtattaattaattccttccactaattaccaagcggcaatcggcggccacggccagtgaggtcaccgtccgctccgacgacgacaagctgccactgctcactgctctctcgagtctggaagcaggcgttgctcggcttctctcactatgaagggccaccattccttgccgccgtcgacgccgcccaagcgccgctgcactgccctggccgccgccgtcccggcgctcgtcgtctgctccatcctcctgcccctcgtcttcctcctcggtctccaccgccccggtacctcgcctcggatctgttctgtaccttacctacatatacatgctgctcacctcatctcctgcttgtcttttttttcttaactgtcagcagggcatggatcgaaggagcgcgccgcggttgtcatcagcactgtacgatttcatcaacacatttttccccttccttctgaattagaacatgctgcatttcgaaattacttattccttttttaatccggtggggtgatttgtgcgtcattttaaattaggaattagggtttagcaagcacaagcatctggatgggagaatgaagcacaagctactcaaggtaatgctgcttgctgattctgcccattggctgactcataattcttagtcatctggattttttttttttttgagggaaggctcgcgcccagctttactgaagaatttttccaatttgacattctgtcctgccaattggaagatttgtgtgactctggagtaagaactgaccttctgaatataaattcccaaatttccaggcgggttttatgggtaggtttctgtagtataagaaaaaacaagacggcatcggttcatgcactctgcgtgtgtgtgcagtgtgcttgctgacgctttactgcgttctgccttgcttagcaggggtactcactctacactgtaagccagggctttgttgctattctcgtattgccaccccaaaattgttctttgccaatgtcactgacaaatggacttggactgttgctgctgtgagcaacatttctgctgaactgcacatctttccatttcaactggtcatatttctcttgtgtttttcttttcggccttacattattgctggctttcctcctaactgctgttgtcacacctaattttcaattaacatgttgttgtgaaaaat

SEQ ID NO: 100257 - DNA, 1657 bp, Oryza sativa
atgtgcaaactcctggtcaaaacagcttaaaacagtgttagggggtaaattcgtccggtatgaataattgagggtgtaaaatatctggtatttgagtttatggcagtaattcgatcgaccacgatagttcaggggggtaatttgtactttttccttttcttaattcttcatatccatccaatttgatgaaagagtgaaaacctttgcagaataatatagtcatcactatatgtctacatctattacattggagtgccgttgtcctgcctatggcttccttttagttggagtggtcaaaagacctaatattcttggagcactcataaaagctaaaatggatgaacatgcatcatagacaaactcatgctgatataacatgcatttatctttgtctcctcatatatatgatcctgtatgctagaaagattttgccattaataattagatgggtcatattatcatgattgaagatcttaataagaatttatattaaataaaacatgtcattgaaaataccatggatgtttttagttatagttttcacataaattggaaattcaaaattaataatacgaagttgaacgtgttctggaccctcaattttatatcgtattaatttagttccaaacttgaaaatttataattagcacattgtaactgatatggactgttaggtacaagtcgtaacaattcaagaaatactaatgtggatagactcttcttttaatctatgttgctataatttggaaaataatcaacatatttgacaaacaattaaaatttgaatatagatagcactaacaacaactagttatttctaaccctttatgattgatatttgatacaagcgaacatgtaaaagatttgagcgccaatacatgcgttcaaatataatggaatatatttgaaaggaagagagttaggatagttaactttttgttggtttgtctgattagttagagaagtaaatatatattttggtcatatatatgcatataaaatgttaagtgctttaatatatatatatatatatatatatatatatatatatatggtttatatatgcatgcagcaacagggccatgcaaatgataaaaaaaaaggcagctcgatctttagtcccggttatttcatccgggactaaagatagcgatctttagttccggattggtagtcccaatttgaaaaccgagactaataagggtttctccaccagtgagggcaggaaggccacctgcgtttgtccaagttgtcggaggtcaagcagctgccccgagccgccaggtacatgaacattttacagcgaggagagaccttagccccccagactaactccacccatgccgcctttgttttccccatgaaaaacatggagtaagctgaggaggaggagtagtttccgtcggccgaaagcttccacacaaagctgtcccgggaatccggctgtagctgaattgcctcaagccgatcccacaagtgcagcgcctgcatcgaaagggcccccttgatgtcatggacggacggacccacccatatgagagcaagctaagatgttaggggtctaatctgacggccggtgacagaaatggaatcctatattttacaatcaactgattttgttttttttacaatcaactgattttctttccaagaaaat

SEQ ID NO: 100258 - DNA, 633 bp, Oryza sativa
actcccacggtacaaaagtttccatatgtatgaagcattagtactcaagggcgtgcctacgttatactacccggtgtcataggacaccgggtagattattcaaatcctatataaattacactatattaattaatatattagtcaataattagataattagtatgtattggacccccggtaatttttgttctgggttcgccactgttggtactgctgccccttgatcccttgtgcacgcacgatatgcatgccctgcatgctcatgttcacgtgaatatgctcaagccatgcacgagttccaaagctgcagcttccctgcccttgtttgcatgcaattgctcgatttggttttgcttcttgcctttgctcgttagtctttgcacgccatacgtataagacagcacctgtgctatctgtccgtgcctatgcacgcaccgcagtcgcagccctcgtgttcaccgtccatgaccccgtcgtcccggccctccacgtccgccgcgccgcgccacgctcgccggtttcgccctttcatcactggcctcctgccgccgcggatccgcgatcaccacgtgcgtcgggcgcgccgtccatggcgctacccctcagatctctccagtcgccttcggccacgcc

SEQ ID NO: 100259 - DNA, 755 bp, Oryza sativa
ttaagcaaataaaataaagacaggctccgacacagttatgccacacaccggcataaccatgccccacaagatcccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctctttcaggcggtgatcttctggctgcggcagacgcggcgacgcttggggtgacagacctctccctgggcgatcttgagctgatgcagctgtgcctccactgcgtctaggtccttcttcagctgcagattctcctgacgcagctctaggatcttcaggttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgccgatggagaggagagcggcgctctggcaagcggcggagaaagaatctccacccgcggtgactgccaacgaagtccgctcgggtgagcca

SEQ ID NO: 100260 - DNA, 589 bp, Oryza sativa
catcccttcacctccgtgtcgtccttcatcatgggttttgtccatagcaacctgcatcaccagctatgccggtctctaccctggcgtcgtccatcgcatcctccgcaagtgacatttgctatggcctccattcgtaggcactgtccttatctcgctttgtcggcgttctcctcacctccttcatttttgttcttgtgtgcggttaggtcggtccttcattcgcaaggtagttcggtttggttttttttgccacttgttaattcaactgtcatattttaaaaaaaatgttttgaaatgctaaagaaattaacctaaacaaagaaaccaaagaaaccgactaataaccactacaataatttgatttgattactctctttgttcacaaatatataagcatttctctgagcttgtagcggagattaagttcaaggtgaaactactttggtatccttgaaagtttatttgacccaaaaagatcgtgctagcgacaaaaaaaatgtaaatgtaagatatatatcataacaggatttggataaattttatatgccagaaatgtttgtgggtaccgagctcgaattcgccctatagt

SEQ ID NO: 100261 - DNA, 555 bp, Oryza sativa
gtacacaaatttattatgattctgttcgacaagaatgactcaaccagcaacatttagaactataaatgataacaataagttctcaaggacacctaaattggttgccttgccttcatggtttttgcaagtacagtgggacatatctattgcagtccactactatatgtgaatctagtatgaactgtgcatagattgcagccatttcaatttaataatcaacattggtggcacttagaactagaaagctgagaccttttggcatgaaaagttggtcatgatgataagaacttttagctcgttcatagtgatccgcaaaccaaatggaggagaaatctttcccacttctcggatcaccaaagaccatggagaagcttgataccacagaaccactagaaagttgcaacctttttaagcctaaaaagttagccataatgacatacttttagggctccaaaacgcaaattttttttactcttccttaatcatcctatggactatggtgatctagggctagtactacaaaccactgatgtgatgatgcatagatagatatac

SEQ ID NO: 100262 - DNA, 1259 bp, Oryza sativa
tacacggtgccacacaattttcacgttaaatacatacctggagtaaataattttaaagttattgattggtaaaattctaattgtttcacctctcatccttaactaaaatatctgtaattacggaaccgaaggaagtagagacagtgtactttaataaaataaaatttttcttttattatatattattaaaaaatcgttgttaatatatgttttggagaccatgtccatattaaaagtgttacagtaagaattataaatttggagggagtatacatctaaatgagaaactgtatgggttagctcctgcgtaaaaatcgcctgtgtcgaagttgtttgagatgtccaagaactgtcagggatatcagatgtgctcgacggccaaaagttttgcacatacttttctataattatgtcatcacatcagcaccatgatatggaatctgcaccacaccaaactaaccatgaaactgtcaattttttttctactatattgctatcgtcatacatgagtactaaactagaagcattgattagtcaaccttttccaaagaaaagcaacataagcatgtgcgtaactagctagcaagtaaagctaagcttgggaaggaatatataggaatttttaactgcctccataattacttgcagagaaataaaacttctgaagcagcagaaaagaatctaagcacgtcttctttctctgtagttaagcatgaaatttcaagtctgtttaattgtcttccttgatgattgaaccagtcagccccaacatctctataaatagttcatcttgaaccataatttacttcatccaaaatcaaatgaagtcacctgtccatctcgaacatccatttggtacacaaatagttaaggataatatggcgagatcatggtcgcttcttcttcttccatttgcgcttgctttggttgcttccgttgctcaagctgctgttgtggagtacactttcaatgtaatattctatctagttttcatatacttccatttatgcatgcagttttttttcttctattttatcgcatatatatcgcaacatgcatgaacactgttatctttaattcatgagatagggcttttggctcaagacgtagacatggcataaaaaaaactctcctggaatcaaatacataaattttaatactatttcctgcagtttccaaatatggactattattaatatgtttaagaatttagtttgaaactgcaaaactggtgtgacaagattcttcacattaacata

SEQ ID NO: 100263 - DNA, 1663 bp, Oryza sativa
gaggccgccgcgtcatcgtccattgccggtgccccattatctactgttgaaaccgccgccggttgccctctgctgccgaggccgcctcgtcgtcgtcgacgctgccgaggtcgccactcgacgccactgtctttgtctccttcgccgttgtccgcctcgcgcgcgggggatccaccgccgctggcgctgtccacctcgcgcgcgcgaggagccgccgccgccgtcgcctcagccgtccgcctcgcgcgtgcggggatccgccgccgccatcgctgtccgcctcgcgcgcggggagccgccgccgccgtcgccatccgcctcgcatggggatgcctcaatgaggagggagaagagattgaggaagagaaagaagaacaagaagaaagcaatagaggctgacatgtggatccctttgttattttggagatgtaaatggagaggatgttggagtcaacacctagtttgattacccaaatcaaatggagagttagctatatgggtatttggagagtcaaatttagagatgctgttggagatgctctaaatttggccagttgggagaggagtttggccagtaatttaacttggccatctgagtagagagtctgttggagtgctattttctgctgaagttaccaaaatttaacttagagagtcagatggagaagctgttggagatgcttcaagtttcctccaaaatccacgtacaatgagtcattccataggatttggaaaaactttaatcttttaaatctaatggccaattagaaaaattttctatagaaattaaatcctataaattttctatataaattatttgattcaaagagctactcctacaattgatttttggaggttagttttacaaagttttcagtttttacctgtagtgtgaaacttgtacacagtacacatgatattgacgaagccattattacatgttaagtgtgaacattacaacagggacaaacatcggtccgagtaatcaaccatgggaaaggtgaaaaagaaaacgaaaaagaaaggatacacggagcccaagggcaaatgacacgctggtactagtccagtagactgcttgccgttgcctctcttcccccataaattacccctcacacaatctcgtgatatgctcctgctaacctctccctcttggtctcctcctctcggcctcttcctctttactccgcttcccccttcgcgccatcgcctcgcttgcgccgcgccaaatcccataaaaattccacccaacacaagcgttaggcctcccgcgcgcgcccgtccgctcgccatgctcgcggccgcttccccttggcgtttgtagatgggctcctcctccctcctcctcttcccctcctcttcctcctccgccacccactcctcttattctccctcctcctcctctcatgccatcacctccttgctgcctcctctcccctccgaccaccatctcctactctacctagaccaccaagaacaacaccacctcgccgccgccatggtccgcaagcgccccgccttcgacatggacctgccaccgccgcgccgccatgtcaccggcgacctgtccgatgtcacggccgccgcggcgccgtcgtctgccagcgcgcagcttcccgcgctggccacgcagatcccggcgtttcaccacacggacatggac

SEQ ID NO: 100264 - DNA, 1388 bp, Oryza sativa
tgtcccatagcaaattactatacttttggagtgtcctagagcaaattcacgctttttcgatgtctcacagctaattacacatttttttaggtgtcatgtagcaaattttaccgaacaaacgaacaatgagcaatggtattgaaataaacatattctaggcattaaacatgaggtggtttttctatccttttgggatgaccaggtgggtcaagcctgggtggtcgatgaagggtattttcttagtactatcttcgtctcagaacaaaaacccaacctagaattgggatgagacacacacgaatcggggcaggcttctctctagatatttttgggacggaaggagtatgtttttaaaatggttagctcaaacatggttttttaattaatcaagcctgaaatattattttttaagatggtctaatgctaatgcaagtagtggagagaaacctaagctgtggtgtaagtgccgtgatgggaagccgcgtgcgtgcatctcggggcctcgggccagctgttgaaatcccgacaaagaaggatagccacattcgattaagggtgagcacaaattaactaaagtccataccgaaccaagcccgtacggaaatgatgctcaatcggccggtaattgatcatatttatcatttaaactattcaacatcgatattaatatgatgtagaaataaattagaaaaaataaaaattataaatagctaaaaagggtatgtttggaaatggtaccccttatacgaaaacgtcgctcggtcgatcgggaaattccatgatcgttttcacccttaccatcaactaaggcccatgaaagtataaccctaaatccctaagacatccagcgctagcatcgcaacccttcaacgctcacaaggcgcggcataggtaccttgcacctaccggcctcagcaatccatcgaattcatcttctgccactacgtctttagtcttgctctcctctctggccactgtgaccttcatagcatgtcttgttccccatcccttcacagctaactccctccgtgtcgtccttcatcatgggttttgtccatagcaacctgcatcaccagctatgccggtctctaccctggcgtcgtccatcgcatcctccgcaagtgacatttgctatggcctccattcgtaggcactgtccttatctcgctttgtcggcgttctcctcacctccttcatttttgttcttgtgtgcgggtaggtcggtccttcattcgcaaggtagttcggtttggttttttttgccacttgttaattcaactgtcatattttaaaaaaaatgttttgaaatgctaaagaaattaacctaaacaaagaaaccaaagaaaccgactaataaccactacaataattggatttgattactctct

SEQ ID NO: 100265 - DNA, 614 bp, Oryza sativa
ctagtaacgtgcttactattttgtgatgtgtgtatgtttctactccctaaatacttatctgcatagagtcccataatgaacctaagaatacacaactcgtaagtgtttttcgttctaatttgaacctaaacttcagtaaggatcaacattcaataaagatgctttcacacgagcaggttgcactgatcactcataagtccaacacaatatggaagtcatgcatacaaaacttgaaatttaaaaactttgttgtgttggctttgtgtatgttcaattgttcgcttgaaatggctagccatctaagagccatttttcttccattctttctttaagccattttctttcatgggcaccatggttacgagagtatatatatgcttgatgcttgctgccattatgtacagtgataaagagaccacttcaatcactaaacgattgatgatgaggccactaaaggcttgtctctagtactccacttgttttagtttcaaaccaagaaatatatatatataataaatatgcatgattgcgtacctcagttattattagtatcgacccagtcacgcgtgtagtgtgtcactagaccttaaaaagcttggcaaaaaaaacaaaat

SEQ ID NO: 100266 - DNA, 572 bp, Oryza sativa
gcatcaaacacacaaatgtcaaatttgatttcacaatagtcaagtcaacgaaatgatcagaagaaaagaaattctgggttgtagctagttacgggtcatcttccctatgataactaaaaacgtgcaattttagatgtcgacagtctttggaattcaccgttgactattatcaaaaacacaaactctgataaaaatcgtatattgtgacatattttcaagcaaaaattactgcaatcatctgcatatgcgtataatttaaactgtttgaatatttacattgaaagttttaacgagacattaatttggcattaccacgcgtgtgatacacttataattataattaatagtactccctctattccataatataaagttttaaaaactaatatttcactaataattataaccatatgaaagtaaattcaaattttatctataatattattttcagcaaataaaatttagttcatattatattgattgttgatcgtgctttaaaagttgaatcttgaaccacatgtgtgtcttatatgatgggatggagagagtatatgattttgtgcaaatatata

SEQ ID NO: 100267 - DNA, 536 bp, Oryza sativa
tcctgtttaaacagaaagccattcatggcattggaccagaaataagaagctgccgacatcagaggttcatccttagccatattggctgcagtcagagctagggcttgggctatcccaatttcctcccagtgagaacccttgctagccgatacccttttataccaagccggctaactcttctaagttgatggccatgacttaaaggtattttttcaaagacttaagtttggattggctagtctaaaggggatcctattggtttcggcattaatgaactcagttggatccaaattgtcgatcggaccaagaaagtactgattgggatgaactaaacttgggattgcgatctgatgagaaaggttctatagaagaaaagaggaaaaaggcagattgagcgaagaaagaactaatctactgcaagaacaagggatctagccgatggggacttacctcggggaattcagccgatggtgcagcaaaaggaccagcggaagttgacatcgtcgcgggtgagggcgccactgcagggaagtcgc

SEQ ID NO: 100268 - DNA, 569 bp, Oryza sativa
gcaggtttcagaatataaatgtgtgccgtgtagatggtttcacagttgttgaaaacaggacgttgaatacgttttgggtactgtgtgtaatgtgtgggtgtggcttgtggaattatacactttgtgggtttgcatatcagtggacacatgcaaaacaaatgaaagcgcatgtggggctgttgtaattggattactccaggttattgggtgtgggggagatcttctggtaattgaattattatcgtgtttggttgcaaagaaccgataggggtgatgaaagtgatgacagtagtgtggtaatccatttactacgtgcaccaaggatggtaatccatttactacgtgtgccaaggatggtaatgagacatgcacactgaatggcataacacagttaacgaattactggtcaatttccacgcattaaaaaagaactgaagtgctcggcagagagattgttgtaattaggttacatgagttgttatgatgcgtctaaaatctatagtaaagcaattattatcatcgttagctgtttaaacttgttgttgacagaatgatggattgtgtctcaa

SEQ ID NO: 100269 - DNA, 755 bp, Oryza sativa
caacaacagacgttcaacaacaatctcggcgcatcgccaccctttaactttcattatgatttcgacgagttcttgctttcaggttgagctgcatcggtttcgatcttcaactagaggtaaaacttgttatggcggcttgcgttctcgggattagtgcttccatctttatgatactctaatcttgtttatgtaagttgtcgagttatcatgtatcttatataatctccgacaatatcgttatctaacctccaatcggctaatatctatcgttaggaagcagccgattaggttaaatatcgacgttggcttagattatataggatatctaccactctatgaagcttccaatagcttgattgtctagatattgtctttctttttatacttatggctgcattagttgagtttgatctcataagtcgtgtttagaactatagtctcaagcctgcttcttggttgctgattagagtagcatcgagctttcagccgatcttacctgatttacctttatgtcttatatgctcaattgttatgctaaatatgccctttatgttaagatcctattgcatttaggtttattaagctctatgtttggtatattttacttgctttaatatcttaatatagagtagtatcagagtattagccgatacacgctagatctatctgatgggctatgctatgagcatctataatctcattgttaatatttatttcgatctaagtgattgtgatactgcctaaaaaggggatcc

SEQ ID NO: 100270 - DNA, 732 bp, Oryza sativa
gaaacctgaaactttgttctgagattatatggtgatattataataataatttacaaaacagagggtagtatatgaaactcttgggtgttattaatagtcaaataggtgcttaccaagtctacagtagaaattgttttattctgtttcagagcatctgcaaccttttcagctccctggtgacattcatattaatttatgttacaaaaccaaacaaaatcaccttccttctctaaaaatgccaaacaaagtaaacataattacataaatgtgtacccatttgatacgttggatcacatgtgaaaaaccatgtatatgaattaagaaaacaagtaaatctcccgctctttgatgtactatggagttaaagagtgatgggggtagcatcgaattataaagtataaaataagaactggagcatcatgtatatgtcaattttacaagaaacaggatttaggcaagaagtttaaacctaagtaactaacagcctaagttctaaagcagtactctatttagctcatagttccataatagcagaaattatatattggtttggcataagcatcattaaatgcttaataaaatcttgcgggtgtttgataagcaaatttctctagcttgatcatgtcctattatatgtagcaatcagaaaatttcagtcactggcataaaacagaacaggtaaatgataacagaagtactacctcatcacttatatcgttcatgtatagactg

SEQ ID NO: 100271 - DNA, 593 bp, Oryza sativa
accccagcaaactgcaggttttgattatgtttttccaacttgcaggatcataagtctattttctgttaaactgaaagtcaacagtgcctcagtgaagcagatagcacagaaattgcagcactattgggggaagtgcctgtaaattgtccctatgaacacaatgaagtagaatttctgatacagcaaccaagaagataaggatatgcagcagagaagaaatcacagagcaaccacaccagaaagcttaaggagatgaggcttccccgcaaaaaaaaaaaggaaaaaagaatggatgttgatcaaatgtagactgtaaatcaaaatcccagaatccccatgtgcaactaacagaaaaacaatgttgaacatttggagcaaatgttgatatcggattttaatcaaagctaaacccgagagtaccaaaatgccgatttggagacctaacaagaatcaacatttgcaaccagaacacccatccaaaggtcccaataagccataggtcatcatatatagcaaaaaggaaagacagtgcttttgtcaattccccactgaacccaccaacctagagtcctagagatcaggggaacccagaa

SEQ ID NO: 100272 - DNA, 760 bp, Oryza sativa
ttgaagaatctactcaagtgtggaaatgacagaatggttagtcctgatactctgccagctgactttcaggatgacagattcaggacctttgtgcaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacatggcagatttgttggccttgcagtattcctggaatgagtaagtgattggacagttctactccactgctttctttggcaccaccaagaaggggcttgattttgtgaagtggaccattcaggggtagcagtatagggtctctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgttgtactctatcttcaggtggtctttgctccctaaagtgggagatgctacagctcttccaggtaggcatgcgctcctcctcagtcgcatgcgctacaacaagcccgatttcagcatcatgaagcttatctggagtgagatctatgagacagtgtgtgagccaaagaggggctgcatctatgcttcttatatcatgaagatgattgaggccatgactggga

SEQ ID NO: 100273 - DNA, 1571 bp, Oryza sativa
agagctattgctagcctctcccaagtgtttcttgccttctccactcaatctagagcctaattcttgtgagagagattgagagggagaaaagaagatttggagatgtgtgaagactaggatcttgggtgagcacttggaatatctcatgggctgtcatctcggtgcttattactcttggagatgatctcctagacgattaggtgtcgcccgcgagaatccgttgaaaattgtggatgtctcgggtaagtttgtgaaggatttcctctcctccaaaagggaacgaggtaagttagtgaagttcttgtgctgagattctagaggctttcaaagtagagcaacccacacttgtggtggatttctagaagtaggttgagttgaatcttggtggtcactacattctagaaatttgcctaggggtgtttggggttgaaggctgtggatttcctctgggtttttgcacaagtgaggcaaggggttaatcgagacccagctcttggagctcctcaacggagagtaggatcacaagattcgaacttcgggaaaaaatcgctcttgtctctttctgtgatgtttctatggatgattctgtgatatatcctctgcttagaatacctgtgcaccatcttgtgaagattggcttagtctcttgtttcgaaatttaaatttcatctctgttttgttacccggaagttcctgtattagaacaccggaagttccgggcctgggaggccggaagtttcggagttccttaccaggaagttccgggtctgtttgaattttaccgttgcgatttgtttttaagttttcagggacagcctattcaccccccctctagtcttcatcagcgcgttcaaatcctagattgttgaccagagaacaaccacaacatgctgggcaaagtgtcaatcggctgactcaggagcaggttgctgcaatgtttttaccaaatccaccaacagccgacccaatccagtcaatgccgattcagcaaatgttgccaagacagccgatggttcggccgattcaacagcaaaacttgcaacatgcatcggctaggctgaggaatcggccaaggcagcatgctgcaaatcaagtagttcatgagcacttggtccataatgtgcaggccaatcagtcagtcgtacctcaagttgttcctgaacatttggtgcacaatattcagttgaatttctagaattatcaaggaggtaatttgaattatcaatatcaggctccgtcacctcatgttcagtaccggcaaacaaaattgcctcaatatgctcctcagtttagatcagttcgagccgatacaacagcaaacgcaaggaatacctcagcaaaggccatggtctgatatgattgcagatgtgatgagggagcagtttgggttaaagccaaaggacactggaaacttgtatcggcatccttaccctgagtggtttgaaagggtttcattgcctagccgatacaaggtgccagacttctcaaaattctcagggcaagacaatgtttcaacttatgaacatgtcagccgattcttggctcaatgtggtgaggcatcggctgttgac

SEQ ID NO: 100274 - DNA, 686 bp, Oryza sativa
ttccgatgtgtcgggcatagttgatggatgtatgtcatatactctactaacatgataacctcactcactttcaaataagaatattgtatatgtattattgaaatttgagtaatattgatttacactataaacaaattgtgtctactatataccacaaaacaactcaatctttaaaaaggattattgtaatcacctccgtcttctctttttccattctcaaaagggtgccaagcatagataataaagcttgctatactaccatgatatagcaaaggcatacatttggatgagttaagccaccatgggtacttaattaacgatgcaatcctttatgagggtactaatagtgaattagccgttaaaactgttatccacgatggtcttgatgggcacgattatgtcgatatgtgacccatgtttcaaggtatcgagaaagaaagccttggtagttatgttcggcttcatccgttagatgggcattcatatcaaattttaacattattatcctattaactcatagaagcgatattgttataatatatttttttgataaaatattattggaatatttatacatagatttagaaataagtcagatcgacatgaacagttaggttagtagtggagataatttttttagtcgattaacgatgtattgttcttattaaagatgttacaaatacagg

SEQ ID NO: 100275 - DNA, 570 bp, Oryza sativa
agaaaagaataagctggtttagtacttttaatgtaaatgtgcatttttttcttggcatactgtggacagagatatattataacccttacatacatatagactaaatgacataccactatatgtttagaagtgcatgtgtgcaaacctacccatattgaacatagccagccccagccctgatcttgacattattagcaccgacccctccaaagctggtggcaaagtgaggtgcgacctgcaaaaatattaggcacagttgtatatattagtacatatagattaattatattaatgagcatgtacttatggggatacttattactcatttacctattggagatgcaagcctaggagatgccgattacactagcatatagactaggattacaggctaacttacgtgccaccgacttgaagagcggtaacctggcaccattcaccactgccactgacactgcctcctcccccctgagatcttggttcgtggcatctgaaaccccctcttcgaggctttgcatatcttcgctggtacccgagctaccgacgaccgtatcatcattatgaaggatc

SEQ ID NO: 100276 - DNA, 717 bp, Oryza sativa
tttgtcctgttgatataaaagtattgttactctctcaaatcataagtaccaattgtatatgaccatccccagttctactcatttacaattatatccaacaaggtagtgcatgataaaacgggaggaactctacaatacatccatgtgaacataccaatatagtaatatacaactcctctatgttaggatgcatatataaagatcactactactaataaacatatatacacaacaaccaccattgattcatgccatgtgctacacgcatctggtgcggcaatcttaaagatatccaaatcggcgtccctctctccatacctgaaaacgtttgctttaagtgctttctaagaaataaccgaaaagcttccctctaaagtctttatttaatccttagcaaattacctcgaaacacagggtgctagctgcaaaagagacgtaaaaacagggagatcagagagggctaggctttgaaccggaggcggcctcgcggcggagagccacgaacccacgagcgacgcgccacccgccgccgggctcgcgacgtgtcgcccatcgagccgtccacctggcgcatcgtacggctcgtacgtatcctctcgaggcgcccgcggtcactgacacgtgggcctgatgcgtaagggggctgaggcggcggcggccacgtaggaggtatcctctgtacggaaggagcccagccaggacgtactcccaccgtcc

SEQ ID NO: 100277 - DNA, 662 bp, Oryza sativa
ttctctggcaatcatcattatctaacctacaatcggctaacatctgttagtagagggcagcgcgatctaggttagattttgatgtgtgatttagattatataagatatccaccactctatgaaacttccaacggcttgattggctagaatattgttcttcttttcatacttaatgctgcatcagttgagtttgatctattaagtcgtgcttagaatatcaatctctagcctgccttctggttgccgattagggtagtatcggagtttcagccgatcttatctgatttaaccatattcgctctatatgcttaagtgacatgttaaatccgccctttctgtcaagatcttattgcatttaagtatattaagcttttgtttgatatattatacttgctttaatatcctgatatagagtagtatcggagtattagccaatacatgctagatctatatgatcggctatgctataaacatatatagccctgttattaatatatatttcgatccaagtgattttatactatcttggcatggcgaccgatctatcccaatcacttgatttaaatatatatcgatataagaactatatattggtaatatctacagccgatcgagtaggtctagttctttattatctattatactcgccgatcgattcacat

SEQ ID NO: 100278 - DNA, 751 bp, Oryza sativa
atacaatatgtttttacgggaatccagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcg

SEQ ID NO: 100279 - DNA, 553 bp, Oryza sativa
ttggtcgttaatagcgtcgcctcatctggtcccaatcttgatcttggattccgcttcaatctaatttttatctccgatacttagattaccaaatttggtcgttaacagcgtcgcctcgtccggtctcccgtgcacctaccccaaatccccatctcgctgtggtcgtcgtcgccgctacgtcgcctcgccagatccgctgccgtcgccgtggtcgtcgtcgctgctccccatcgccgccagatccgccgccgccggtgcggaggccggactcgcgtcgcttcgccgtggtcgtcgtcgcctcgccagatccggcgaccccgcacccggatccggtgagcccgccgccgccaagctcgccacgccgtcggcgagctcgtctgcgccgtcgtggggggaggaggatggcggcgtcgagccatctcgccgtggtcgtgaggaggacagcggcgtcaagccatccgccctcaccgttgctccccgccaccaccaccgctgctccttgccgccgccagatccaccgccaccgctgctccccgccttcgccagatccgcc

SEQ ID NO: 100280 - DNA, 653 bp, Oryza sativa
tggatccccctgaacagtccacgcgctccacagagcaatttgatctctcttttttaaagaaaaaactttgttgttttctccctttatgctacaagcttatgagatagagccctgtcctagtgatagagcacaacggcatggcatatgcagccggccacaccaagacacatgcacaaaagatacagtggagaaagagagaaaaggggtagttatgattgagaaagtgtactaaatgtcaaatagctctttcatcaaaacagcttaaggcctatttcattgaagagctattccttgagtaaaaaataggtcttaaaataactcttggctacttatccaaacagggccaaaggtcgatctctagtttgtttgttttctacatgtcagccggccttcgtgattgatcatttgttccagctgatgatgtcagcggcggtaccgacgacgaggagcacattttcttaatttctttacttaattaacaaaagagtcagcagcttgtaccggcaaattcagccgacaaagccaagcatgtacgcgtacatcgagtatagctagatcaattcataaactgttttttttaactcatgtgtcttttatttgggagcgtatcctatgcacacaggcgctcgcgtgtacacaccgtgtacaccaac

SEQ ID NO: 100281 - DNA, 580 bp, Oryza sativa
tacctaaatactgatctgtttttaaccccatcctgaacctaagaagacacaactcgtcagggtttgtagggacaaatggaacctaaacctctgtttggaacaacatataatgaatatgcttgcaaacgaacacggtggcctgatgactcatcagtacaacacaatatggaaagcatgcatactagactggatacataaaaacttagtagtgacgactgcgagtctgctcaattgaacgcttgaaatggctagccatctacgagccatatattttccatacattatttaagcccttgcattccatgggcaccatgtgttcgatagtatatatatgctagatgctagctgccattatgtacagtgatctagagaccacttcaatctctaaactattgatgatgatgccactaaaggattgtctatagtactccactagtcattagttgcaaaccatgaaatatacagatagaataaaaatgcatgactgcgtgcctcagttattattaggatcgaccaactcacgcgtgaagggtgcgactagactttcaaaagctcggcagaaagacaaaacatgtcataa

SEQ ID NO: 100282 - DNA, 615 bp, Oryza sativa
tgttctatcagactgttagcattccatgtagtgcatcagccttagtttggatatcaagtgtggctcttttctttacttgtctgctcttctgtaatctgtactctgcattaattcaatttgatatttggttgacaagaaagaacatatatggtgtatttctttttggaattgatccaatgttgttccctttttttttccagagatgggaacactgcagctgggtgactgaagctcatggtggcattagtgctaagcttaaacacttgcattcaatttgtagtttagctcttagctggctagttctatttattctaaaaaaacaactgaattgtaaccattttgattactttgtgaccctttcatgtatgcatttgtgaacgtacagcatacatgtgtgttttccctgtgctaaacaatgtttttttttactgtgtcctatggatttgatctgggagaatgcatattggttcattgcttacttgggaacgtacagctgctgccttatttttccccgtgctaaacgaaagcagggtttctatgacagggattagaaacgggcagggattcgaaccccgcaggattgagtgatatgggagggattcactcagtccctcc

SEQ ID NO: 100283 - DNA, 659 bp, Oryza sativa
atattatcattcatgggagcaaatatgatagaacctacccagcatgatatgtatagatgtaaacttaactttaactaagtcctcctgactgaatgtaacactcatgaatacttacagtgtctttcagatatattggtagagaatgtaggtatccagaagctcctattgaacagtacaaatattggagacgaggtttgtatctctccctccttccctctctctgtctctcttgcactctttgtgtgttgtttcatgcgcgtgcactgcaatgtaacatgatattttcttttcagggggcaaaagcaatttcggatatgttgaaaaagaacaagacgatacgtactttacaactcagcaacaacacaatagaatacagcgtatgtatatgtatccacttcatcgaagacatgcacttgaatcacaaatagaaaagaaaaactaaccatatgattgtttattgaaggattgctatttactatatctcctttttcttggagcagggttttgcaagtattgcagaagcactccttgagaataatgtgctacggagcttatttgtcaagttagttgctcacaacccagtggctttatatgtgatatatgatgagtgtgcatatgaagttgtgctgagatactgcggtagtgattacattggtagt

SEQ ID NO: 100284 - DNA, 643 bp, Oryza sativa
aagacaaagttgtgtttggattgaagccaaaatagcctaagttcactattgaaatggcctattttcgtaggcatgtcaaaagttggcttcaaactaaatagacactaaacactattgaaattgtcaaatattggtaagcctaatttaggcctcaaaccaaaccaaccttatattttttctgattttaagtgccacgtcaacgccatgtaagcatcatgttagtcgaaaacgccatctaaactgttttaggactggttttgtaagttgaagggcacttcatatatgatattgtagttcagacacgtatttctgactcctaaaaattgagtaacctaaagtgaacttattccgttggctgttgcggtcggcctagaattggctgacgtactgatccgttggaccatatctgcaaataaagaattttttatttataattttttttattaaaagttttacaaaaataattttctattttgaaaattgacggaaggagtcgcctaccgcccttaaaaatcgccctctcagagggcggcgaaaatgacgtggcagacggccgtcgctcggcccccttgccgccctccgctagggcgattttgtactgtgggggggccgcctgcaaatgggcggcgagggggcatggaat

SEQ ID NO: 100285 - DNA, 685 bp, Oryza sativa
tttctatccaaaattccaaacgcttacatatgtgtgaaccctcgtccaggaatcagccgaggcacacaataacaaattgataatagagtacaattattactctaattaataagcgaataaaatgtcattacagaggtagatagttcctctcaatcaataaatatctaagcagcggaaaaaaaaaagataaacggggcagacgacccactccacaggcagcttgaccagggctacacctaatccttcacaccatcagcatcactgtagaactcctcctctgatgaatgattgcaaggtgagtatatgacatactcagcaagccacgcaacaaatatacaagtgcacaggataacaaaggatggcatagtagggtttcatttgcataaacaacatttaataaacatttcagaatttaataaaatagttaagtagtaattaaacaatattaatccaacgctatacaacataccctggtgcatatgcccaaccattctgaacacccatcccggctgcacagttctatttcaaaccaggaattaaccatctcaaaccaggagctaattaaattattaccaggtatagcatttttttataatgtgagaaatgtgaactaatcaccaaagacattggtagacccacccattaaccgcggcaccggtatttgaatagttttactttggccaga

SEQ ID NO: 100286 - DNA, 678 bp, Oryza sativa
ctagaagtaaaaaataacccaaattaatataatgttcaattttaaaatttcaatgcaattaaaaaaaaaagacagtgacgggccgtaaagaagtataatggcggcgttttatgagcttttaagaaattataaaacggaaacccaatgagccaattaagctctaaaacctataagatccattttttaaaaggtccaaaggagaataaatgataatagtagatcgagcaaagcaaataaaaaaggatatgacataagtaagggtagtaactggtgtgacttttcaaaaactatttaattagaaattcggggataagaagatttgttctttcaaagtcttaagacaataagatagctatttaaataattttaagtaaaatcatacgaaaaaatatatgattttgtttgggtgctagtcgcgcaattacgcgggccacccagctagtttcagtagaaagaaagaaaacacatccaacaagtttcagaagttaaaaaaaaagaattaaaaaagatgtgatgggacaaacccccaacttccactaataaaagtatcaactgaaataacgttttcaaaatcacatagattctagcataaaatttcgtaggtactacaccatccaaactggaataaaagctccgtggctaccaattccaagagtgcaacaccagtacgcatagcat

SEQ ID NO: 100287 - DNA, 575 bp, Oryza sativa
atttatgaaaccgataccgtattggataaagtttatatcttgtaatcctgccccccatcctatataaggtgggcaggaggccctctagggggcatgagacaactagatcgtcagatatataatacacccggcggactcaaatccccaaacaggagtagggtattacctctcattgagagggcctgaacctgtctaaatctttgtctccgcatccatctacttttaggtctcgtgcgctacccccttttcatattgccgaaaatttgtttcgacagttccatgtaaactgttaataattaattatgttcatttttcgctttctacagtgtctgaactctaactaataacctagatactaattagaactttgactaacaataaattttaaaatatttagtttgaggacattagaacacaaatgtttaaattagtattaaatattactctcttcattctaaaatagagaaaatcccttgtgtgcccatgaaaactcacctaatcccttccataccctcgaattttacccaatcccctgtgtacccttgaaatttcgctttgattcctcccatgcccct

SEQ ID NO: 100288 - DNA, 709 bp, Oryza sativa
gaagaacaatatgaaaaagacgatcatgataaggttcatctctatttcccccaaatgctgcatcatatctcaaagaacactttgtacatgcaaataatgattatgaataaccacatctgcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtatttttggcttggttgcaggtgacaggcaaagaatgtcacagaaaaggctttaccttcctccgttccacaggcaagtttgagagcagcgatgaaggctctacttttagcgatgatgagaccattttagagttactgccgttaggaccatccacttcacgcattttggtggcatccacttctgtcaacaatggccaaaatatatatgcctctgaccagccactatctacattacctccacttcctgatttggagataccccaaagaaagggtcccttgtgtattgat

SEQ ID NO: 100289 - DNA, 575 bp, Oryza sativa
ccaaaagttttttgttcgctaaccaaacaagattgtgaatgaatatcagcatcaggccatcagcgtgttaatgctgtgggcgtgcaacgcatgcaagcaagtaaaaatgccggagatttgaaattgcagtgatatactactacactagggtgagtaaagagtactagtacctattatactccaggacaggagtagtagtagtagaaaaactgataaatccttgggttgggttgggttgggttgatggatgggcaacgggcacatgaatggagtcatggaggagggcctacgttcgtacggtggggactatagtcatttgggcgcctgcagtttcacttcacgagacgagtcctagtagtactccattttcccagctgctggtcgaactgttaggccttttaaatcgtaggattgagaaaatataggaataaaaaaaacgtagaattttgatagaaatgtaagtgtaaaacagatgattgcaaaacgcaggaaaaacacagaaatgaccgtttgatttaaccgcagaaaaaatacaggaattggatgagagagatagactcaaaaaagagttatag

SEQ ID NO: 100290 - DNA, 504 bp, Oryza sativa
ccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttcattatttcatattataagttgcttcgacttcttttgtaatcaaacatttttaagtttgataaagttttaaaaaaatatatagcaacattattaacacaaaataaacatattatcaaaacatattaaatgttagttttaatgaaactaatttattatctagatgttgataattttgttccataaa

SEQ ID NO: 100291 - DNA, 691 bp, Oryza sativa
aatgggatcacctctgaacttctttctggtgtttatgagttgtgtcaaatgcaggattcaacatttgctaggtttgtgatagataggtgtgcccccttatttaccagtaatgcatgagagcaacatgctttacactctagtattttttttttggatcatgcatttgttcaaccaagttattgcaatgatagccattgctgtgctcctgcaaaaaagtacaaatttctagaggccacagttcctttcataatgtagctcaatcattccctgagacaccaattaatctggcagaatacatagattatagatatggttgtactgtccatatagcagcactaactggaagatcgaaagtactaactgaaggatccttttaatgatactcatttagggaaaaaaaataaacagcaattctttatgtactttttgctgtttaatcatgtcatatttgcccacccttatttcctgtggtaatcagggtactaaatcttccatgttttggttgcagctgctttgaaagttgcatcgtacctgcctcttccctactcagctttgagctccctgctgatcatccccgccccactgcgggatgcaatctacgattacattgcaaagaatcgctacgattggtttggcaaggatgatgaatgcatcgttaccaagaacaaggagcttcttgagcgcttcatcg

SEQ ID NO: 100292 - DNA, 690 bp, Oryza sativa
tggtcataatgaataattatgcttatgatagatgacaaattgataaaccaaacgtacaagttgccagaaaataactttccatgactgtaaaataactaaatggctgtttggtgtggtgccaaggttcagtgttgaattcaatagaatacactgaacgcacagcagatgggtaatttctcatcatacttaaataaaaatcacgtggcatactcaataaccaacaatttttgaaagttttgaagtatacctttcaccatcaggatgagtgataataatatccatgtcaccacaagaagattttccacgtctgtatgatcccccacatacaattatcacctccaaataaaaaagatcatgtataacaacccaataatcacttaagggaaattattgttctactaaaatcttaaatatatgagctatttgttttcaagaatcaaatcggcctaggatctcgataggatgaccccattcctcatttttgtactggatgtgtactttcagaggatgactggaggaatggtgatgaaccaaccattagttctccaaacaaaataagtagtcaggttcagactaatagggaactacaaaaaataggtgtaagcaactagctgctacaggaaacaataaccaccgcatatgttgagacaaattgaacatggaactgatgcttcagtattagtttttgaa

SEQ ID NO: 100293 - DNA, 640 bp, Oryza sativa
actttatcagatgtagtaattctaattattgtggatatattctaataacaagcacgataagatttatcgcattagcagttgccactgaattagtcttgtgatggagcacataagatgatgaggccaactacaatgctcaattgtcaaccatatcataaatagaagagcgcttacatgattaattccctgaacaggagaacagctgttggtttataacatttattgaagttgaacaggggaagattaaataatacagtagtataatactgaccttttcaagagggtacacagtcttgttacaaactacgcacttgtcttgtgtgccaacaaacatgctagagaatctgttcggttgcccctgcagtttggataacataaaagaggaagtggacatgaatgttatgtcctctacatcaaagctgccaaacaatttagatactagggacgtgcttcaaaaacataaaagagcatatcttagaaatatattacgataccttgtttccattcgatttttctgctttagctgattttgatgtccctggcataatatagtcaaaatttagggcaggcctaaaaatcatgagacaatagcaacaatttcgaggtaaagacactagcaataattaaggcatcaagccca

SEQ ID NO: 100294 - DNA, 592 bp, Oryza sativa
attggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcagtaggcggacagataccagtatccagtacatcgcatgccattcgcatgtaccgttccaaactcctccatctcacacacttttttttttcccttcaaaacgcagtagagacatacaaattcgttttttttatgggagggaggagtagatgttaatcgtgcgtgcatattt

SEQ ID NO: 100295 - DNA, 512 bp, Oryza sativa
aaatttacagttttcaatttttcaacggacaaagcgacagcataaacaatggaaaggaaacacccataaccaaacgaagataccaaaccaactccaccataatcttccgtgtaatcagttaaaaacattaatcaaatcttccgtgacaacgatccatcgaatcaaacctcccccccatcccgttaatctcaccgcctcccatcccatctcatctcatcattttcatctccacaaataaactcgtctcgctcccttgcccacgccggcgcgccgatcgccttccccccagatcaatcgaccacaccaatctcctcctctcgtcggcgcagccggaaccctacctgaggcagacgccgccgccgccgcatcccgcgtctgggtcatggaggggttcgctagggcggtggaggacgggctgaagctgtcgaaaaggctggtgctgccgggggggctgccgccgccgaggccactggcggggatggaccgccgcgtttgggttgggggtgggggtg

SEQ ID NO: 100296 - DNA, 719 bp, Oryza sativa
tttcatcaatcggcttcgatgtacatgatagatctattccctgatgtcataccccaggtaaaccttatcattattaacctgagtaattgtcagccgattcattacttgactaatctcttgttcttgttctgcagacaatcgactcttcccctccacgccaaagcaacagtggcagagacattgaatatgctccaggtctaattcccaatggaggtgggccatctccccctgtcatcggctatcatgcccccaggacttcaactctcctccaaggcctaatcagggaaccagccgatgcaggcaggaaaagaagaactaggtcattggctatggacgcattagctccagctccaaagaaaagggccaaatccaagaaaaccaagtcgactgatgacctgccttctttggatccatccatcgagcaagctctagatgaagaagaaattgacgaggctgttgaccaggctcccgctgatgtaagtgatactgaggaaacaccatcggcttcacccaagcaaactcctccgactccttctgcgccagttcatttttcaagataaagcagctctctttgatcccttttgtaatcacttcacttttcggccgatcactcacagagtttattgttgcagaagaagaaaactgctatgaaaaagaagccagcagcaacaattttcaaaccggctcaaccagtaagatattttaattcttttattagt

SEQ ID NO: 100297 - DNA, 513 bp, Oryza sativa
atattagggaagaacctaatataaaaaaaaattagaagggctcagctgtaaaaaacttctccactaagtaaaagaaaagacacgaatattagggaagaacctaatataaaacaaaatagaaggggtaaggcttcgaacccaggtcgtctagcctaccatcttgtggagctagccggaagacccctgggtgtttcgagtaaaagaaaagaaaaaactcacaactgttaatatactctcctctctctctctactttgttcttttgaactccataatttagagaaattctatgccgaagtttctatcagcaagatttatgtttcctttgaactatgttcaatttcctttatcaccatgctctttgatatttatggttgctcttctgggagtgggattaaattcatatggaaatggaacattcatattgtaccatattgttagataatcctaccaactcctgcgagctggcctccccctatgtatgtataaaaggaggaccagtgtctctaagaaga

SEQ ID NO: 100298 - DNA, 538 bp, Oryza sativa
acttttgccagcgggtaataatggaggatgccctcatcattcacacccccttaacaagggcctagctcgaaggtgggattattcagaggcttcacacggtcgccgcctgacttttgcgtctttgccagcgggtaatagtagaggatgccctcatcattcccacccccttaacaagggcctagctctgataccaaatgataacaatccgatccaggtggggttggctgaggtccaataacttaaggttgtccagacttcaacagttcataggcacacccactcggggaaaggcccaatctccctgaaaaactagtccaataggggaagagtggctctcccttttaaggtggcttcttcctcccaagctaagtaaggtgggattattcagaggctcacacggtcgccgcccgacttttgcgtctttgccagcaggtaatagtggaggatgtcctcatcattgaccaataacttttcataaaagatatatcaaatagctgtaaaaccaatattgtgtgaaagtactaaatgtaatggcata

SEQ ID NO: 100299 - DNA, 530 bp, Oryza sativa
ttaactctggttatcttttagtgattgtgccgaacatacggaaatacctcgacaattgaacacatatatggtctttgaggttctcttgattgcatttcaattggagaagactggaaaatgatatatccactactggagaagtgctcgtctctcccggttcgcaagcccctttactcccaggtagcgaatcgggagggagaatccgggactaaagatggcggtctttagtcccgattcaaatacccgggagtaaagctccatctttagtcccagttggtggctcagccacgtggccgacagagccatttttagtcctggttggtgttaccaaccgggactaaagattttttttaaaaaaatttggttgtgttgtgtgctgcctgtacatacatacatacatacatacatacatatatatatattatgcatatatatgtttaaatacatatatatatatatatatgcataatatagaaatgtatatattacacatatacatatacgagcacactatatgtatctatacatat

SEQ ID NO: 100300 - DNA, 750 bp, Oryza sativa
  unsure (1)..(750): unsure at all n locations
tgttttgattctttagaaagattggatgaataatacatgtatcgaccgtattgtcatgtaatgttttctttggacaatgaaattcaatacacgatcgagctgagctttttttaagataagagctcctgcttacgggccattacaacaagttcagaaacaatgatagcaacacacggggggccctaatggtgaaggtacattgtttaatttggtggacttgcttgtaaaccgttgcaacttttgtcattctgaccatttcatggatacaaggattgttaggagaaatgaacagcccataatatgtttttttttaaataagggaggccagaggacttcgccgggcagaaacaaaccaaataaaaaaatattggtacacgctgtgaattggattaacgtccaaaatagcctaatcaaatcgtttctcaattcatacttactccctctatctcaaaatatgttaaccaagaatgtgactagtgtcagacgtaacgtaaaggcggagaggtctttaagcctccactgtttgaaccatggaagcactccaaaaaatatatatatattgccacacctccattgaaaggcggggcttggaccttggagctctattttagtttcgagataattntgttcttgtctccactttgatgtctaatattgattttgcccttgttttttagggttttcgtttttacccctactttttgaaacgaaacaactatttgccccagttccattaattcttactaatgg

SEQ ID NO: 100301 - DNA, 678 bp, Oryza sativa
aaaaattaaggtggtttttgcggtattttggtccgtcgttcgaatttgagctgattttaaattcgttggcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattcgag

SEQ ID NO: 100302 - DNA, 625 bp, Oryza sativa
caccctgctgccgccgccgtcaacccctgtcgccccgccaccgtggctgtcgccgccgggttgtccgtgaactcggcggcggaggcaagcatgttgtcccttcggaagcaaaaaaccccaacgtgcacggtggaacggagacagctgcagatgcacgagcgttacgcctagggatttgggccacggatcgaccgtgcgatcgagaaacggacggtcgagaatggaaggaagacgcaaaaaaggaaaaggaaaaggaaaaggaaaaggaggaggttaatgcagcagagtttgatttgctgtaatgcagaggtagaatttgtctgatgcaacagcctgggttttatatatatattatccagtaattctagcaggttccaaaatacacagacacctttaatccaaaataataataataattattattgcctcctagttaggatcaccctaatcctatcttcttatataattggtacctattaaagagcatttactcctataaagtaagatatacaagaagccatatcattaaaaaaaattgaagatgtttttgtcggtactttggtacgtcatccgtgtacgagtcgtttttagttccttcgcttttaaaaatacagatcggcatttg

SEQ ID NO: 100303 - DNA, 702 bp, Oryza sativa
gcacgagcttggcgaaaggggagggagtggctcgtgggcttcctccgcggccgacacggcttggcgggtgggcgggcagaaccgcgtcgggtagcctcctggtggggcggagccacccccagctgcaacggccccagcctcacaaaggtgacatagggtgaatctcagccctagaaagtaaatccaatggctaagattcgtccacataatcacgagttaaaattttactcccaatacctgaaaatttactcctagtaaattttttactcctaaataaatctgcgagtaaaattttaactcatgatgacgtggatggatctcagcagttggatttgttttggagggccgagattcacgctatgtcacattgtgacatgcctaccttatgtcacccaatcccaatccgagggagagagagcagtggaactgaggaagagataaggtggagactaaggataacatgtggggcccactttcattttttgctacatcagtgtctagtcagcacgagtggatcgggtcaaattgttacgtcaacaaaatcgatgtatatactgctataggatccaaattggatggtttgtataatttaaggggtgaagttaaaatattactatatttatctttaaacttgatcaagtttaaagataaatatgtaatattttaaatagaaaacaaaccgattctcaaagtatatacagt

SEQ ID NO: 100304 - DNA, 897 bp, Oryza sativa
ttaaaagccggcttggacgcaagaaccaagccatattcgtggacactagaatctactccctccttccaaaaatattagacttatttcatattttggtttctccaaatatgttagtcatatattgtaatttttacgtatttaagacttactacctccttgcacaaatatatgacgttggttagttcaattttgagctaaccaacgtcaaacaaaaaaatatagagggagtaaatggaaagataaattgaattattaatcagaacctgatgagcctggtaaacatacattgtttgatctttgttacatgcaggataaattattttttttcttagtggcaaaagtaatactcctttcgtcccaaactataacaatcttaaattgaatgtatatttatacaatgaatctggacaaaaccctatttagatttgttgtatttggatatgtctcatccagttttaggttatgatattgtaggaaagatggagtattttaggttgcaagttactccctatgtccaaatgaatcacctaggatagagatgtgatctattctaagataatgaatctgaacaaaggagggagtatgttgtaaaatctaatcttttttggatgcaggggccatgatgcttcactccttcctaagcaagggcattattactccatctgcttcatattataatcgttttgagtttgtagaaaaaaaacagtaatattttcaccccaagacaaatatattattaaaatatatattcaattatagattagtgaaactaatttgatgttgtaaatattactgtatttatttacaaacttgaacaaacttgtagtagtagtttaagtaatttaactaaagttaaaatgacttataatataaaacggggagtagctattaagagta

SEQ ID NO: 100305 - DNA, 738 bp, Oryza sativa
atgccatgagtaatttgcatggtcgactgtagcgtttaatttgtcaaagttccattccctggaggtggcatgaacaatcttccattcagttcgtcaaacactgcactaggtcccatgcagtagtaaatatatcaagtttgctactctactcgatgggacttgaaaatgtggtgaaatctctttcagttgctggtagaagcctggcattatgcaattttattgatatggtgcatagattgaaggagctatttcttttgtccctgcagatgcaagcactgacacaatattcttgtattttgaacacataatttttttattgctgggtcgggagaaaatttgacagaccataaaaatccccaaaatgaactttagtttttaagtcaattatttctagaaaactaacttcagacacctttgcaactgataggtcattgagacattgtgttctggtcaagatcaagagactttctaaactaccatgctttttttttttacaaaacaatgtaagattttcagttcttgtaatttgacggccattttgttcaacttttcagaattcagattttaggacttttaagttttgtttatttcacagcgttttgatgctttgctacttcatggacctttgcatgaccttattcaacatgtaataagtactaccgcaatgcattttattttgacgatgactgagctagacttcttttgagttactcacatttggatctacagttctgctga

SEQ ID NO: 100306 - DNA, 1603 bp, Oryza sativa
caaccaccacggccgttgcctcgccagccaaccgtcgcagtcgatgccgccacagccgtcgccaccgtcactgctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtcaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgcagccggcggccgcgaggctggggaacgttctcgcttgttaaagcagatttaataatatcgtcaacttgctgactataagacaaccacatcatctatagcctgttagtataggctgctcatatagcaatggtctttattactatcatatcatttgtagtaacagataatatatttttaagcatgaaccaatctccatcaggcttatttctttttctttattgaactgcgtgttgcagccggtgataattctttcgtcgactcgtgttctcgctctaccattccctcctccagcatatcagtgagactgacgtgatcacgctatcgccgatcttggttggcctattagacatgctcttacgctctccggtttatgttgtgacacgatgggggataaacgcgtgacgagacaactatgaggctgttcatatggatgtcattttaaactatacaattttttaataaagttatctagttatgtacacatttagtttagttttgccaaattttggtctacatataaacatttctgtcaaaattttgatagcattgttaaggtaaaggtttattttatctaaaatctcaacaacacctacgtttttggttgccacgtgttcacaactcccaatcagcaatgagccaagtcgtgacgaaaaactcgatagcgatcgaatccatcccatccacctgtcaacgcatccgatccacgtggttcttagactagtccaggtcgttctcgacggtttggatcatgcaccggccaccggaaaagcgactcccctcgtctcaactctcaagtctcaaccgtgcatgaggcgatgtggggaccaccggaccagcaccagcaccagcagcaacggtcacgggctcacgacacgcgaggtcgtcatcgcgtagatttgggccggaatacctgcggattctgggcccactcctgcctctgtggtgcgttgctcacgccgccacgcgggcctcttttgggccgcaagaaagagaggcgagatgggctcctttgctcttccttgcagcggaagaagccgcgggccgtttcctcctccccgagaccaagacacaccaccacgccaccattcccacgcctcacgcggcggaaagagagagagagggtgaatttgctagcgagatgcc

SEQ ID NO: 100307 - DNA, 560 bp, Oryza sativa
ttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaaacaacttttgtacagaaactttttgcaaaaaaacacatcgtttagtagtttgaaaaacatgcgcgcagaaaaagagaggggtgagctgggaactctgtgttcgcacaccaagttccaatctc

SEQ ID NO: 100308 - DNA, 650 bp, Oryza sativa
ccgtcacattgaacgtttgaacatattaaatattgaaaaaaattaattatatagtttatgtataaattacgagacgaattttttaaacctaattgcgccatgatctgacaatatggtgatatagtaaatatttgctaatgatggattaattaggcttaataaatttgtctcgcagtttacatctggattatgtaatttgttttgtttaatactttaaatgtgtgtccatatatctgatgtgacctagtaaaatttttttactggtggaactaaacacagactaattcattagggcatgtttagattaatgcaatttcaaatcataccattttttgggtaaaattatcaaagatgtatatatatttagtttcttgccaaagtttggtaaatacataaaaaaatcatgccaaaattttagttatattgttaacttaaaaaaaattggtaaggtttattttgactacaatctgaacagctccttttttttctaattatacggatgacgcatacacatctgatgtacattcttgattacatgaaagacacgttcacactagtgtacattcttgattacacggaagatgcatacacatcactgtacatgcgcagcacactcgcacctgtttacacctcgtataactaaaacttta

SEQ ID NO: 100309 - DNA, 638 bp, Oryza sativa
ccggacaaatcgagctaagcaagaacatttacataataagcaggcataagattaagacagcaacgcagaattgcagacagagagaatgcatggaggcagctagcaagcacccctgcctgtgttctctacacggtttcaatcaatcaccagctaattggcagacattcaaacaaatcgcaacaccgtagtatagtacttttaattcgtcttcgagatacgactttaatcattaattgccttacctcaactttatgttcggattacatatcatgtaatattataaaaaaatctaatggtgtaataaatgttataaaataaacttagatgcatagttccggatatatgcccctccggtttttaatgtacaacacttaaattttggatgtgtgttcgttttgaatcaaatctgaaatagtatgttacttttaaagtgcctttaaagataaaacaaatcacaataaaaatacatatatttttaaataagacagatgatcaagcatatattcaaagtcaacagatcagtcatacattattagaagagaatttcttgtatgcccttgaaatttaagtcaatcttttctatgcccttgaattttactcactctcttggataggtgtataccttttaattatgattt

SEQ ID NO: 100310 - DNA, 749 bp, Oryza sativa
tattcgggaccaattatattgttaagatcattgatttaaacttctttcctgggaaatgggtgccacccttggattaaaatggggtttgggttccagtacctggttggaataaatttgttgtctacgtttggacattctacttgttcataaaatttaaccttcggtcatttttcaatttatttccagcctccgacgataggtactgtgccgttaaagatacatgtttctattcaagttaaatcacacttatgcaattattcatggctatcatttgagattgtactaatggtttgtattttaaaattaaatattaagggatccatatgcttacaaaattgttctggattattttttttctatatggttcatccatacaacttaaatggataatgcaccgcagacagcccacaccactgccatcgccatccaccgcatacagctcgcaccactgccatcgccaccgcctccgcttgctctcctgtttttttgggccaccgcctccgcttgctctcctgtttttttttgggaaaaagacagagagggagaatagggctgacaagtgggccctacgtttttttagtatttctcctatcacttacatgtgggtctcatcttgtaacgttcctatgataggactacactttacatgaaatatattttatgtcgatatgaattgaattaaagttcaaatgcatagatcatataaaaatatttttttgctaacatgaaaatttaaaaatttattaaaa

SEQ ID NO: 100311 - DNA, 641 bp, Oryza sativa
ccgtcccagccatcccatccagagagaacatcagagtcctcacagctctgaattaggacaacatgcacgcacgaaaatattatttgtagtacttgcatgcacaaaacaaattaccttttctctcaaattttttaaatgtgtcaagttttttaaacaaactttaaactacatgttctctcaaattacttatccaattcatgatccaattgcaccactaaattcattgtaattaaatctttaaaacaagactaaacatggctataatctgatgaaaaaaatgtttagctttattaatgaattgtttttaatgttgcacctatatcatttaaatgtttcatgtagtattcatatgatgtttcactttttaatttgtaataatttgtaaatgttgcacatgttcttctaggaatgttttagcatgtactttataatattttaataattataactccaccaagtagatcggaatcgtttcactaagtagatcgaaaatgtttcagtcttgtaaaaaaagctgaaacccaaccaaatcacctcataaaacattttactataacgtagtgaaacaacagtttccgaaagaaccagacgatgtttcaccctatataaaaataatgtttcagcaaatagtgaatagatgt

SEQ ID NO: 100312 - DNA, 571 bp, Oryza sativa
ctttctgtcccctagctaagccaataggttaattattgcgaatagttgctaattgacatattaatttatgtttatgtgtttttgtacttaccaaatcaagatttgacaggtgagcatatatacgtgcactactaatcgatccgacataatggttatagcttcttcaaaataaaggtcaaaattgttttcattataaaaaaaaaatgattcgacgtgtacgctcactggctcactagctagctcactgatcgtggcctatgatttagtcaagggcaagagatatataatatccttaattcagagtttcacatttttgtttggagcaataggtgttactatattcatatatatctcttgccaattatatagatcgacattggaactggtctaaattaattaattgatctttgaattgtcataaacttgccttaaaagtatttagagatggacaaacctctgtccttaaaattatttttaatcctcagtgtggaatctctttacgccatttatatagcagtactaagttaggttgtcatgaatgcacacacgctgtttactatatagagatggg

SEQ ID NO: 100313 - DNA, 520 bp, Oryza sativa
ttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaaggttttaacaagaaaggaaattggataaagtgttgcactacgtactttgctagcgcatatacactaaataaggaacccccgaagctgcatagcacgtttctttttgggcaaagtggatggccactatccggattagctcttttgggctgagtttggatgtggtgctagaaatttaggatttttcacaaatgctaaatgagactaaattattagtgtcaggttaattgaatactttctccattttcatatattggtggtttgaattttttttctattctacctttttaaatttaatcaagtttataaaaaatatagcaatattttaaaacaaaacaaacacattattaaaat

SEQ ID NO: 100314 - DNA, 638 bp, Oryza sativa
aatgtgaaatgctatatgttcagatcagaaatggaatctcagctgcagcaactatactacaagcagtaaaaaacattcaaggatcaggcggtgacgtcgaagcctaataccagcaccctattttaaggctgtcaatccacgtgattagccaatttagttaatgctaatcactcgattaggaacagttccccaggagggagcagggaggcgtaggctccagctgtgaatgagcagggagccatcaccaccctttatcaaaggcgcccccccggttgtgaaaaaaatgctgcgatgcgatcgatggcatagttttggtgcagagaacgacgatgatgcctctcctgccccgtcgattttttactcagagaacgaaactcatgacgcatcattccacgggctctctcctcctcctcctttcgctttcgcgacgccccagccgatgcgcataatcttttgtccttgtcgagttcacacaaaagtcacaaaaccgctcgtgttaacgttacagtttttaccgcgccatcagagtttaatcgtacgctaagcttccattttagtaggactagtgggcagtggcttactggctttcatcccccgcaaactgcattgttcttcaaggaagatacagtcggaaagag

SEQ ID NO: 100315 - DNA, 725 bp, Oryza sativa
  unsure (1)..(725): unsure at all n locations
agcacgcgcgctaactagcattagcgcggacttaccgggggttcctagaaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgggtaccagnntgtacatcaaag

SEQ ID NO: 100316 - DNA, 535 bp, Oryza sativa
tttataggtggaggggaaggcgaacgtgcccggaaaagcctctgatttcaccggcgacgtggggtggagagagagagagagtggggtgggatccgaaatcgaatcccgccctctcgagcgcgcgcgcgcgggcgggagtgacggggcatgggcggtgacgtggggaggacgcgggaacggcgcggcgtgggcacgggaggagcggaggaggtggggtggttgcggcggttgccggctttggggcgaagtgggcggcgggaggttagggacgaccgacaggtgggccccacctgtcggtgcccgaaggagagagggagagagggaggactttgggacggggaagggggagcgggctggcctagcaaagagggcgtgcgggagggaggttgggcctacggcccaacaaagaaaaaagaagggaaagaaaaagaaaaggaaaaaggaatttccctgagatttaaatattgcagttgctcattttgaattggttaaaattatttccaaggctctgaaaattccaataaaaatcctgtta

SEQ ID NO: 100317 - DNA, 1239 bp, Oryza sativa
ccataccttaatggtattgtggtgaagggtatgggtatggcgaaaggctccagaggctagggtggcctcatagcccctgagcttgaaagcaactcattttcgtccccagcccttgtcgccgtaccttgcgggtactgtggcgaagggtgtgggtgtggcgaaaggctccagaggctagggtagcctcgtagccccccagcttggaagcaacttattttcgcccccagcccttgacgccataccttattggtactatggcgaagggtgtggcgtgtggcaatacaccgtgcctcgtgtggcgaaacctcttcgtccgcagcccttgacgccgtgccatattggcactatggcgaagggcgtgggttggcgaaacctgttcgcccgcagcccttgacaccgtgcctcgtgtggcgaaaccttttcgtccgcagcccttgacgccgtgccatattggcactatggcgaagggcgtgggttggcgaaacctgttcgcccgcagcccttgacaccgtgctttattggcactatggcgaaggcgttggcgtgtgacgaaaggtgtcaaaaggcttgggcggcttcgtagccccccagcttggacttaactcactttcgccccaagcccttgtcgccgtaccgcgcgggtactgtgacaaagggtgtgggtgtggtaaaaggggttccatttcgccttttcggtttgggttccccacgaacggcgccagctgttgtcgaatggacaactatgccacgtcgaaaggcgtggttctcatgtaaaagcaattgtattgattcgtgaaatatttttggggatccccccattacatggccctagaggtttatttatagccttagcacaagcttgcaccttctagtgtttagggttacaggggattttacatggttgcccttatgaaagggacatttacatgggtatgcagtgtcatttgcacatatgggcctttaatgggctgataggctgggcctggtctatggcaaacgggcctaaaaggccgggggcagcctgttgggcctccttgatgccgaactcgtcatggcgaagtctttgtagtttgcccgagatgcctttactttcggaataccgacgcggctttccagccttcgccatcttcgcttatggctttcgccatagggcttcgcctgaatggccttgacgtctttggcttgaatccttgatgaaactatagtttcggcaggtccggccgaagggcttcatggcat

SEQ ID NO: 100318 - DNA, 545 bp, Oryza sativa
agtgttataaaatattaaaatatttttacaaagtgattcttattaacttttctccacagagatgtagggaagtattttctaagactaacacatttggtttcacaatttttggagttataatgattttcttatgaattttacaagttataacgtgttgtatgcatataatgttttacatgcatatgtcttgagagctttatatccagaacataatacttcttgattgagttgagtaaaaggaataatttggttaactaatccatttttagttcataagcttatggtcttattatcgtggtttagttcataagcttatggtcttattatcgtggttcatatttttatagactaggggagatctagtctatgctagtacctagaaattactatatgagctaagttcttctaagttttggtggatggggatagaactatggctccactggtcctaataagttttatttggatttatttggagctaccatgcatatatatacttattcatatgtattgtttaaccactattatgtgtttagtacctatac

SEQ ID NO: 100319 - DNA, 1035 bp, Oryza sativa
aaagggttagagagtgatccagggtgtgccactcctcggggtgttagaagaaagttagtagaagactttggctgaaaccaaacatcaaaaagaggttttgaaataaattttacagggagagcaagtttgaatctgctaagcagtttttcaggattttggagatattaaagtagatcaaggagttagcaaaccttactaaacaaaattctgaaaatttgtgggttgatttctgacatatcaaggtatttttgagaatttttgtagaattttttttggatgcatataatttccagattaattgtttttgtgactctaggcctatcattgcatgtgatgatgagatgattaagatccaaaaacaattaaaatcactccaaaaccacatgatgcatttaaattaaatttagttctcaggtttacaggcttgggtatgttatattcaacgtgtagaatgtggtagagtcttgcaaactcgaaacaaactagagtgttcatatcatgtaggtaaagctgtacaaattctgcagagtctaaaaactaatcgattagccgtgctcgcggttatgagcggcatatggatatgtgttgagtatagacttgtgtttattcttctaaatgctgaaatttactttcaaattgtgatgagatttgagaatgatctccttgctgccatggatggcaatgaggtgcatattcatacatgattaatgtctactttgatgcccatatgctaagtactagcttgctgaaaactatttgaaagcaaatcagatttaaatgtgttttatgcaaacaaaacttgctttatgctaaaacgaaccatattatgccttccttgataatattccttacaagtagagtgttaggcttgtcttggtgcttgccagtatattatttcaaataatgtactgactcttgccgttgaattaaccttttgcttgcaggttttaaacttagtctttgagtgatgcaggttttgactgcttcttctaggatttgaacttaatggggtaaacccctagtcggtgtgcttgt

SEQ ID NO: 100320 - DNA, 621 bp, Oryza sativa
ccgctcccttgcagccgcttgccgtgccgccgctcgccgtcagtagccggtggccgtgcgctgccgccgcgggtggccgtcgggccaggccgacgtagccgcgctccgcgcccgcgctactgccggctgtatcggacagccgactgccgcctcccattggtcccagccgcggtcgatctgggccatcggatcggcctcggtctccatccgggctacccgtgtgtccgcatacgtggccgccacgtcggtgctccgtcggagccacgtgtgcgccacgtggtgcactagcccgtgcctccgtggacttggtccacggtaggccgaagcccttgagtcaccgatgggtgggtcctgcttgtgcaccgcccgttccctctcggtgatgtcataaatcgagtttaattgcacaataattcgttaataattctagaaattcatttaaatggcttaaaacttctaaatttcatatctaattcattcgaactctgaattgagccattcaacttgcaaaattcatctaaaattgagatctacatgtttgtttacttttcatgtactgtttatttggtttttattagagtttttcctcgttttgcgtgctagcgtgtagttcccgtcgtt

SEQ ID NO: 100321 - DNA, 2821 bp, Oryza sativa
acgcgaccttaatatcgaatcaagcccctccaactatttaaaatttacaatcacaggaaagaaaaaaaccattcacgtgtgtcgaccgtgccatgtgtaggaccatgtagcaatgcgggtaaaccatttgcgcgtgccgaccgtgccatgtgtaggggtgggtagcgacgtgggtagccgagtggggtgcacatagcacctcaggttgccaaaaggtgtcagtggcccccacctccactccacactccacagtccaggccaaaaaaaacaaaaaacagccaaaaaaaaaaaagcgtgacgtggacgatagatggagtaacggatcggaggccccccgtccgcaacagcaaactcgatcggctcctctacctcccggaacacctgtcgccgccgccgccaccgcattcgctcgagctcgctcgctccagtcgagctagcgcgctagcgtcgcgtcgcgtcgcgggcgcggcgcggcgcggcgtggcgtggcgtggcgtgtcgcgcgcggctgcctttccgcgccgcgcgcgcgcgggcacggggtgcgcgcgggcgcggcgcggcgcgggctggcgttctgagtcactgaatgggtagaagctgggataaggattggtgacacaaaaccgacgaagagtttttgctaggttggttaattagtgagcttttgagtggttttggaggtattttcgtgtaaagttgtgagagattattccaaggagtttagctcgagctagcatacgacggcgagatgatctgtcagtgactcgagtgtttagctagctacgaggtgattagcaccgtccagaaaaaggtaaatggtgcagtgtataggcacccgcagatcgtgatgctaacttggatttataacaactgtttttgtattgtgtgtgcacgcttgcggcatgctgcttggcagagagataagcccggtcatcatgttaaccacattaaacagttgaaaaaccagagaaaaattatgaagaatttattttttttatgggtgttaccgagtctttacgataccccggcggtaaaagtggtaattgacgataaatgagacactgcttcgaggcatgtgagttcgattaacaaatagataccgtatgacggtatgagtattgtcatgtacgtaattctaactatggaatatggaacgagaagtatcagatgacaacatggtctaccatgatcatcgatccatcttgagaaacgagtaaaatgtttccattacacctcaaaatagccaacaccatggaagactgccgttaacatacgccaacactgtcgcaaaaaaacagagatgagaggcttctgccctctaatgtgagttgctgacatgtaaacccataagctaaacaaaagagtaaatttcacaaaactacaaatactttgatcaaactattacaaaactacaaaactacagatttaagaatgtatttcacaaaactacagatttaaagtcaaatttatcacggaactacagatttaaggtattatatcacaaaaccacacatttaaaaactattttatcacaaaactacagattttataactttaaataaataatagtgctacgatctaaactctagaatatgtagatttttgataacttcatcactaaatctgtagttttgtgatatggtgcattaaatctgtagttccgtgaaaagtttgacgctaaatctgtagttttgtgatacacatttttaaatctgtagttttgtgataatttgactcaagtatctgtttgtgaaatttactctaaacaaaatatttcacacatcagttattcaaggtcagaagaaagtgaaagtaagttaaacaaaatatttctcttctagagggctttagggatatagatctgcagaattttgaaatcaaaatatatctttataaatattttattaaacatacatttttttaaaaaaaaatcagcaaacaagcattacgagtttgagaggatgggaaaagaagagattgagaagatacgcaaaacgagataagccattagagcataattagttgagtattaactattttaaattttaaaaatagattaatatgatttttttaaagcaactttcatatagaaaatttttgcaaaaaacatatcgtgggtagcgtgcacgcggaaaacagagcaaacaatctctctttcgcctgctgcccgcaacctaagaaacccatgtaaatgtaatgcatgggctttaataggcccaatattaaagcccatgcacatagtgggccgaacaagatgggacagcatgtatacacacacatcaccagtttcagaatgggaaaagtacaccgaaggtcacttaacttgtcatcgggttacaaaatcgtcccccaactgcaaaagataccggaggtccctcaactaacaaaaccgttcgcttgaggtcctctggtagttttgaccccggttttgtctgacgtggcgggtgagttagcgtgggccccacgtggaccccacctgtcagcattgccacattagtcgtctctctcttttcctctcttctctgttctttctcatcctcatctctctctctccgtactctccaacagcgagtctatgagacgggagaggaggagggtgtcggcgaccggcgacgcggcggcggaggaaggggcggcgcgtgggcggccgggggcggagcggcaacgtggcggcgggggaggggcagtgcgcgggtggctgggggaggcacggcatgcgggcggccaagggaggagtggcgacgcggcggcggggaaagaggcggcacgcgggcggctgggaaaggcgcggcgcgcgggcggccgggggcggagtggc

SEQ ID NO: 100322 - DNA, 610 bp, Oryza sativa
tccatcacgcccaccctcgccaccggtgcctatgaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccattcggtgtattttaattaactaacaccattgcggtggcaccaatccaaaactatgctcatagtcagagtctatgtaataatgtgatccccatttgtgtactagttgagctaagcatggctaagtatttcctaaaccaacatctaatcattttgataccaaagttatcaatggcatatgaacaataaatggctgagtaataggacccatctcacatgacattgtaaaagtatgcgacatttaatagaaatgcgggatatttgtaaattgggtacaatatgatcaattgtaatgcatgacttgccttgctctcgcactgatgagacctcagcaacgtcttcgagaaacagcggatcgacgaaacggccgaaatctacgcgacaaacaaagcacacaagcaaaacatgctataagactactgaaacaggaaacaaaac

SEQ ID NO: 100323 - DNA, 1012 bp, Oryza sativa
atcttttgtaatgtaaataatttttctacctttttttcgtcttggtttcattgattttgctagcgagaacataagagcaataataaaattgtgtacagatcagcgaagaactacatgaaaaatggaagtaattccatttgtttctcttgtgtggtttgtggtttgtgatttgtgtttgtgcatatattttttttccttgagaaatgcttctgtgcataaataagttgatctctttgtatcatagaagttctctctgccctgcaatgtgtatgataaatcataatcaattcgtggttaatgttttatgcattattactagtctgtatttttagttcacattattcctgttcctatcaaagaattctaagttgatcaccaacctcgttttttttgcatagatgacaatttcaattgaaactattaactatgtattgtccatacgcttctgacctcactgtaaacttggagacaacagacaaatcctattttgattaccgcagcatctgggagtaaatcgaaatgaatattcaagtttctttttatttgcattctgagatggttttctaaacctctagcacaggccaatgaaaacttcgtttttagcttaattatcccaatagaaagatgcacatatgtctctggtatttaaccatgtgtagtactagtacatttctagctcatgccatgaacctgattttaggtcggcacaacaacttaattaatcggtctctgcaacgcgtgagacacgattgatgttgatcactgcctccaattgctggccttacatgcaccttaattaaacctgtcttaaggaagtctccaacctctcaatcactgcgtacttatctatcctatcagtgccatctcgatcgttcgttttccttgcacactaatagtactagctctttttctttactttattaactgctaattaaccagtcaacacaatcaacacacagatgtacgtcagagcccaactagctttacatgctccattggaatattacacttt

SEQ ID NO: 100324 - DNA, 736 bp, Oryza sativa
cttgtaataaagcatagggatagaatattttcccgtcagcccattttatgtctctaggttttacctcatcgcttacatgtcgtaaaaatatatttgtaataaagcatggggatagaatactttcaccataaattaaatgaaaatttaatttttagaacaaaaactaaatgaaatttgtacatcattttcaacaaaatttaaaccaaaataaaaaatattttttggttttcactttctatgtgaaaatattttatggatttaatcttttaattttttttgaaaaaagtagctcgaaaatttaaaagtatttttcaaatttggtaccaaataattgtcccaattcatttaaatctttggtttttcatgaattatgtttctcacatttagatttatgtttcttaagtaagctaagtacgtgagcacgagatatggggcgatacagccttttgaaaaaaaaaaattaaaattgtcaacacacagtgaactaacaaagttaagttctatatagaggggatcaaaatataaaatataaatgcaagggcatgtagggaatgtggaaaaattcaggatacataaggactgagaaaaatttatagacacgtaaacaatttttctcttaaattgaaatggttttataaatgtttttaaaaattttagtatagtgacatctattaaagaacatccgactcaaatttgatgtacacatcgagggaaaaaaacaaatttgggtgcaaat

SEQ ID NO: 100325 - DNA, 610 bp, Oryza sativa
atcgggtatacgcatctgtactggtgccattgtgtttggcaatttttttgtctaatcgtatctcgcgttccagtattaattatcagccatccgtcctcgtgtcgcaaaaacatgatagacatgcagtttaagtgtacgattatgtttacagcttatttgaaaaaaaaatgattatgtttacactacagtgacgtccaggataatggtcaaaggcagcatttgtccagatcagcccagcccattccatggtatcttacctcaattacaaaataagttcattttaactaatctcacatatacaaatacaaaatctcaaaaactagaatattcatattttatcaaatcccaatataatttctctctgtccaaaaatatataagattttggtcggatgtgtcccaatctaagctagactcttctgttcagactcgtagtataggatgtgtcacatccgactaattttttttattccccttaaaaaaatcttttgtattctaggatgggtggaattttgctcactttatctactcccaataaatcattccctactttcataaattccttgcaatagttactccgaaaatacactagtgtataactttgagataag

SEQ ID NO: 100326 - DNA, 693 bp, Oryza sativa
ctatagggcgaattcgagctcggtaccctgagcccaccagtgattcaagggtattcagacgtatacccaagatttttgaaaaaaaataagtatatatactccatacctcgtatatgtattaaaaaattaaagagaaagctaaaacttctcattttgggtcctgttttaccatttcttctctatggaatctaaatttcccacttcctccttccccttccccttttccttcttcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcat

SEQ ID NO: 100327 - DNA, 952 bp, Oryza sativa
cctctcgtttccttaaaaaatatatgtatagaccacgcgcactgcataaagctaacaatgtgctataagatactacctccgttcataaatacaagggaagccaacatacaacaacattaatccattatatttgtggataggggtatgtagtactaacgtatataatggtagtgtgttacacaaaaaacttgtgcaataacaagcaacttaattatagccttaagaaaaaaaaagatgccacacaggcacaatattttcatgcattccatgaaaaaggaaaaacagaacaaaagaatgcacggagccgtgttgatcatcatgaacaaaaggcatttcccttttcccgtaactttaaattgacagcatgcacgtatatacatcaggtttgaccaattttacttatcccttcctttttggctgctggctggacatgtggtatattatccatcatcaattcattacttcgtgacttcatcaacacacctactccgtcactcctactgaataaagcgcaatcagacttgaaatgtaaaactaatataactttaaatttctcatataccatgtttgtagcaataaaaccataataatataaaaagaaatccaaatgtcaatataacgatactaattttatcaaataagatttaatttataataaataattaattattggtcaaatattttaagtgttgaatatgagcgtctagctactaagctcggcatgccaccaatgcaccaatatgcgtctgaggaataaattaacgttgatgtatcttatctttgtctccaaaaagaatccggccggactctcaaataacaggtcaaatcggcacaaaatgcatctacagctgaaaaacagcataaggcatgtatttcatcccttcacgcatgtcttgctccctctttttccagatgtgatatatgatctacaacgtaagtgttacgtagctga

SEQ ID NO: 100328 - DNA, 792 bp, Oryza sativa
tgaaagcgtgcagctgctgcggcaaaccaccaagcctcattgctttccaagggggatttagtcgaaaggtttaaagctcaaggggaatctataggccaggagccaaacgcatgcttaaaattcttccgcatttcgtaggcgtggaaaaaggcggcaggtttgtcaagcaaaaacctgcacttgacctaacaaattcaaacatttaaaataacttggactttaaccaaaccggggtcagcaggttgcttttcttccaaaataacacttacttttttaaccttcttgctgttctagctgtatgaatgtcattcttttttcaagttccactttccttgggtggtattgataacatggtaacaacatccatcagaaagtggctgtaatttacaaagttggatagatagtgcagcattacgcatacagaagtacagaatcggttccgactcaaaagtcaaaaataaaacctgacggccttcagatgactcacaggatcattttggcaacttttgtgagctgggggtgataaatactgtcattagttgttaggcacattccctcctgggattattatacagctcaagctgcgagtttgtaaatgcaattaaaatgtttgccgacacatgctactggcccaatcttatatcggtgtggaattaaacacatttggctgctgagtttcagtgtgaaattaaacacatttggctgccgggtttctttataccatcatgtctcccggatgcatgcatgtaactagctcggtgtactacacattcttactatcatctcccattg

SEQ ID NO: 100329 - DNA, 910 bp, Oryza sativa
aagccggtgtcgagcagaggaagaagtccccctcgcctactcctccgacagcggcagcttggggtgactgcaaatgatcgcggaagaggcccacgatggtagaggggatgcccgttttttccccccccatgtgtctgcggttcctagcaatgaagccgatgggttggtgcgggatccgacgacgttggaagaagctgagcgaagggcgccgtgacggtggaagtgaggatgggtcgccggtcgagattgatgcaaatcaagctggaatcgaggttgatcgacggcttgggaaggagctcgagggcgacaacagtgagagcgtctggcacgaaggaagcaaagatggcgaggacgaggaccgccacgacagctaggtggagaagcaggatgggagcccgatggcaccggctacgtcggccatgtcgaagcagatcaggtgggtggaggtgactaaaacctcttgagagaaagaatatgagggtaaaatgaatattttatatggtttctctctcctcaactaagtgaatgttgtattttaatactcatgtgttttgcagtaaattatcatactttctgagtactcgaacaaattcacgtttttacaatatcccctagaaaaaccacattctttgatttttcctgtagcaattatattatttttaaaagatattgcagcaaattaaagagcatatagatcctatccttgacataaaaaggagaacttcttttaaaagatattgcataatgaatccataaattagtcaataatgttgacagcatgagtcggcataacaaaatttgttggctcaattaatggatctcgattaatctgtcacatataaaatgtagggtccattgaatagcaaagtaaagatgattgggtaccgagctcgaattcgccctatagtag

SEQ ID NO: 100330 - DNA, 551 bp, Oryza sativa
aaagctattagcatatgattaattaagttttaattattacaaacttgaaaaatggatacatttaatattttgaagcaactttaatataaaaagttttcactcaaaacaagtcgtttaatagtttaaaaagcgtgataataaaaactaaggtaaaatctttatctttacaagaaatgaactaggtcatagtgtctatctatttgtagctcgcattcaccatgcaaaatggatgagtcgtgtacctattttctcggttgtcttattgttgcaattgcttattaggcaaggcaaaataaacactcccctttttttttccccttgacttgactagagtacataaaaccggacaatcatttcttactagatttaaccattttgactctagtatacatctttagtgctgtgtgtgggaatggatgataagtattttttaaagaaatacggcctttactatatgttaaaacaagaaatgatactacagatgttagcttcgtactataccaaaatgcaagatcctctcggtcaattaaatataatttttttgctgaaat

SEQ ID NO: 100331 - DNA, 629 bp, Oryza sativa
cctatgcaaatgcatgagtatatttactttccaaatctaaaagtttagtgatacgaggtgtaaacaggtgcgagtgtgctgcgcatgtacagtgatgtgtatgcatcttccgtgtaatcaagaatgtacactagtgtgaacgtgtctttcatgtaatcaagaatgtacatcagatgtgtatgcgtcatccgtataattagaaaaaaaaggagctgttcagattgtagtcaaaataaaccttaccaattttttttaagttaacaatataactaaaattttggcatgatttttttatgtatttaccaaactttggcaagaaactaaatatatatacatctttgataattttacccaaaaaatggtatgatttgaaattgcattaatctaaacatgccctaatgaattagtctgtgtttagttccaccagtaaaaaaattttactaggtcacatcagatatatggacacacatttaaagtattaaacaaaacaaattacataatccagaatgtaaattgcgagacaaatttattaagcctaattaatcgcgtcattagcaaatatttactatatcaccatattgtcagatcatggcgcaattaggtttaaaaaatctgtctcgtaatttata

SEQ ID NO: 100332 - DNA, 617 bp, Oryza sativa
tcacaatctttcaccaccaattaaccaaacccaacatccacctcagacactgcattcttctcttgtctaattttttttctgacaagaaaagaatatcgatcttttccgacttctgaagatccagaagtccccgaactgccgggcggtttcccaacccccgacagttccaagccactagcttcatttcttcccgcaggactggatcgcaagtcccgcttccattgggttttgttcctcactattctttagctctccctccttctttcgctttccagaaacttcctcccctccctccatctatcttctctttcccgggatcaccgtccccgagcctgctggcaaaatcttacctctagtctcccttgtcattcttttgaaagttttctgtttgctacctcctggcccttttactcccgatggcacctctccctgagcagcccctccgtcgacgtgcatgggctgcatggcgttgttttccatgtatttcccctgggcgtccgctttttcctgcactctgtcatgttgagctggtttcagcatctcccctcctatttcgcccccttggggctgattctttcccgcactaaccatctccttctcaatggaaaacaatgctt

SEQ ID NO: 100333 - DNA, 512 bp, Oryza sativa
cacgccgccaccgcatagtcgaatggcgccgttgcccggcccccacaacgcgtgaacccatcgtatctaggtggtatttagttggagggactaaagtggggctaggctaaactttattcccggtagagacttatgtttttgtgagagggactaaatttagtccctagttcccaaacacccccctaatcgcgcaacagttcccagctgcacccgtgcccgtcgcatccggccacgttgccatgtccagcgccccagccgcttacagcgccgaccactcacgacgtcagcgccggccactcgtgacgttggccgctcaccatgggcactcgcccactccaccgctcgtagcaccgactgtaccgcctcgcccctggtgccgacaggccaccgcgactctccagccggccccctccccccgcgcagcaaggggggcagatggagctggagcggcgttgcatgacggcaaggcgtgcgtccgcgccacgtgcgtgagggcaatctggtctttttcg

SEQ ID NO: 100334 - DNA, 729 bp, Oryza sativa
atggcttgactagtgagttcagggcaccggcaacaagttctactcaggttgtggacacgatgttaacatctctgaccactgcacctcaactcagccgttcccgctggcagccttcgcgatggagcaagaggtggcagtgcagcagaagatggtgctgagtataatgatgacaaggccggctgtggcaccatcgcctcgggcgaagatggcggctgacctctggaagaagcaggagacacaacaaatctgacgaaggtcatcgtcacacggcatcagcaaccactaccgtgtccacgtcacttcaagttgtccaggcaggtggattcgtgtcaccaacggccaggtccaggaagccctcaacctcgacgttggacttggcaacgacgtcgtcgtcggcgaccgcgatgcagggtgatgccacgagcagggccgtttcttagggctcacaacctctagcaccaacgactgcggtgattgcggcgcaacggctgacacaaccttgggcgcgatttccaggtgagatggctttgtttcgtcatgcatcggcacgattttcagagccggatggattgaagcaatgtgcagcggctgcatggcttgagtcatgttaggcttgtttagggagttgtctcagccaacaaagatcgtgttgcagcttgaggatgagctgctcaaaagaagggtgtagtgtcatgggcattgggacagaaggcagaggcccataagcag

SEQ ID NO: 100335 - DNA, 798 bp, Oryza sativa
tggcaaaaccacaagttgtatgagtatatagggtgtgtttagttcacaccaaaattagaagtttggttgaaattgaaacaatgtgatggaaaagttgaaagtttatgtatgtaggaaagttttgatatgatgaaaaagttaaaagtttgaaaaaaactttggatctaaactcggacatagctgaggtttttcctagcaagtgacagggttgaaatatccatcttctacatatgtgttctcatggttgtgtgtgtcagtttgggaaagtccttttccactggaagggatttccaagtaattatgcaattttttaaataaacaaaatatattaatatatgatatattactacataaatatataaatccagtttatgcaagttgatgggaaaaaacaaatatggccatcaatagtacacgtacttgttagattttaatttgtttttataacttctattcattaaatttggtcttatatgtatgtgagtgatataacttatatttatctgtgttattatctttttaagaaaaaatttaactattttaatgatatggaagaagcgaggggcatcttagcatctactcgagggaaaaaaacatgtcctgttcggtctagtttctgaagaaagaatccacaagtctttgtgctaaattcaaaaatgaaatcatggatttcggctgatctctctgactccctgtctcatctgaacttgctctatacggcagcgcgacgtgtgggtaaattagcaattgccaatgggcagcatgccactgttaattaaatcgtccaaatcaaagata

SEQ ID NO: 100336 - DNA, 1645 bp, Oryza sativa
aatcatggtggtgatttgagtgctgggtttcagagcagatgtgtgtagtgcaatgcaaggcaaaatgcgacactgcctgctaattgatgcgtgcacacgtgcgattcgtattattgtccttctaccctcaagaaaatttgtacgtatatgtgcacacgtgtttgagctttcagtatttttttaatataaaaggaagttcagaaaaatcaatcaaaattttgcaatacaaccaaaattccaaatttaggaaatgtacttcttttttttatatataaaagggcctcattccgttgataaagaagagaagaaatgtactttaagcatcggtgaatttgaattgaagcttggaattggaaatgccatgttgcccaaccacatgtctaattcagtatttcagttatcactatctaactacgatgattagaatgtataatatttaagtacaataacaataagatgtcgaataaatgctgagatttcgatgattggattggtataaccgactgcggtttgtcttactggcgcctaaattaattgattaaaattttaaatgcaacaatggatgcattagttcgtcagctggaaaattttttttggagattaattaggacgtagctgttgcctgccaccaatcatggcgacaacacagccgctacgaaaggaacggagattacatactcgaaagagattctttatcgtcagaaaaaactgatgaccacagcagcagtgacaggccagcacgaagcaggagtagtagtatatgaattataatttaagaaatacacattatatttgtatatgggttttattattatacatgcgcatttcggatcatatgcgtatcaatgacaaacatgatgaggcaatatgaaatgctggactgcctgccctggatagagtcatgcagatacttgtcggcagcattacgcgttgcttcctgcagttgcatcatttttattttcttttgagtacttttaaggtgttttattattctactgccagtattatcatccataaaaaaaattttatcaattgatttataagttctacaactagtagtaaaaaatatttcttatactaccaacagttaagttagtagtataaatagaaatgatacattggactagaaaaggtgattataaaatatctaccacctctgtttaaaacatagcaacttttagctataaatttcaataaagatatgtttatattcgtagcttaaggttattatattttagaccagaggtagtattttattttattttcttttttgcatcatacaattttgctagttttttttattctacatcacccttccttttttattatagtttttttgagatggacagatacggtaaagagtactttggatgattgttaaactgttttggagccacagatgctgtgttttgttgtggggcttaaaaaaaaaaaaaaaccttcaagaactttgttgggtagattagtattctccgtttgtctggtccggcctgccattctacagtactttagctggctgggccaacatagcttgatctgatttgcctcagattaattctgcatcatccacacaattgcagtttggatacacacaataattacatttaattgtaggatccgatattggatttaagtttataaactg

SEQ ID NO: 100337 - DNA, 624 bp, Oryza sativa
agatgtggtataaccaagagcccaacatgacatatctaattagaatacattgtatccatatataatttaggtaattatttgtctggtctaatccatgcatggtataggacacatgcaaatagatgcaacccatcttaaacacatagctaggctactaggctctgccataataagtaccctacatggctagggtacgggactactagtagctattacagggatttgacatgcacagcaagctagtagtactttcggttttatttaatagctaggctagtatcaaaggcaggacaggcatgctgggtattagctagctgtcaggaacaagactatacactgatacacatagcaaacatgcgtgatgataatcctagcagcacgcgacatactcgggagaagccggcacgcggggccgcgtcatgggggataagcggtataccattcaacggtataccgttgtgtagtctttctcttttagtaattagggagtcgagatatcccggtattgtggtttagggatacgaattagattaagcctctagttaaggggagtcaaagttgacttactttacggcagaacactttccggccgagatagcccagtaaggcccatgggccttgtcg

SEQ ID NO: 100338 - DNA, 596 bp, Oryza sativa
atgtttttaagagagaagaaagaagagacaatttggattatagatctatcatccaaaggctagaaataattggggtgatgtggcttaatgagaggagagaaatagcattaactacacttagtggggatgaactatgtaagtataaaggattcctgaatcctaacgacttttgtcaggttcaacatcttatcagtattattcgaggatcaaagaaaatcatatatatccttcatcagttttgtattttgtcacacgctccaccctccaattcaccagtgcagctgtcatttttgaatctgtgcttaaaatattgctagcttagctgtgcaagcactcttgtgatcctacaagttggtgcaagcacaaagtgttcagtttgtgagtctattccctccaacgtgattttcagtttcctctttgctattatagttttaagacagttgtagcttagcttttagggtagtatagacagaattctataaccaaggcatgttgctgtggcaaatggtgtgagggcatatatgctgagtataccacatgctgtttggactcagactttttaatggtccacacacccaacctattccatggaccat

SEQ ID NO: 100339 - DNA, 518 bp, Oryza sativa
aggcagattggtatactttcaatttgtttttaaataatgacaggagacattcactttcacactttaccattgtcctcttacaaataatttacaaacacttaaaccacgtcattaaagtggtaattgtaggtcaaaagtcaaatactccctttgtcctataatataaggattttgggtagatataacacatcctaatttatcctgattcattgtattagaatgtgtcatatccacccaaaatttcttatattataagacagatacagtagtagggattagttatataacttttgaaaaaaatcatctcaaaattaaaatttatcgaatgtgactacagtacaaccttaattaatataattatagtgtaattagaaagtaattacaatatattttaggtgtaagactcataaaaccacacaacacatgtagtagctcagtggatgtaaggtcgtacatgggatcgagcccctgcacgtgagatttttttctcccgccacccgtgaatctttactcgtatc

SEQ ID NO: 100340 - DNA, 570 bp, Oryza sativa
tactccctccgtttcacaatgtaagtcattctagcatatcccacattcatattggtgttaatgaatatagacatatatatctatctagattcattaacatcaatataaatgtggaaaatgctagaatggcttacattgtgaaacggaggaagtacaacatataaatgatctgcttggcttgtcaggttccaatatttctcacagggtcgctgtttctccgatctattattttacagggtactacaggttgtggattatcaacaatgaatgggatccaatgtgcaggtgatgatttgtcaggttggcaacttccattcaaaactttgcggctacattttttggttatctggatgagttgattgtaatgccgtgcaatgtaatcatcaaaacctgtggtggatacaactggcagtggggtgtacagtttattttaaggaggggcagccctgattgcagatcaattcttacgcacgaaggatctttcagtaatacaacaagtctttttcagtgctattgttttgtactgaaaattgtccatggtcagcatgaatctggatagattctaaagaa

SEQ ID NO: 100341 - DNA, 708 bp, Oryza sativa
atgtttctctctatattcatttccagtgttcataggcgactatgtgtgtgtcagagatcgaattgtggatattgattccggaataactaaaagtcctgcagtcttgatagtgaggtatgaactcatattctaagtcttgggcaacttgtaagttactgcgtcaatcgttttgactgtgactagggaaacaggtaaatataccatggtctctactggttagtattaggccgtgtttagttacttttcaaaaaaaaaattaacatatacgaacctatatgaagtattaaacgtagattaataacaaaacaaattacagatttcgccagtaaactgcgaggcaaatctattaagcctaattaatccatcattagcaaatatttactgtagcactacattgtcaaatcatggcacaattaggctcaaaagattcgtcttgcaatttacatgtaaactatgcaattggttttttcatccacatttaatgttccatgcatgtgtccaaacatttgatatgacagaaaagttggaagtttgaaggtaacatagccttagagcaagtataatagtaggctataagctgactaaatgtgaagtgtaggagagaagagaggagagagaggagaagcgggctgtaaacttaaagccggcttggacgcaagaaccaagccatattcgtggacactagaatctactccctccttccaaaaa

SEQ ID NO: 100342 - DNA, 1092 bp, Oryza sativa
tttcaaaagttatataactaatccctactactgtatctgtcttataatataagaaattttgggtggatatgacacattctaatacatgaatcaggataaataggatgtgttatatctaccaaaatccttatattataggacaaagggagtatttgacttttgacctacaattacactttaatgacgtggtttaagtgtttgtaaattatttgtaagaagacgaatggttaaagtgtgaaagtgaatgtctcctgtcagttatttaaaaacaaattgaaggtagtaccaatctgcctcgtcgtcttgcacgcggccaaagctcatcgtcttttcagacatttacagtcgacagctccactctccatgtcaatgatttagtccagaacccaaatcaaaactgctgatgagttaatcatcatcttcttttctttttgggcactcaaacaaagtggttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggatactttatagttcgctaataacaatatatacagggatgcctgtggctgatggctactgtcaccaccaacatcttgttattgctcagactaaagtgttggttgctagctcaagtttaactagctccaaatacaaatcttcactcataataatggtgttgctggtccatgcttgatcaaccatgcaagtgtggtgttctttgagttgggtgttgtcccatcaaaatcctctgtatatatatacttgcatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgag

SEQ ID NO: 100343 - DNA, 1231 bp, Oryza sativa
tgcaacatcttaatttgtttttgatgtatgtgctttaatttcctttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactgaaaaagatttaatttgggatctgaagaaacacttctccttatttactactaccagcattagtcttcctgaacattgaattgtgtacttgcaggagtggttgctattcataactgtcaatctgtcatgcatggtgttattgacttgcctgtaactgctgaaaaagctttttagtatttatcaagaactttgttaggtaatccaactctatcatccaaaacagcaccctcgctctcatctacatgctgcatgattccacaaacgcattatgattgtcagatagtcattattcatatcagtagccaaaaagttatttgcctgtgatgaaacagaaagctagtctagctaagatagttgcttcatttcagcatcatccagctaaacagcactgatcatcacctcccttgatcctttgtgtcaattagacgtcaccctacctttcttcctcctcttttccaggattgggaaactgctagcaggtcaagcagcattgtcagcaacagcatgagtctgcatctactatcccaaaattatgcgcatgatttatatagttaaaaagaaataaaaaaatatagttatatatgtataccaactctataaagatataggggatgctttaactttatagggaagaatttgaagtggtggttatatttg

SEQ ID NO: 100344 - DNA, 834 bp, Oryza sativa
gacccagctctttggagcacctcaacggagagtaggattgcaagatctgaacttcaggaaaaaatcacccttgtcctctctgtgatgattctgtgcatgttgctgtgattgtatatatgctctttcatccagtagtttatttcgtgcaatttagttcaagtccctgttaaggtcttcaggtttttctgttgcccggaagttccggacagtctgagcagaccggaagttctagtgttctacatccggaggttccggtcctgctgaatttaaagctgcaaatttgtttgtaattttaaggaaagcctattcacccccctcctctatactacatctttgcgcgttcagcaatgaaaatgagcagttacctctcaaaacatcaggacaaatccccaatactaacgcctcctaatcatgaggactgggcgggcgtggactggccggccgcctctcccgccgacgcccccacctctcgtgtcggcgcgcctcctctcctcctctcctgccacctccgtcgcgtcgaccgcctccgcttgccgttgcaaccgcactcgccgatgcccgccctcgcagccacgctcgctcgccgcttgccctcgcagccgctcccgccgacaccgccgctccgcctgcctccgcccgtgcccggagagaaaaagagaacaatagaaaaatgagggtcacttacatgtgggctccgcatatttatttttattatttgtactgactaggatgtcacgttagcgaaaccagcccactatactgtcttgggacctcttttgaacggttttgtatagtttaggggtgaagatttctggttttgtggttaagggacct

SEQ ID NO: 100345 - DNA, 616 bp, Oryza sativa
aagcaaaccatgccactctcaccaaatcaagtactactaagagtatgtttattcttgccgtttagttcatttttgtctttttttttgtccattataaaatattttgacctatgttttttgtgtattcctagatttagcatgacatgtttttttcacactccaatgtatataaaaaaagagtgttatcacttatcacgggattcatgagcagatacgtgtaacttactaactttgattaactcttttatatgaatgttggccacacaaaatgatgtcagtatatttaccacagaaacctctgatgattatactctgtccagaagtataaggatacgtagagtttgaaatttgtcaaagaatacaaggacacccacacctacttcgttatctcagccaattataaccatccctcacctcaaccttaatctctccacaaaacacgggagtacaagttttgcaaataggataactgtggtgcaaacactttcaagtactccctccgtttcacaatgtaagggcctgtttggcacagctccagctctagctccacccctcctggagctggagctcagccaaacagtttctgctcgaccaaaactaggagtggagttgggtg

SEQ ID NO: 100346 - DNA, 2061 bp, Oryza sativa
gtcgtcgtatccgtcgcctggcacgccggccagatggtcccacccgctcctccgcggcggcggcggccggacgggcaccttcacgggagccgactggtggtacggcaccgcggggggctgctccgggaggtggaacctcaccctgggggccgatgggatcgcgcgcgcggcggacgggggcgactgggtctgcgccgaggacgacgccgccgcctccgcggcggcgatggtcgccttgcggcggagcagcgccccggcggcgccggcggtggccacggcagcagcgccgccgcgcccggagagcttcctgtccccctcgtgaagcgcggcgaggagccctacgtggccgccctggacgcgggccggtttaccggacggatcgggaggcggcggcggcggagggtccgaggacggggccggcgcgaagaggaggtccccctcgaggagctcgtcgcccgccgcggtcggggaggtggggagagacggggtcggcgaggtgaacatgccgaggaagcgctccgccggcggcgagcggagcgtgcgggcggcggagtccatggtggtggtggtggtggtggtggtccccactccggcgagggccggcggtgtcaggaggtgggggctgcgtgcttgactttttcgagcatcgtgtgggggctttgggttctatatactccggcccacagattgagatttcctaggcccatcttgggctgggttaacgtaggcccatatctcgaagaggaagtaggaaatgtacatagacggcccctcatcttatcatcggattacaaaattgtcccccgacaacaaaaccagatatatggcatcctcgacttataaaaccgcgtcactctgggtccttagacagttttgaccctaattttgtctgacgtagcatataagttagcgtgggacccacatgggtcccacgtgtctgtgaaacctccctttttctttccctttccccatctcccgtctcttcccccatctcttcctcatgtctagagtggcggccccaatgatggcacaggaggtggctaacgaggtccatcctcactcccctcctccaactccttcctcggcatccccgacccctccctctctctcctgacgatcttgattgagcggcggcacacccttcccgaccccatggaccccgacgacggcatggacagtaggaggcacccgacgagctccactcctctcttccttcttctagatccctcttcctcgacgtcctcgaccccttcccctctctcccagcgatcttgaggaagagcggcgacggcaaccttcccgcccctacggaccccgatgacggggtaggtaacggccgacgaggtacacacgctcccctcctccaccaccctcttcctcgactcccccaccccctcatagcgctcacgtgttgttgcgccctccgtccccggtctattgacttcccgtggagcggtggcctctcgaagcccctcttcccgcttctgggaggtggtcttgggagagcacgtctgacgtgcagcgctcgctagcactgtcctctcggtcgccagcgatagccgggatgtgcacggaaaggacgacgcacaacgcattcttggtcttcctccacatcccgtccattgctcctagcacacgcatgcgtcgccactgccaccggtccccgggcctcttcctctgccgcctcgttccaccggccttcgcagcaatcgcttcgccctgcccagacaatgatgagaaaagtgatagagaggaaaaagggagagaagaggggaaagagagagggtgatgacgtgaacaccttgacacatggggtccatgtgggtcccacgctgacttagttgccacgtcagacaaaactgaggtcaaaactgcctaaggactcagagtgaactggttttgtaagttatggtatgacatatctagttttacggttggggatgtctatgtaatccgatgataagatgagggacctaatatatactttttccgaggaagtaaagctacggcccaaatggaataacggactgaactttgaacccaccggtttcttccaccgta

SEQ ID NO: 100347 - DNA, 557 bp, Oryza sativa
atgtacatctcagatccatacaatgagattccaaaaaaaaattatacatctcaatccatacaatgaaccacagattcttcatctcaatctacacatggatcacaaattctttgaaaaaaaaaagaaaaaaaaacgaagcaaagccgccggccggctgagccggccgccgcctcccctcctccccggctgccgccgccgccacgcggccctccgcgccggccgccgccgcgctgccctccgccggccgggccgcccaccccctcctgctgcgcacactggatcgagttgggaaggggagttgggaaggataagaagaaaaagagataaggaggaagggaagagataagattagagatggagggagagaggagtgggtgtggatgagaaaagagtggacgaaaaaagaggataagtaatagggattatatagtgtattttgatctttaatcccggttcgtaactccaaccgcgactaaagatcctggaggggcctgaccacacctgacagcctgtgaaccgggactaaatatcatctggtaacaccaacctggactaaa

SEQ ID NO: 100348 - DNA, 594 bp, Oryza sativa
agttttgctctttttacaacaaactttttggggctgttttgatcaattttggtattgaatcacttgaagaatcacacacacaggttaaaaatttaaaaaattataattgcccactgcgaactcggtttcacctcgaaccaccaagacatcgtcgggcggcgcaagagctcaatcaactcagctcttgccttgtacttaaatttagtgcttatatttttaagtacacattatcattctttcttatctgctattcgtttaatacttcattacatgttttattctttactctcaattaccatgaaattaataaattatattatgacatgttggagatattggggaaaaatgtagacataagtagataaattttaaacgcaacaaattcgtttttaaatatatcgctaaatgtatacaagacatattaaccgttgatgatgcaatatctgcggtttggtatgcgaacccgtcgtttgcaactttggacacttgcaactcgttcatggaggcagccataaacttcaaactcatacaaacaaagagttccagatttatttccaaaaaattggcaaataccccacagtacagtgttttatt

SEQ ID NO: 100349 - DNA, 6002 bp, Oryza sativa
aaacgttttttggtaggagtatttggttaagacttggttgatggtttttccttgacttggttgtggtgttttttcacattgcttttattttccattgtttttttttgtgtaaagcgtatttaggcgcatctgcaacacgagattattttttagaattgcaagtagaaattatggaaattccctcgtaactttgcataagaaagttgggacaccttaaattcaaaaggtcaagtttgaatttgacaacaaaaggagatgaacaattgattaaagtggtcagtttattgcatgcattggcacaactttagtgggacaccttagaagaacggtccattcaagtaatgatgcaccttgcatgcatgttccatttgatttgtctgatgttctaaaccataggtttagctttcctagtagcttgtaagcattatgtattgatcaatggcaccaaataagaaatataaagtaagatgtcatgtatgacacatctttagaaaaatgattgaggggccatgtgaattgtgaaacatggaaaatctggaaaagcaagaatggagaggggaaaaaagaaattgtgtgaaatgcctaactggtccttaaaagttttataactcataagttattgttttgattgagatgttgtggtgcttcacaagtggaagtgcaagaatttggagacaaaaatacacaaacgaaaattttcagtaggttagccatttattactttccttgaaattcttctggtgaagccaccctataggaattctttttctcggttcaaaacatccatgcatatagcaaaatgttttccgagtgattcaagctctaccaaagttctttttaaagaaaatctttgctccaaagggccctattttgttgaaagaagtatactatggctaaattttgtgtgtatattttggtcgatgcatcttcaccagccacatttaacctgttcaaatttcacaagtgctatgtccgtgcgttgtaacgggatctagaggaatatagaataatggttttatagggtttatttttctctatctggcttttttggtgggttaagttttacgtgtgaataattatcgtagtagagtgggaaggttcattttttacgggagtttctcgtgttgtgcgtagtaggaggtggaaggaagacgactgtgcctttaaaataatagagaaaactaattgtcccccattgtctttcttgatcatacctcttttggttgactaacataaggcacataagtccattgtggatggtgggagaaaaaaaaacctgtgcacaattacttaatgtggagtgagtgctaattaccctatacttttttacagagaacaatgactctgtatataggaattgaggttctagttgcaagtggtattcaatccttgagttgatttgaccttttcaaagataataagaagaatcttctgttcatactagtagatcaaactgggatctccataggggaaaaggcacaacttttctaaaaagaaagaaaatagttttaaactactgactcaggacttcactgatcatagcagacatcaagtgctaaaaagagagtagattaattctctccaggaaagaaagataatgcagttgtcaaagttgggcaacttcgtcagtgatgcttcatgattttttgtccaatgtatagaaaaatttggctatagacctatagtacctctagtggatcagtggatgagacgaagttgtgaaataaacttcattttgcatagcctttggtcatcgatcactgattgattactatgcgaaaattaacaaagagtagtggactttggtgatctgaaatagcttagggcaacttgtcaaatcatggtttcacagaagttcttttctttgtgcctgtttattggttgtttgtgcactcttcgaggtccacatctgttgccttctttgcaagagatggttttcgtttttttttctacttgcttttaaattaatttactttatatgtctaaagattttgcctttattttacattctccacaaaccatatctttttccgtcaacttgatttaatattttcataacacggttaaatcctagaaacatcttttgttggatgcataattgtagacattattttggtttggatatgcatggtgtactttcattaatcttctctttttttaggactcattaatcttctcttagggtgcgtttgaaatggctgaatgggtgaacagatggatagataatgattatacgatattacaatgttgtgatagtatttgagggtataaataaatgaattaactataacaaagttgaaattttgttttaagaaagtattctttttttctctcgaaaacgaaggagtgctgcatttcatttcattaaggggaagaaaaaacaaatacaaaaaacacaacacaaagaaaaaaaaataaagtaggagtgctcgagccctcctaccaagacccgcacacactaagctacccagggagcttagtttcctaggttagccgtcccactaaggagcttttgaaggcgagaagctccaacaacaccccaaatatggcccaaagagaaagtattctgagcaatttaaaatttgtataacaatcccaagtataattcctaagaggaaagaagtgggggtacaacgcatgagcaccacactcagctccacaaggatacatatatgtgttgaaagatgcagtctctggtgcatagaaatgagcagcctcagtgaggatgtgcatatgtgtatacctactattgtcctagagagcaaacccatatcttaagattttgtcattgatggcaagcaaagagtgcacacaaatacctcgaaatcgggtcgattgtacgtctcacacgatcacatcaaataaaataacgtcaaagctcctgatgatagagaaaatcgtaccggtcatcgaactaagtaaatagcagttaaatagttttattcaatatgtttgttcatgagaaagcgtgggtgtaatcatgaagttgtaggtatatgattgcgtgcgtcattcaaatcttaatgctccagcgataataggaatctgtcgctggtcgctagcatacgcatttttggtacaggtaatacaaggttatttttattataatttgcttgcaatttggttgcatgtgtagctgtattttggtttcatcagatacataacactaacattttggttggttgcaaactcgcaatttttaccatcagtgtttcgatggtgaatacaaaatcttagttatgcacctatctcttaaatttgcctagcatacttccacatcattctcctccaagagaatctactctatgacactgagtttatcgcatttcaacgattttccactagcattatctctttctataatataccggtgaatttatcaattgttctacaatacattattgggctagaactttttttttcaagaaacccaaaatacccttagagacatataaaattagctatcgatttatcttattagaatttttaaaaaaatacaattttttatgtggcctccttacacaacatgaaagtttgaatataagtttcaagtcttttatgtttactttgtacaaaaatatttttgtatggtacaacagagagaatttgcttacacaaaatacaatagaacaaaaataccttatatagtatatgaaagatgatttaccttaaaaataacaataaaaaattatttatatagcatataacaaataaattatatataaaaagtagaaatgcaaaaggtatattcttgtgtggtatagaagagagaacttgtttatacaaaatataatataacaaaaatgtcctatgtagcatatgaaagatgatttacattaaacaaaacaataaaaatattttatatagcatataacagataaattatattgtaaaaagtagaaatgcaaataacttgaaacttaatacaaactttcatgttgtgtgaggaggccacataaaaaatcacatttttttaagacttctaataagataattcgattgttaatattgcatgtctcaagggtatttttgatatttttgaaaaaaagacccaacccaatggtgtattgtagagaaaatgacaaagtcaaccagtatattgtagaaatagacaatgtttggcaaatcgttgaactgggacaaactcaatggcaagaatagattttttttttcttctcctaagattggcttgttatatatctccataacaacaagcaacctaaaatgatgccattaataaaagaaattctatgaattatgcttgggttagacttctaacaattggatccctacctcatataatctgcactgccaatgatggtaatatagccaatagttttagaacatgtgtgatgaccatctagaatcttcatacggtacttattagtatttggccaaacgatgggagccaattacctttaggtagcaactttattatagtgctacttgctagtactatctcatgtagtgatgtgtgcagctaaagttgatcaatgctactatcacaattatctttgatctacaaaccacaagaaagttacactcttcagaaaaacaaatcaccttttccttatgatagtttttttaaaaaaactttcggtgttacaaaatgattatgcagcatttccccttgtgcttattatgtttaacgtcttttctaggtgggatgtggctgatagctgaaccaattgtggcaatgtttcacattttgttgaagaactatatgtaggatagtttgcattggatagagaaatctttttttcgacgtaatggatggagaaatctactggaaggattgtcatattttgtacatgcaaagctgtcatattttgtacatgcaaagccaacagtgacgtctattttgtgtttgtaggtggtactagattagattgggtggttgtggtgtgggcatgtgacatgtatttcttcaattgaaaaaaaaacagaagtattttgtgatacatgataggattaagtcatcaaaagtaaattaattgtgctcttctttgataaatagatgtgttcgtttcatgattattagtctaattggtgcatttgacaatggtacactcgatgcaatatattatattgtgttttttttaaaaaaaaagttgatttggttctcactgtctaatagtatgctgataatgttctaatgtatttggcaaactagtccatagatgtaggacccacatatgggagtccatagttacagaaaccaccataacgtaagtaatttaaggtgggtcccactgaagataaaaaaaatcagccgcgacttattctcgtttccttcgcgcgggttcgagagttcgactcctcttctatcgccgcccccaaatctcgccccatcctgcgccgctgcacgacctctccgccaccgccgcaccagccctcaccaccgcccccgattcctgacaagtccccacgccgccgcatgccctgtccgccgttgccgccgccccccaattcctgacctaaagtccccacgccgccactgcacacgctattttccgccgccggcagcgcaccagccatctctatcaccctccatatcctgaggtgcacgcagcatcgctcctcccattggtcttcccctccgtcaccctggattgctcactcctcgtttatgtatttttttttcagtgcggctaccttcacgatgggctcagatctaggcaccacggcctcgcgaatttgctctggaggctgcggcggtgcacagatggagatgaaggcgaatgaccgtcgacgggtagccggagcagaagctgcagcacgcatgcacctggaccattgggtacatctggtattgttccttcctattcgtagtcaattgttcttttttttattatttttttgttatcatgatgcttcctgtagtactcaataatactcatatgtacatctctcctttgcgtgaatattcacgtaagacttaattcattttctataatgaggacaattaaacgcatgccttttacaggaaccttgataattaa

SEQ ID NO: 100350 - DNA, 592 bp, Oryza sativa
cctgctaagattggcaacattttagtcacatctaaaaaccttagctgcataaaatgaactgaagagtaccttttggtttagtgctaatacgggaggtgtgtcgatcagtttgcttatgcttctgcagccctccgctgttaactttgggcgtcttctttggtgcatcctgaaggggggaaaaagaatgtgttagtgttgcagatgcaaccacacaacattggcaattcaccaactgctacaaatactaattctaatttttcatacatttttgcaaactattttttcataattcatgaaaaaaatgtttaagtatttcccttgagaggcaataaccaacaaggatacagtgttgtcctcggaaagctaacacgctagacttaaaattcacctctaagttgcaggtagcaaggattagcacaagtatcagtcgtcctggccactcatttattacatcataggagtagataatgcgagcaccttacgatgcattggcaccaattgaggtttcagaagcaaacaacatttacaaagcagtcaccatcatcgaacaggatttgcaaatgcgaacctgattcagtccattgacagtacc

SEQ ID NO: 100351 - DNA, 730 bp, Oryza sativa
caggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaggccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttggttcgaacttgtaataaagtagttcaaaaagatgtttgattgtttcaaggaattcttttagcatatagctttgccctttttactacttctatccgtattattcttgtggccaagttaactgtggaagaatctgtagtgttcttgtgacaaagccataagttaaaaaaatttgatctgtgtgcaatattatttttctcaatatgaaaagaagcggcacaaaatactctaaagagaaagatgattcgttttggaaagccaaccccaaaaaccggggcccttttaaagggccccccccaacccccttttaaaaaaattcttgcatagaagcacaccaaccaaacaagggtatatggcaagcctggcaagctggcaacgagttggcttgccct

SEQ ID NO: 100352 - DNA, 695 bp, Oryza sativa
ctgcagcccagatctgtaggattttactcctatgtacaagtccattcgccttaaaataaacaactttaatataagagttgatatatcaatctgaatagatatatgtgttaatttagaattggggagatactgaagatagcactgtggtaaaaataaaatggaaatcttagtgctggatacacccagtatgtagtatctcttgttgctgtaggacatggagcatatgcagaggatggacaggacacgtgcaagatggttgtgtaatgaagtaatagatgctgcagttaaggagcctgggctactgcaaaggacggtgttttggagcaacacaagggagcacagggtagcactgcctcctcctcctcctcacttgccataattttgccattgccatgtccattgccatttgccacaatcttcaattccccaaaattttagcacatcagattcacctaactactactacggctcctacccacttgctcaactgaaagcaactgcaccggcaaccatcactgtagctactctaccttgcaagagaccatgttgtacacgcatattctacgactatatggttgtcagccactatttgctgctagcatattacctttggttttttctatttgacgttgatttgttaaaagacgaactaactactatcaaatactcagagactaagagagtatgatttattc

SEQ ID NO: 100353 - DNA, 730 bp, Oryza sativa
cagacccgcgaacattccgcctatcagagctcataccgtttacagcgttgctaaaccatgaatgcttcagttacagcgagcgcgcgaagctgaccacacgtaccccccacactcattcgcaaactcgcaaatgcagcacaattaaacggctaacagcagtagcaccaccaggccaccttaccttaccacacacaaacacacaccacgagaagccgggcagccccctccaaaggcacacctcaattgcggccctaggggacagccacgagccctaaggaggccacagggagcgtcgtacggagcaggagactcacctaggcagcccccgcgccgggggtgggctagggctagggttagggtttgcggggagcaggggagcccccacctcggggccagggcagtgggcgccgggagcacgcggcggggaggggggaggcacgcggaagaatctccgggtggtggcggcggaaaccgcggcggcggcgcccggggggtcgcccgagatcggtggcgcggcgccgcgggcttcgcgggctcgcgtgggggggtggtggtggtggtacgtcgtatatacagaagccagaggccgcgagggagggaaggagaaagcagattgtgtgtttgcgggtcgggtcggggttgcgaccgggtgaggctcgcgcgagctcgtgcggtcggacccggtcggtcggtcgtcacggagtgagattcgcggaaaggaagatgaatg

SEQ ID NO: 100354 - DNA, 590 bp, Oryza sativa
taaaatatttagatttaaaccttccttataatatatacttccatttcagttggttgttctagtatgagaaattttgggaaagagtatattagatcatttcaaattcatgaatttctaataatccctgtgtactcagctagtctggtctgatcttggtcttgctgttcaagctacccactgctctgcgaccggccatccattaccaaggctgtctgctaccaccaagcatccaaaggtgaggcaagtgcaaccgtagggcttgcaaggacatatcttactgtcttgtatagttgtaaggtgggcagtatcaatccccttatggctcaagcagtctagaacagccggaagcacaaccctgtcggttgaggatcttgcatctaaatataatcaagtcctacctttacgttcctcgtcccgaggatggacccaataggttgaaactgtattcccaatgcctccttttcccttgtatatgggacagttagaatgttgttttagtgtgagtgcggaaacctgatatcgatgccttgtgaatatgatgaaaaaatgaactaactagacctagatagcattgctgattttgcgtatct

SEQ ID NO: 100355 - DNA, 574 bp, Oryza sativa
ctaaatcctatgcaagacttcaagtaaaaatggccgaaaagcagagtgaaaggctttacacgtgtaaaatttgagagcaattcttggctccttttgagattgcaagaactttgccgtttgttgcacaagcatgacgttatcttggataaatcaaccttttataaaagtactttggttaggagataccaaatgttgtagatggctagcagcaaagggcgatgatcctaatcctctgttgcagcaatatgtaggacatgattaggaaaatgtgactcccattctactgagcaaaagatcattctatccaatttgacaagagtaagagagtccctattatttgaccaagtataatttctaacatgcaaggggatttccttgactacctaaacgtccctatcatggccctgttgagattatcattgttggcaacttttttgacaagttgacaagcacgatcgcagcaccttaagccttgcggtgatcctagagtcgccaaccacctcgatctagcaaagagctaaacctagatgggttttgataacaaaatcggctagcggagccgatttctagataa

SEQ ID NO: 100356 - DNA, 568 bp, Oryza sativa
cacacaaactccaagaaggatatgggagtattataggtattggtatttgtgtattaggggtgacattgtatatattacctcttaatttatgagtgaataacatagataaatctggaggtagcaatcacatctactatagatcgtgtcactgcaatcagctaaaggaacaaagaatgagaacacacggatcatgatttgtcttggccacttgatgtctcgacctacggagtaacatcctcggccttgagctgaccttgtcagtcctcgtcacatggacactaacgagaataaaaagttaatatggttcactaatagaacatagagccatatacaacacttatactaaatgcaatatccataggtggaacaattatcccttacaacttgatatggattagaggtctatgataaccatgtaccaaaatgatgagaaagattgtaaacaattatcatggtgattgttttcacccatcacatatccttcaaaatttgcagcatatgctgctaaatattccaacatccaactatgttggaattgctagttctgggctatgactctgattgctta

SEQ ID NO: 100357 - DNA, 524 bp, Oryza sativa
gaattcctcacaactcacaaatcagtatgggatttcaggtcttttcttctgctcaggaaggcataatggattttagcacacttcgatttatcttataaagtaacttaccatgtgatattcttgtagaaaatcaggttctcttctcaagtaacctgattaattaatttgccttctcgggaacaaaggaatcaactttgattcaacaatggtcccaactttccttttctcttcataaaaccccaacacaacccatattctctaacctctttcctagtacaagactaggagcttcatttattatatatacaaaatctatctatctatctatcttctattatatactaaaagtctattaaacttcttacaaacgctcctacaccgccacgaagcattctacaaacgctcctaagccgccatgtggcgctctaataatttatagaaaaatctgtaaaaaagaaaaacatctaaccatcagttttcacttaaaaaggtggacccaataatattaaccattagatcaaaac

SEQ ID NO: 100358 - DNA, 661 bp, Oryza sativa
attcctgcagcccagatctattatatgttttccctgtacatatgtaaatttggagtcttagttgtaccaagtgctctctctacttgttaatttgtatctaagtatgtgataaattgcatcattgagactttcccttacatatataaatttggaatcttggttgtactaaggccctgtttgtttcagcttaagattattgtaatctagattattaaatcggatcactctaagctggattataatacgctgatatagaataaggccctgtttgtttcagtttatgattattataatctagattattaaaccagattgctataagctggattataataagctgatataaaataagctgtgagttgttgtttgtctggattattggaggcatggattattgggtttgaaaggctaaagtctataatgccctcagctatctgttcggttgatggcataggtgggtaatttttctcaagtatgtagaggtagtgggtctttagccactcaataatctgaaaaaagtttctttagagaagcttattagattataataatatggtttatagattataataatctgctataataatctacttgtttgtttcgcttactcctaataagcaagattataataatcctaagctgaatcaaacatggcctaagt

SEQ ID NO: 100359 - DNA, 641 bp, Oryza sativa
attcctgcagccccatctgtttaaattaaggtagaggagagctcagtgatctctatagatgattgacaatttgagtcaatggactgaacatcgagcggatctagtttgaagggaaattttcaatgaatccaacattccttggatattaatttcctggatgtttgcgacattggagccttccatggcaatgtaaatagctacatatccttctcctaagtacattaagaaaaatgactccccaaatactaaaattctattatatatatatatttaaataatactatattccatattgttctatcaacagttgtcgaataactatatgaagtagaatattttcacctagcatacccaagcatttctagatcaattgatggtctataggtacacgacgtcagtctgctggcactcttttttctttacgccatagccaacgcgaagacgtggcatgtacctctagcctcccacgttggacgcgaggtcaaaaagcgcgcgaacctcctacatacgccacgccccctgtgcgaggcgccgatctaaggctagggttcgagccgtggctcacgttgtgcagcttgaggcctctcggttgtgcagcttttcattgaacaggacacacctgtgggtattgtcttcattgg

SEQ ID NO: 100360 - DNA, 672 bp, Oryza sativa
cagcccaacatggtttgtaaaaaccacatcctagcgcataaacaggtgaggtttttacattcaaatttaaattccattaattgacacaaaaatagttcagctgcttccagtattttcagttagaaatatttccacccaaatagcatgagttgtcccaaataccaccgatatatgaaaaatacctggtaattgataacaaatagcatgagttgtccactcttagggaagtactggaagctgaatgtaagaatcttacaagtcagttgaatctagattcagatctgggataatttggatggtcagtcttgagcaattttatggttgttgaggaggtaccaaatttatgatagaaatagtcgtacctcatagtattttctcaaggactttaaaattcctcagcagtcttagctatgattttcctactgatggggcccttactctaaaccgtgtactttgttcacatataattcgctgtcatggaaacttaactagccctgacagccaaaaatcgtcaggaaaatgcataatcacgtaaggaaaatacatcctgacgtggcactgtcagaaaaattccatcagaactgacctatcggctggagcggagctagaacgaaatggagagaagtgacacttgcttaacttactctactttatatcgagtttaagctgata

SEQ ID NO: 100361 - DNA, 1067 bp, Oryza sativa
attatttagaccgtcctatttgacccagatgatattcaaatccaagtttagggaccggggtgacccaactcaacaaatgggaggacctaacgagtgatctgtaagtttaggaaccgggatgacatagtcgaacaagtttgaggacatgaacggtcgatttgtgagtttagggactgggatgatacaacggtacaagtttagggaccagtgatgacacaacggtacaagtttagcagaatggtggtgttgcgcatgcctgatctcactgctgtgctgtgcttaagcaaagcggaagtctatatattggaccttttttcaattaactatatactcccttcaattttattttaattgacattttagacaataatacggtctacaaaatatatctttgaccttatttctctattataataaataaatgtatgtttacttttattacaatactttgaaagataattctatatatcttgttctagtttctttaaactaaatatttttaaagctattagtggttaaagttataaaagtttgaacttaaccttgtttaaaatgttaaataatatgaaacaggagggaagtataagacattgggacagtagtatatcccgtccctgaaacgtaagacattgggacagtagtatatccagtccctgaaacgtagggcatatgcccaataccctattggcaccagtggcggtagtggtggtgtcgccaggaagaagagagccggcaggagaggtggcaccgcgctagggaaaggaagaagaagatgacgaggggaggggacgggtgggtgtttatatatatttatgatttttaggggtatactgtcagacttatatgtgaaaaaaaaacctaatgatttaaatgcaaaatgcaactgactgatatggctgaaatgcaaaaagaaaatacaggtgtggctcgtactgtgtaaagggtgtcacaagtatgatttcatcatacttggcatctcctttttctcgtagatatatcttccattggctatatgccctgagaattgctcaaacgtcgtgtgaaacatgtgtattgtggaggctatt

SEQ ID NO: 100362 - DNA, 615 bp, Oryza sativa
ctaacgagaataaaaagttaatatggttcactaatagaacatagagccatatacaacacttatactaaatgcaatatccataggtggaacaattatcccttacaacttgatatggattagaggtctatgataaccatgtaccaaaatgatgaaaaagattgtaaacaattatcatggtgattgttttcacccatcacatatccttcaaaatttgcagcatatgctgctaaatattccaacatccaactatgttggaattgctagttctgggctatgactctgattgcttatctgtccatacccctttggggcatattgtgattgtgtagattacgtgttatagacaactttgtgtagttgtctaaagaatatgttggttggcaaatcttggttggttggcaaatcttgttcgtttggcgactccgatttttggtaatgccatttatctaagctaagtgtgtaaagactagaaaatctgtcaaaaggttgattttcctttgttagctcacatcctaccaatgaaagcaacacatttaatgcataaacaaagaaaatgtaggatacatttcttcccttccccaaccttaacaaataaagggtgggcaaggctagtag

SEQ ID NO: 100363 - DNA, 536 bp, Oryza sativa
  unsure (1)..(536): unsure at all n locations
ctccaacctcaagctagttggctccattgcttatcttgtgttgatttgagattcactttgagtcttgctttctcacttcttcctctccaccgatctataagcttggatttcatgtgtttgtgagagtggttgatttgagtttattttagtgcttggtgttgacttcgtgaagatcttttgagcactcaattcatctccaagaaatctttgttgcatttgttactcttggtagttgaggacacctagacgactaggagtcaacctcgagacaccaatttgtttgtggtgtgccgagggagtttgtgaaggtacgatctcacctccgaatgggaagagatacctttagtggaaggaggagtacatttgtgcaacctcacaaggatagggttggaaaagccccggctcattatgagctcctcaacggagagtagaatcccctcaagtatttgaacttcgggagcatatcgtcttacaacaaggggatcctctagagtcgnctcggggcgggttttntgcgttagtttggnnnaaaagtt

SEQ ID NO: 100364 - DNA, 750 bp, Oryza sativa
  unsure (1)..(750): unsure at all n locations
accaaaccaagcctaggctaataagccaaaagaatcgcgctgctttttttatctaaaaaaattagttaagattgtatgcgccaaatttaacctcgtccaaatggaataagatcaagtgtaggttctttacaagagcangtttatgtcattgtgcagatcaaaggtctacacaggtagtcaattcatttagtcttcatcgttgaacaatcaagtatgacagaagcttcactcattaatattttgttccgccagagcacaagtcattacgatcctcaagcattgtgctggtaggcaaaacatgtagactacagcatttttcgtctccaactttaaggaccggccttgtattttactctttctaaattattagtcaatacttgcaagatggatatattgttgctcatttgcctggatgttgctcatttgccttgatctagttttttttatctgattgtttatctatttatctagacatttaactcagataatattatcatcacttgtgatatgtctccctagaacccgtattgctgaaagtgaacagtaaatctaaaaaaataggtccttgagaaggtacatatttttttatagtaaaattttgttacctcgagttacctagtactaacttgtagataataagttttacactagaaaatgtgatacctcctactaccttgtgaaggatgataaattatcattcttatgataatgggtaccgagctcgatantcagtnaatcaaanncacatcg

SEQ ID NO: 100365 - DNA, 814 bp, Oryza sativa
cgtgcggctattagaaacccctcatgatttggacgaaccaagaagtctcaggatgttatttgtaaatatggtaaccttctgtttatatatatttaatatagcgcagtaggagcctctcctgctgtttcccgtcaaaaaaaagtctcaggatgttctcttcgtacccaatgcagcagaggcgaagccaggggatctggaggaacccaggcctccccaggccaataacaaccctaccccacccccaccccctcttctctttttcacataataatcatctttttatcacctagtggccatgttcagctgctggttcgcggctgtggcgcagccggcaccaacagtgccgcacgcacgcggcgcagttgccgtagcaggcttgctaaacaggcccagaatgtcaagtgtaaaatttgatatggctatggtatactgttcaaccatgaactaaaccttccatgctgtaatgtacctctacataatttctaaatgagtaaaatacacggccaatccttaaagttggagcgaggctgccctcaaagtcatcaatgttaataactcaaaaattgagaggtgatctttccaagggacccctaagacgccaaaggcaataccgatcagacttccagattcccttggagatcgagcggaggacaccttttgattaggagcgactcaccatcttcttttccaccgtaacacccaaagttctgtgtggcttttaaggggaacaaacggaagcattatagcgcttaccctaaccacatgtacccaccactatttgtgggaggctatgattggcttccaccataccaat

SEQ ID NO: 100366 - DNA, 676 bp, Oryza sativa
tctctttccaatcccaagaggttattgggtccctcaatcaggtgcggttgccttaatccaccaggtctagtgatcaatccatcatgggcacttcgatctaggagctgatatcgtccctctatctaaggcatgcgtccttcttcatctatgtcaccagccacctctctcccctctcatcctagtccttttggggccagggccttgtgtcttctgtaaggcacattaaggtgggtaagaccacttttgccactaagatgatcgctcggctctgacgaggatacttaaggccacatgcaagagtggagcgttgtaaatgctcttggcttacgcttagttcgaaactgagttagggagcttattagctgcatgccaaatgagacgcattgctaactaagtattattttctccgcttcatattataagacattttgatgtcttcatctcttgtgtagatttactaacatccatatacatttagacacatatgtgaagcatatacatggatctatgaaagaatctattcaaaacccaaaacatcttataatgtgaaatggaggatgaagatattttgtgaatgctatatatcccactctattagctgtactgaacacaccacaaatgtttaattgtaagagacaggattccgtattatactctgagggggcagatttgttga

SEQ ID NO: 100367 - DNA, 650 bp, Oryza sativa
  unsure (1)..(650): unsure at all n locations
caatccctacgatcccttgttatcctcttcttgttttactctttgttcgtcttagttgtgaaattgagtgaagaattgctgatttagtgtttgaaaatcttttgggttttaatttgcatgatgtaaatccttcttcttagaatggtcatcttgttctctagtctccaccatggtcaccattactttctagccttcatttgctctacgactatctcttgtacgcctttgttgtttgagatacattttgaatttgaggggaatgggagcacattatggtgaagttgaggtttgggaggaaagcggatggcatgagggggaggatggaggagatgaggttggggtcgaatgcacgctgctcactgagaatagcgggcgacgacatatcgggactatgcnnnnnnnnnnnnnnnnnnnnnnnnnagcgcgagacaatggctcagaaacacgtagcactgaagattttcgaggcacttctgaagaggtgtatattatggggttttaatactaactctatttaacaaaatattgtagacatccttttctcacttgtgctattcaggtacactctataacatccactggacaatcagtcgacatcactttacaagaaaggttacaagaaagcatcccaactttacaagatgatttcg

SEQ ID NO: 100368 - DNA, 567 bp, Oryza sativa
agaacaaaatttagggtctgttaggcacagcaccagctctagctccacctctcctggagctggagctcagccaaacagtttcagctccaccaaaaataggagcgaagctgggtggagctctctcacaaaatgaactagagaagtggggctgggtttaggcagcttcacaagtgcactccagacccaactcctggagctaaatttaggagttagagctttaccaaacaggcccttaatacctagctgtggtttcaaagggcacaatggtcacttcctttggctttcctttttgatgttgcaatatagagaaaactaacatttatacactaacaagattaaggtgtaaaagtgaaggtagcctagtcagtgatcaagacccctttgctccacatgcttggatttttttaacgttaagtttggatgttgacgagattgattttgcataaacttgggctaatatgtatatgcataatccctcatatggttaggatattcaaacacttacaatatgcaaaagctttgctgcacagattgataatcaatctcatttagagaaaatatcttttg

SEQ ID NO: 100369 - DNA, 1159 bp, Oryza sativa
ggatgaaatgcaggaagtatacagatcaaagattagctgcctagagtgcagatcagcagaagtttattgaggctcttctgagcacaatttgatttgccactcatggtttgatgaattccttcaaggcactaaaaactaactatatatgcttggtgacacgtaaggagttgcccctgttttagttgcataatggctagtactatatggcaattatcaacgcaattgtaggagtagaatatattagataaacatattttactgaagaagaggttgatgacttacgcattgtttagcctacctaatgaccaaactcaaaactatatctcaagtcatatcaggtaaaatgtagtgatcacaaaattatacaaaaaaacattatggcgcctaattaactatcttgataacataattacctgaataaaagatttacctgtaattagggcaatgcatgcatcagtacctcagagctaaaataaatcacaaagtcacaatcatgttgttagccgtccaataatcgtgctcaatcaagaacataaacttgcaatgatttgaaaacttatcttatttggttggtgaaaagtttccaagaatatatataatcagctagagccattactttttatttctccatacttatataattcacctactatgcatcctatcaaccaaattgcatgcctataattcttctactagtaactctatttgtgaaaagaacaagagaattaggtaatctggaaaccactacaagactaaactacccaaaagattgttattttgattgtgtgcatcccatgtgcactaagaaagtatgtggtaattgtgttttcttggaccattctttcatgatgcttcattgggttccatttgcttcgagttaaagcaaaactggtcctgagattacctcaaagtacctactaattatattgtaggcaccactgattggattaatgaggtgtgttgcaggccacagttcactaattatgagctcaaattaagggacattattgctggtgaacagtgagtgccgtgtgtgttttctgcattcctctaaattgacacaaatcttaattcatttgcagcttttaaatgatcgataattggttggtcgcatgcttttaatcacaaaaaaacaaatgcacagtttttgtttgttgaa

SEQ ID NO: 100370 - DNA, 644 bp, Oryza sativa
atggtggtttatgagacctctacaaagtacaaaaatgaaacccagctcacattacttattggtgaatgaacaatccaacactttggcgatttttgcacgagggataggttacagcccacctgcaacctattggggccttgtccgcaaaaatcgattatgtactattccctccattccataatataagacacaaccataatataagacataatataaaactctacaccatcaagaacttagtactagacactactctttcaatacaaacaccacttttccatacttaaatttaatgctacttatctcacacgatatcttgaatgttgtgtagaaagcatgtctcatgtaagacctagtttccttctctttcctcatttatttacttgttacatcaattttcatcgtttttatttaatgctatggacaccatccccgttattgggttgggaatggccagtcgaattgcgatggagtgcgccctcagttggatataaaaatgaattagtggccgagatcagtaacagctattaatggtagttgccaataatggaggtttaatttggaaacaaaggaaagaacggccattcgctcacctctcgatcgatcgacctgccaacatcaacatgcaatcggcctcctgtcct

SEQ ID NO: 100371 - DNA, 531 bp, Oryza sativa
tgcgccgcaaagttcgaagcgaatcatttgtcctgattcattggaagggtatgcaaaaaatgaattcatctgaaaaagattatgaaacagtaatgataataactaagttaataataaagtgttgacaaatagtagggataaaacataaatgtctcaaattttaatacaaatagataagtcaagggcgatcaattcccttcgcacgcttgctaggtcccccttcttcctacgtctaatctgctcagtgggatatgtcaaaatatcggggggtgcctctctcttgctgtctgctgtggtgtcacctcgggtgcctgaacggcctttgtctcctgtgtcggctgtgtgacctgaggtgctgcgtgccaataatccatccctgcttccccttgaggaggctcagtggaaaagaagtcctcaatgaatgctgtgcgaggggagtactcatcatctgtttgcataagagggagaaaccaaaaatggcatacttagtaatgatacatataattagaaactaaagcgtgttattgttta

SEQ ID NO: 100372 - DNA, 563 bp, Oryza sativa
cccacgagactctgcagcttactacagctgcgatgatcactttgttgtggtagacaaaactgttgactatggtagaggaggagcgatgcctgataaaactagtgccccagaagtaagagctcaagctcggccttttggaggtagcacaacatcatatgcaacgggtatgtttatttatagtcttcatatgtcattttatgtaattcagcaaatctgttttttttttattctccccttacaagattctattcacctttgtaattcttatggataagctttcccttgtgaatattatgtctgtgttaagcaaggacagcattatacttatccctatgcattaatgtttcttgaaacatccctatgcattaatgaaagaacaagctattgaacttactattcttagaccttagttcttccttagaaccattcttaactatttgcttcgagtagtctgttcagtgttttttgtttgtataggttcctcaagcaacagaaggcggtatttcctcgagcaacagaagccgaacagtcgtacctaaagagaacacggatgaaggattttt

SEQ ID NO: 100373 - DNA, 538 bp, Oryza sativa
ttcatttgcagcttttaaatgatcgataattggttggtcgcatgcttttaatcacaaaaaaacaaatgcacagtttttgtttgttgaagactacagtatcaggtcctgtttggatcaccctgtcacatcggatgtttgacactaattagaaatattaaacgtagactaatgacaaaatccgttctataaccctggactaattcataatatgaatctattgaacctatttaatccatgattagcctatgtgatgctatagtaaacatgtgccaattatggattaattaggcttaaaaaatttgtttcgcgaattaactatcatttatgcaattagttttattattagtctccgtttaatacttctatttagtgtccaaacatacgatgtgatacggactaaaatttagtctctggatccaaacaccacctcagttctcaataagtacaattttcatttgaaactctccttctgatggcagatgtgaattgaagtccgttgtatagaaaatggctaacatttcgaaatgatttcatcaaa

SEQ ID NO: 100374 - DNA, 708 bp, Oryza sativa
gtttttaaggagtgtgattcgataatagttaaggatacaaaggaggaatttgaactggaaaaatctttcaaggtatggtttgttctattattccattatatttagaagaaatgtgctgtctgaccatttgtcagccaataacttattccttttcttttgggttactcaaacaaactatggggcaattgcaaattttaccactgttttgaattgttattgcaaaactgccaccagaactgtcattccaatggcattcttgcaaaatataaaaaaccagtggcaaatttgcaaatgccccgtttgcaagaaatatttgaaatttgttgtttgttctgattaaacttttacctcattttcctttcatatgtaataacgccatttgtatatgatatgggctgtagatattacctatattatttcaactggtgttgatgccagtaacagatcaataatgtgtgaaccgtcaagccagcatgaaggtgcaggacttttctcatgatgcagtgtactttctttataatttatctaatcattagttggtggatactattcacagatttttttttactggatgcaaccattgtttcttattggcattttcacagcatgtaggtgtcttatttttgtcatcctaattatattgccagtagtacttataaggctgtgttcggattccctggatgggaactaatcctcccacacggaaaa

SEQ ID NO: 100375 - DNA, 643 bp, Oryza sativa
gacaaaagcttaactgtatttgttacaagagagagacatatggccactacttgtcagcactaatgttacaccttcaggagaaaggtacagaagctatcttggcattgttatcagtcgtcatcgtcgtcgtcatcgaactcgtcctcctcttcctcgctcagctcttccataggctcatcctcttcgttaactataaaaccactgagtgtttcatcttcctcatcatcttcgtccccctcatctttttcatccccactattcttatttttatctttagtctcagttttttccttgcgaggtttctttggttcttttgatcttgtaacatactttgatctcttcacactagaacctttccttttgggaattaaaattgaaaatttccttttttttaaatttttcccgggggttttcccccccctactctacctatcaatcttcgtcttcacgctgcccctcattcttcttgttagcgcctttaccctttaatttgccttcctcatcatcttcatcatcggagcccttccttacttcctccagaaaccaattccaatcctttgggggacgaattcttcctttaggatagttgtcaaattcgtggcccattgataagaacccgaattctgcagccaaacaattactg

SEQ ID NO: 100376 - DNA, 2318 bp, Oryza sativa
ttcagaaatcgatcccgtagattatgaaattggaagctcaagagtgctaatgcatccaggatcttgatgttgggcgagaacatcattcctgtgattttgggcaccgaatagtacaagaaagccatagtgtcttttggagatccaatactcctgcagtattgctgggctgggcaaagctttacaattctaagcttgatgcattgttgttttagttatctctgaattattggtatgttgccagtcggcatgttcattattttgggcttcaatcacttttgcaattttcttgataagagttaattgactttttcattatttattatagagtatatatatagacgtatatctgtatccatatattttgaaaaatgctgtatcccggtatcttcgtatccagtaacgtaacacgccagtactttcacacacataccatactcatacgtacccacgcctacatggaagtatccctatcacacatataaagagaataaaggcctgtagtttgtacatgcactttctcacagtctcaaaacaaattaaattacatgctgctactaaaaatcatttttagaaaggaagtcgctggtatcaatcatcatatgaagatgttattggaacaagtctagcaacgtttcttgtaaccgaaaagtcattagctcctcccagagtctcagtctacacagcaatttgcagatgcatttaatttgcatgtccatgtgcattgacatactatatcggttaggtaattgtattactgtagcgtgcaagtcaggacaatattcttccttcctcctttattttctttcttttgaaacgaagcatgagttagcgattatactgacagattacttatacacacgaaattgcaagttaggatgtattttaacacttgccctatacctatcaaagttgaagattattactctctccgtttcaaaatgtttgacaccattgactttttagcacatgtttgaccgttcgtcttattaaaaaaaattgtgaaatatgtaaaactatatgtgtgcatgaaagtatatttaataatgaatcaaatgatataaaatgaataaataattatctaaattttttgaataagacaaatggttaaatatgggctaaaaagtcaacggtgttcaaacattttgaaacggagggagtactaaatacagcagatgacatgtgaatgattgcataattgagcaccagcaaatgttgattttgcatctgttaagtaatcagatggattcatcagctaagaaaaagtaattacatggacaattaattcatacttgtcacttgcgcatataattacgccgtatatatcctaaaactttggtgcatgaattttgatggagcaaagctctgaccagaggatcgatccaattggtgctaatctaaacatgacacaccgacagtaaacacaccatttgcctaaaagtagtgcaatacgtacctcaagagattggaccatgcttatcaagttgaataaataaataaataacctgcattatttcctgttatcatttcttttttcttaggacactccaaatctttgttctagcaacaggaggcaccgaaattaattgtgattacctaatagaagcactagtgatatactggttgagtcgtaggtgtaatattgttctaccctcggatacaaaatctgccacggggtaggggaatttgagtccctccagaacccacgctacatccacctatgtttatctgtgtcttatgtataatcagggaaaaaattgagtcttatgtcccaaactaccttttttagcaattgacctacgggagtggtttaggtccactaaaaagatgattttgtttaggagcaatgcactatattagtctcaatttgagacattgccaaaacgatgaaattctttaaagatctctatgtccttagaatataacaacttttagagttaatttttttttcaactatagcaacatataatacttgtaaaagatgacctttatcatttaaactatccagttgttcttttataagaactagcactcctactctcgcgacgccctccccatgggcggcttgggaggcgatgacctagccgccccctctccccctccttcctcttccgcctcgctgtcgcccgagcggttaccggcaaagccgtgcggccgcaaggacgatgatggcggggcctctcaccgaccttgcgttcgggcggccaggggagccgcccatggcggcggcggcccgcgctgcttcggccggatctggcggggtggcggctggcgctggcggcggggacggcaatggcaatggccacggggatggtgacaac

SEQ ID NO: 100377 - DNA, 528 bp, Oryza sativa
aaacatgcctgcacgaatgcgcaggctactttcttgattataatggggaaacatgttaactgattcaacccaccgactaggatccaccaagcactacagacaacttacgttaagtatggattgatgatttggcatggcccctttttttttttgctctggatcataaaagctgagagtttgaatttgaaccttagaaaattgtgacttagcaaatttatctttctgtcattggctccctacttaatcatctctcagttttgacttaaaattactgttgctgtagcaatttgtattcagtatgacgtaaatattatgattcattttgaaaatgatgagaatagcatgagtttgtttgtgctagaaaacttttcgggtatatcaaatatctcttggagctcatgccttatactacgtatgccctggcaatctggtatcatgcattgatctaccaagccaacagcctgccagtgccccgttcgtatgaggaccctaattaaagccctatgtcccaatgggtgtgttgaaaaa

SEQ ID NO: 100378 - DNA, 578 bp, Oryza sativa
tagataaatgaacttacgtcaaaaccttcttaaaagctaactaaactaataaattatatatagaagttttttcgtgggatcaaaagtcgagcaaagtgtgactatgtgactagttttaattattataggcaaaaactagtagcatactaaacatttattgatataaaaattagcttcaatccaaacaagctcgtatatagtttcttttttcttttacatgaaaagacatcatcatcaatacaatagtaagctagaccagtacagattaaataggtggaagcagaaagtgctcgaggacagttcgcgttcgcaccatgagcatcttggccctccgtcgacggcgctcataagccacggttactataggagtgatcactacgcagggccggccccaaccacggcgaacggtccactcatgtagtcgttttcgaggaagaaaaggccagccacgcataagaccagcacgccgacgacgaaccagaacgccacacaagcgacggacagctgggtcgacccgtcgagctgcaggttccaatggatctcggcgatggacgccgcgatcctgtcgacgtcgcgct

SEQ ID NO: 100379 - DNA, 515 bp, Oryza sativa
acaaggagacaatgcaacagcaagcgcaggaccctagctacacaggttcaataaaaagcaacttcattgattccttttaacggactcctaaccacttgcgtgcttttgaattcatgaattcggttcaaagtggataagtcatcatagacctcaagagaaccttaagcaacatatctcctaaaactcaaaacacaagaatccgcaagctccccatcatcttagcaccttagtgcactccataaaatacaagatcaaacactacgcatggttcatattcctcagacctcaatgaaagacttgcatgactatagccttaaatccgaaaagttaaacaaaagcactacacgaccaactcaaacaatttcctagcaaatagatgatcaacaaatcacgaacaacgcccgttccagctcaaaacaggagctgctagtagagcagcaccgtcttcaaccatccagattgataactcgaacacactctcgatccgaaactatcccttttggcaaacatcacac

SEQ ID NO: 100380 - DNA, 1006 bp, Oryza sativa
  unsure (1)..(1006): unsure at all n locations
ttaagtatacaaacacacatttaaagtattaaacgtagactattcagcatgtaaactgcgagacgaatttattaaacctaattaattcgtcattagcaaatgtttactatagcattacattatcaaatcatggcgtaattaggctcaaaagattcgtctcgcaatttacatgcaaactgtgcaattggttttttttccgttcacatttaatgctctatgtatgtgtccaaatatttgatctgataaaatttttgaaagtttgaagggaactaaacactgccggagaataagcccagcagcaattactgactgactgacagatgccttccgttttttcagaggataagaatcananaaatttttcagcgtaaagcccacttcttcagaatatttttttctccttgttcatgttcttctcgtggtactcaactggggctatttcagcaccagccaaagcaagattatggacaccatgatgggagccaacaagagaggagaaagggaggagatgccttcctacttgtcattatgacagtattattaagcttcaaatcttaacgctaacaaatattacacacaaataagtgatcttttaataaaaaaaataagactagtaatgtgtgtgtaatatttgttggtggtggatggtgaggtggtaggagcggcgacgaagccatagagattgatgctggtgggagcgagggaagcgtgggttaggcgggatgggagaactgcgtcgtggctgggttagagaagaaaagagagggggaggcggccagttagatgggcctcgtcgatgcagttgacggctttctactagccagccagcatgtcacggttgggcgggggagggtggcgccggagagcttgagctcccgtgcgggcgcgagcgggaggagaacaaataggagatgatattgtttactctctccgtccttaaaaaaagacaaaccctggtttccgtgtccaacgtttgaccgtccgtcttatttgaaaaaattatgaa

SEQ ID NO: 100381 - DNA, 2393 bp, Oryza sativa
ttgatggcgcaatgcggcatgtcaccatctttcttttgaacgggtacgtgattgatatatgggtgtcgctatcgagcatgcagactcccttttgtcattttccatttgtgcttgcatcctttggttttgggcttttggccgtggatttcgtgaaaaaacaggatataagattatcctgttgattagttaggcctttaatttgaggcagatgatcccaatgctggcgatcagggaattggagtctgatgatggaatcaaccctgtatatcatttgtttttccttttgagatagagtaattctgaatcgtttcttctttgttgccatgaactttatcttgtgtctagttgaaacgagttaattatgggtgtttttaataatcacgcaatctagtccctttttgaaaagaaagaaaatatgtgtatttggttcctttaagataaggataatgcatgtaatacacgttgccttgacatttacttctggcattgagatttgtaaaacgtactacaccatattacaaactatttacatggttgatctcttcacacaatcacaaaggaagtctcaaccttgacaataaccgtgtatattgataaatatttttttttggcaagtcccctcttttgtcaatcagtttataaagtgttgccgaaatttaaaatttaaaatttaattttggatatttttcatcttagtttattttataatattggcttttaaattgttgaagatatagatataaaagttttaaatattttttcattgctaacaagtcgtttcacggcttattagctctaggccaaacaatgcacctgttgataaagcaagcttgaccatgatcatttggctgtagcttctaatgaagcagagattttttttccccttatcgtaaatgaaatgtgcattttggcatattaatttctgctgatcagaataagcattacatatgctgaacatggtaatcccacagcaatcaatgaagtgatcaacaagcatcatgcatggctttagttttgcagtcaacatccttagtggttaagatataattagaaattaattaaaagcacgcagtaagtgaggttccttttgttataaagaagaaaaggtagtacgtagtggctaaggttccatccacattgatgattacgagtatttgctactactagtatatcttggtctctatctgatgtgatatgtaacattatatatactcctaattaatcgtgggaataaaactttgggcaaacaaaattgtactaatggcttagcaacctactcctctcgttaattaattaagtcgctatcgcctttcctttgagaggtgttagggtccatcaagttgcatgtatttgttttaaaaagtactacctccgtcccaaaataattttaattctagattgtttagcatatattaaggtttaaatagaaagactgtggtgccccctccctaaatggtgtgcatgtcagagtggaaagatggttgagggtaaattagagagaaatttgaataagagatgattgatggggaaattagactctagagtaacaattattttgggacaaattttgaattctagaaatacaaattttgggactgaggtagtacatatcatttgtttattttttttaccgagtttcataattcaggccctcagcgattgctcatattccctaattataagccaaagcagattattagagaataaaaaataatttatagataaaccttatatatatattcttcacgatttagaagctaatgctaaaaaaaccacattaaaatattttaaaaataatttcgaaattaagttaaaaaattgaattgttagcttttgctttatcttgttagggcaactaatgggactctcaaatctcaacatctcaattagtcatgtttctctagaagccaaacccgtctaacactacaattcaaaagttggtgatgggctgcttttggattacggtgactatacaaggttcagacaaaaagggttgacatgaagacaaaatgtcataaattatattgtctggttcaaaaatgaaaaaacaaacaaagaaagactagctatattgtgtccaacctttcttgaaaaacgaaagatattatcgtaatatatcccttacatttaaggacttattgttgactaatctatagcatatatttcacctctcattgagaaaggatacctcttggacaagtaaagcatattaagtccgtaagtaaacactttggctacgatgatacatcatatatattaaggccctgattcagatttctgatgatgagtggattattgcctcaaactatctacttgattatatagattaaatattgtattaaataaatttaataaatagattaaaataaacgatctaggcaatataatagata

SEQ ID NO: 100382 - DNA, 551 bp, Oryza sativa
cacaatgtcacccctacttccccccaccaaacgtccccaccccttcccattgccatcgagactcgagagaggagatcgtggcggtacacctactcgacaacgaccactaccacccgcttcccttctcggctttggccaccatcttcaatcccttccattccatggctctggctaccactacccctttctcggcatcaccaagatctggcagcgtgagctcaatggtggctcggaattggcatcctcgaacgacaaggcggtttgaagtagagctgcagcggtgaggcagcctgaggcgaatctagctgcggcaacaacagtggctagaggatggatgtgacatcccgacccagggcttaataggattaatagaatactcatatcaacaagttgcaacttcttttccggaaagcgatctccaaagaactctgagcttaagcgtgcttggcccagaacaatatgggatgagtgaagtgtgtagaaaaaacttgtgttgctctgtgagggcagcctgtgacctattaaagctgccagatgtaaatatccctggc

SEQ ID NO: 100383 - DNA, 597 bp, Oryza sativa
cccccaaatctgcaaactgtgtagtatgattttccacgattttatttctgttgatccacaaacaaagaaattgccattctttgcggttagtatttttaactactgttatcatttctactgcttgcttccaagttggatgtttggctctccttgagaaccttttgcattggatgcgtcccagctgcaagtagtccctcttaacttatttcttttgaagaaagacctctttaacttatttctctttgaacttagtcttttacccagcgggctcacatattagtgactcaaagttagaaataaataagttagaggaccctctcttccttgtagcagaggtttgttgcagacgaggttgaatggaacaggagaacaacggagacgaagagatgcaacgcacgcaccagctactagactcgcttccggtgctttactagacttgcttgtagcattgtacattttgtgtgtgttatttttatctaaaaaaaaatctcacttatatatacaagtttaagtaccattttgaacatgggaatctgaaactgtttggaatgaaggaattttcaagaaatttacctgcagaatttatatcatttgtca

SEQ ID NO: 100384 - DNA, 509 bp, Oryza sativa
attcgagctcggtacccgttcaggaaagaacttcttctacatatgtgtagaatgaaggagcctctcaagcaattagtttttgattggttacaaactatgtaattattttgtgggttcctgcttctccttgtaagatgtaaatattttccaatttttataaaagctatattgttgggctaatacctggcagtaatttatgtcaagaaaaaaatgaatgattttacaaagtttagggggttagatatatccggttttaaagtttagggtgctagacggacttccatccaaagtttaagggagtatttggattttttcctagaaagaaagtatttttttctcatcaattatggatattagtcattggccacatggttggttagacagatggactctcatagtatttggtgatagcatatcctcaaagccacttatatgctagtgagaaacttaggtgaacataatataaggcatcaaatttctaaggcatatggcatccttcaataccttca

SEQ ID NO: 100385 - DNA, 522 bp, Oryza sativa
tcatcatccttcctccctttgccatagccactcttgcaaagaaagtgcttgaatctcatgacaataaaagccatctctttatcttcactttcttcacaacttgactcttcttcttgttttgccttcaaagcaacttcttgatttttgatcatggcggcattcttcactatttgcctcatttcacgagcttcctcttcttgcatctcatgagacacaattcttccaagaatgtcacttggggtgagtctcttgaagtctttcctttcccgtatcattgatacaagagtaggatttcttggaccaaatgcacggagaagtctcttgaccacaaagtgatttgtcatgtcctcactcccaagtcctttaatcttgttgacaaggatcatcatcctatcatatatctcttgtggtgtctccttgtcatccatcacaaatcttccaagccttccttccaataattcaatcttggcctcacgaacggtgggtgatccctcatgagccaattgcaaagcatcccatatc

SEQ ID NO: 100386 - DNA, 1051 bp, Oryza sativa
ataataatcagtatccaaatgtgttctatgagcaacgtaagaacagctagagagtggccaagtaaaattactacattgaatattataagcaactgcacctaatagaagtgtaatatagctaaaccagaacaaaaaggaatctggcaagccaaacttaccttataaccatacttcgggctatcatctgtactagcaagcccttggttgcgcagctgtgctgtagcattggcatccaagacaatggaattttccccagcctgcaaaaagaaatatacattataaaaaggaaaaaaaataggtagcaactaaattatttcttacaaaattaaacagaaccactgttatcgagtcgcccgactagtcatagataaagtcagtcaatctagtcgactagagaaccacgactcaaccaaatagaaagtcgtgcgattagtcatggttagtgataaaatcggtcatagattagtcgtagcaaatcaccaattcaccatgctaattggcttattgtgtatttgtgtttagtactttagttttatttcatcttgacttattttgctgctttgctactccatagtccatagtttatactgtatacattgcttagaacagtagtatatattgcatcccctgtagcatgaccaattcgtggactagttgtggacaagtcgtcgactagtcgtggactagtcgaccaagtcgacgagtcggtccaggggtaccttgactcgactttacaacttgacaaccatgagcagaacgctggcccaatataatgaaataccagcagcatatcacactatcagagatatcaaacggagaaaacgattcaggattaacttctacacttagtaagaataaaagacaaccttgaagcgtgcattcctagccttctgcctcgcttcttccattgcagcatcaaaaccctcccgatccacactcaagccatagtcaactcccatgacctatggaatatgaaataataagaaacagcataaatagaacattgaagctttatagatctttcaggtcagaaaaaggacagctaacctca

SEQ ID NO: 100387 - DNA, 656 bp, Oryza sativa
ctaaataatattataccatgggtaaaaaatttactactctctctgtcctaaatatagggattttggttgaaagtgacgtattctactactataaatctgaacagtgcacatgtcaagattcatagtactaggatacgtcccatccgtccaaaaatcatttatattttggaccgaagggagtagcgttctaagctggtagtaattttttacgaccatctaggaatggtgccgtatgatgtgggagtattcatgcaagtaaatttgttacttttgaatgagtagatgatggaggctgggagtaatggaaaactccacagagtaaattcgttacttttttgaaacgtgggagacactagaaaaatagaaaacttggaaagaaaaactagacggtaaatattttactaaaatgcgaaaacagaaaaattggagagaagaaaccgaaaaggaaaaggtggggtggtaaaaaagaggaaaaccggaaggagggagcgttgtgtggcgctcgaactaatatactgtgcgcagcacgtggatgagcgctaccgtcattttactccttaataacaattctctctttttgttactctttgtataagttttattttaagctgaaatttattagaccatggatggcacaattaccaaagttcaaaaat

SEQ ID NO: 100388 - DNA, 590 bp, Oryza sativa
atcatgttgctgtcggatctgtttgtgtgttcatgtcccgacgatgtcacattatacggatatcttcaccaagggtttgtctagtaccatcttcttagagttccgttccagtctcaatgttcggacacccgccgggccttctatccggtgcagtcccaccgagccaagggtcttacaacaatcgcaccgaactaccatctctaatccaccactggaacttctctttaatagaatgactggggtgagagggttagtatcttttgtattttggcatgcttcatctcttgctatctagccaatatctctcccgattctgtttctacataaataagttggttgagtggttaggaaaggacgtgcttatatatgtactctgcacactgagatcaatatattgcattgagtctatcttgctctcaagtctccttttcttccctgcaaaggatcccacagacccctagttctctctcccaccctagccaccaagcacaagctgcattatgggtcaacggcaacatcaagctatttcttgtgtagagaaagccctaggtgaactcctcgtaccacaagtttcaagcattcaattttta

SEQ ID NO: 100389 - DNA, 577 bp, Oryza sativa
tatagggcgaattcgagctcggtaccctcttgcgttttcgtccccgctttcacgcaaaaaatctggattggagttaatagccctcaggcatctccaccttataagctgctgctccttagctattatactcggcgctatagtgttttcaggctgctacaatgtcacgagctgctactactgctgggctgcttgctgctgtgggctggactactagctagctttgctctcttttctttttatctctttcctttttgttttctctttttcccctaattatttgtggggtgttagcccctcacctcattggctaattttttgggtgggagaaaccctttgaaatccaaaaaaaaaacatcaagccacaacccaggacaaacatcaaggctgtggcataggtcgccaccaacctggcccaactagttcatagtatgtctatttcccttatctacccgggttgttgcttgtgcatagaaagaaatacaacattcagacaaaaaagaaagaaaaaaagaaacacctcgctaatatctcctatcactggcatgccacttgctaagttcaccatcaagcttgtggt

SEQ ID NO: 100390 - DNA, 730 bp, Oryza sativa
agataatcctttctaaatgttctataaacttggatattagggagtggtaatttcatcgctcgaatttttctttttattttattaatagtcttagattttgcattttttatgagcctcgttttgagggagattgaaatgcaatatttcaacgttgtgtatctatttaacagaaacttttaactttgtgtaaaactttgtgggaaaataaatcagaatttgtataatcttactaccacagtacgaaatacagaaaaactaagcaatgtaagtaacagcgttaacacaaaaatacctacagaatttcagcaaggttaaattacatgaaaggttcttctaccttgacattggtgaatgatgattgctgtctagttgatcaacccgcaagaggccggcaatggcggcttcagcaccagcctgtagggaagagccggcccaaagtagtacctcctgtgaggcagcctgaacaacaccatggcctgaacgtcgagagcaaacacccattcagagccatagtgtttgagaaagtcgaagccctcgccggcgtccatgatcctcgcgacgtcgtcatcggcgtccacacagagctccatcacaccgtcgacttcatgcctgggccgcgcctctgcgtcttctcgtcgcgctccggcgcgtggaccgtgcacccctactccgacgccggcaccgccatcatgcccatgctcggcgcattcagcgacgacatgcacaccaa

SEQ ID NO: 100391 - DNA, 716 bp, Oryza sativa
ccccctccccctttatgatctcccaaacacgaaaccctaggtaggcgacgagacgagacgacggacggagtggtggtggcgtgaatcgtggggcggtgagggttggaataaaaggacacagcacggcgggggtggggcgccggccgagagagggagggggcgtcacgcgcgtcacacgtgaccggcgaggcatctcgtggggtgtgtgggtgtgaccggatcggagacgtgccgccgttggatgagtttgaccgggtaaccggcgaaagcagcgttggctggcgaggaggaggtttgggataaagacagggcgcggcacggcacggcaacccaacccaccggggtccggagaccggacggggcggaatacggtggcggccgcgcgaaattacgcggctgcccacgctgcgctgcgcgcggtgtgtgtcaggcgggcgtgggattgcgggtgcgctgaggtggtcgccgttggtcggctttgcgttgcgtctcgtactctcgtctcgttcgttcggcttgggcgccgaaagaggaggagagagagagactgagacaccgaggagggagaaggccgcgaagagggggtgggtgggtgaggtggtgtgggccccaccggcgcgctggggaggcgggcaattattgttgtctccatcgagcggtggcgagacctgcccggaaaagtggacggggtgacggacggacggcagcggcgtgca

SEQ ID NO: 100392 - DNA, 2143 bp, Oryza sativa
taagaaagaaatctttatatttgagatggaaaagagttcatatgaatggcccagtgccgcacaagctgtcttagacttttgacagaatagtccttctttaaagcaaattttacaaataaccctaaaaacttatggcatatatggtccttatctcatcaccaggaatccttggcaatgaggttcaagatctcatcttggcgtcaactcatttaccgatctctgccacctacgaacttcctttttagtcctaccactctccaaatcctattgatttgctatcaaattttgcaaaaagggtatattaatgtatcataatttttttatttataaaaaaccttaatgcggtaacaggtcacttcctattttcccatccctaaattctattaatttgctatcgaattttgggggcaaaaaagctacaaatctacttatcaggatacactattcccctaatttgtcaaaagttcaaaaaattgacagcaaatcaactcgacatagggaggggagggagggactcatgttccctcttatactttttataaataaaaatagattagcagaaatgaatatggatacaatttctgaaaatttgacataaaattagtaggatttggaagaagatatgtcataggtagtggatgtccttgccaaaccgactgacgctgagggttactccctccgtccaaaaaaaacccaatcttgggtttgaatctggacatactatgtcaagatttaaatccaggattgggttttttttgggacggagggagtaggtgttagcgccaacttgtttcgtgcgccaatgaccttgatgccaagatagggggttgtatcttcaataaattttaggttatgtttggtattcatgattggaaactaatcacatgcacgtaaaacagaacggcttatttttatagaattaattaaatatcagctttaaaattttttaaaatagattaatttttctatatagtgtgaacaacaaggaagtaaaagttggtacatgtatatattataactcacccttagtatgactatttcctaaaatgtgtaaaatgtaaaaaattcggacatgttgtctgtgggggtgggggcaagccgcaagagtttgcagtttgtagtaccgaggcaccgtcgcaccgagcatattcacggaaagcaggaagatgcctggcgcccctgccattatctgcaatcattcttgcctctccattcctctgaacttatctgagtctgaccatttgttttacactgtgagaaagatcatcatcaaccgacttaccgtcggtaaccgcggttactggccttaccgtggggtacggtaatataaataccgtggtaacctctttaaattcaaataaattttaaaaataatttaaatttttgataaattttgtacggtttcgtacggtttttcgcggttactgcggttaccgtgcttaccgccggggcgcggtaaccccacccccggcggtttgggaaaccttgtcatcaaccactaaaagtaagaaatttttacattattacatactactccgtccgtctaaaaaaactcaacctagaagagaatatgacccaccctagaacaacgaatctagactattcttcgtccagattcgttgttctataaggggtcataggttgagtttttttcggacggagggagtacctccgactaaaatataaaaatctagtactacctccattccaaaatataataaccttattcaaatatgttgtattagaaaatatctcatctaattctaagttcttatattttagatccgagagagttgtatataggacacatcatgttacgatgaatttagacatgctttttattcaaatttgtagttctaggatgtatcacgtctaatactatattgttatattatgagatttatgagatggagggagtgctacgcagaaggacgatccctgctcagttcgggcatcaacagtgtgtataagggcataaacaatataagctcctcttttacgtggtcttaggtgccatgtaccataaggctactaatggcaataccacctttataatgcatgacataccacccttgcaatgcatggaagcttcaaatgaatcccatgcaatatttctatttatacccttctattttctattcaa

SEQ ID NO: 100393 - DNA, 870 bp, Oryza sativa
  unsure (1)..(870): unsure at all n locations
ctttgatttgcgcaacacgattcactatancgcgaattcgagctcggtacccttaaaggagctagtatcaattgtacatctgcttgaacactagactgcactgagatcacttggcttgcattggctgattttaactgtgaagctcttttaccaagaagatgcctgaaagcagctagtgctcgaccacggtgcaaatgatgttccaccctcaagtctttctcctgaagagggtaataacgaagttgctagtttggggggaaagaactagaaaactataatagagcatgccaaaccaactcagagaaaagaaccccaacttcatggaatgaatgcactgttgtttttttaaaaaaaatgctagtgaagaaggttcaagctgtttgtctgctatatgtggccttatgctatttaaataagccaccttgaggccaacccacttggactaagcttgtggggtcttttggcttaagttcaagcacctttacactggctcctgctatgatgaaatagcatcccttgcattcttgattggtatcgcatataatagcacagatgcatgacaacatagcatgaagtggtcaaattcagactatagaacaataacatgggttaacagcacaaagacgaggcaagattccaaatgaccgaaacaacattttccaagaaggtatttttatatatgacgttagatgagcataccctaagggaagagtataggtctttctcaacacttttttgatggatgctttaaagacaaagcattagtttcttatacctcgcggaatgatatataatctgtgacactgtgagtaaatacttcttcggtgatgtgcatttgatagcagtgcgattccaaagggcctgatcatg

SEQ ID NO: 100394 - DNA, 628 bp, Oryza sativa
ttttaaacttagttgaagtatatacttgttttaacttagtataagtatataacttcttttaattagtaccagtatatgctacatacttttcaattactagtatatactttttatgagtatatactgttcttaaacttaattagtagccgtacatatgtttttatagtaagttaattagtaggagtgcacactgtttttaaacttagtagcagtatataccttttttaacttagtaacagtacatacctatttttcaacttagtaccagtatatagtttttgatgaatatattttttgaacaaacataaagatgtttgataaggaaaaaaatcaaaacaacttataatatgaaatgaagggagtagtataggtattttttttccacgtaatagtacgtaccatttttgtcttatagaatagaacaatacgtaaatttagtatgtgtagggttgctaattccgaataaactgtatcagtcaatgattgataaagaagtgtcgtcaatcattggcaaagtatcgggttgctgcattctgaataaagctaaatgaatgaaatacgctagaagtgcactgaattctgaatagacaattctacatgcaggctaacaaatcggttagcatcgatg

SEQ ID NO: 100395 - DNA, 669 bp, Oryza sativa
tcccggttggtagcaccaaccggggctaaagatcaccgggattaccaaccgggactaaagttaagatctttagtcccggttggtgttaccaaccgggactaaagatcccgggggggcctgacaggtcctgacagcattcgaaccgggactaaagatgatctttagtcccggtttgtgtggaaccgggactaaagatgatctttagtcccggttggttacacaaaccgggactaaagatcaaatatgcccgttacccttttgaaccgggactaaagatcatctttagccccggtttttattgcattcgggactattgtgggaatcggccgaccgacgaaagatggtttctccaccagtgtatgtatgtatgcatatgtatatgtatatgtatatgcatggatggatgtatcaattttcatgaccgattataatcatgaaggagttactataaggtgttgattattttggttccgatgcgtgtgatgaaaagtttgagaagaatttgttttcctttggccttaattcctcgaagaaatataaaaatggcatccctttgttttcccacaccctattaacctttcgggtattacacacactttcaccttacaacttgcaaaaaaagcaacacagcccggctaaattatttccgagaggaaactggagagagag

SEQ ID NO: 100396 - DNA, 657 bp, Oryza sativa
  unsure (1)..(657): unsure at all n locations
cctacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctctttccccgcaaccccgttcgaggaaaaggaggcgctcgttgacgatgttctctcctaacggtaccaaggtgagccggaacacgaggatcatcttctcgctgtacgccatgggaggatagaagggatctggggcaaggactgcattggagttaaaccngaagcgggggtgtcaaaagcgggcgcctttgcacgagccagctacaagttctgtccttaacaacggcccaagagctgcctcgggaagaactcancttagcacatgagatcatcgttgcctcatattcacactttaagttgacttgttcagggcatgagtga

SEQ ID NO: 100397 - DNA, 658 bp, Oryza sativa
  unsure (1)..(658): unsure at all n locations
ccacttcacgcatagcaaatgttccccaggcacaagcttctagggtgtctgcaagaaattgaaatagtcttgtcatgtcatttcatcattttaatagacaataatataaggcttgtgcgagttcccggttaaattagaggctcgaaaaatttagaccaatatcncgaaaaagttaaaagttggtatgcgcagaaaagtttattgtgatgaaaaagctgaaagttttaagaaaaaagttggaatataaccaaaaacctaggtgaaactttatactccctcgttgatgtcactagctacttctgattatcctaaaataaatttaattttaagtaatcattatatcatatcagagtttataaaaatacatagagaataataaatatattaaaaataaataaaagggaaataattacattaagattcgataaagtgggagtattctagtctttatattttgtattggtatatatggaatgagtaaaaaatgaactttggtacatagagtaatttttttaattattacttcttccgtgttaaaatacttgttattgtaggcaattcagccttattaaatgatgtcaatatgattaggagtagtacttcagagtgacaaatattttagaacaaattttggaaaaaaaaaaagctactactttct

SEQ ID NO: 100398 - DNA, 722 bp, Oryza sativa
  unsure (1)..(722): unsure at all n locations
ttgcagctgatatagagggaccaggtgtgataacaggggatgattcttggttaaaccgcttgagcactggggtgagcacaaaccatgccttgagcatgattcatctcttcttatagcaaatggtcagatggagttgttactgtaaaagcactctgcaactgactcaggcactggggcaccttcttcagtgagagggaatatgatagttgtcataaccttactgtaacattctatctctagtgatgacaacactctagatgtggtatacatcattctgtctctctacacatgtatgtggaaattttggagtctgaaatgtattgagagatgagacacgtacttttaccatgcaattagactgcatactatcgagcaaccgtcataatgtgtgctccaatctatgttcaaagaccagacatgcatgctctgaatggagttgatttatcacaaatgagcatcactgtggatatatcagatgacctaaagctctgtcaaagcttaaaactgctgatagagcacataccatgccatctttgctattgtgcatacagaaaatgtgctaacaacagctagattaattctgctagagataatctagttgcggaagatatcaggtttgntcctnaactagggatagcgatcagatactgtctcgtatatactacatctctttcttgatgtcaagacagccatactataataaaagggacccatttatcaaa

SEQ ID NO: 100399 - DNA, 765 bp, Oryza sativa
  unsure (1)..(765): unsure at all n locations
actcggggcccctttgttcgcaggataggaaaaacacatgaattgaaatagtatgtttctcaattcccatatgaatgaaaaaccataggaaatacaatgggagtaatttgatagtgccatgagaaaaataaaggaaagttcacaaagagatcacatctatcattatttttcctctgaaatgtgaagcacatgaatacaattctatgagaatttttctttctttcctatgaattaaagggacatgtaggaaaaaaaaatcatacaaatttgaatcagagtttttctccaaaacttacatgaaatgaggcattccataggaatttaatagggctccatagggtacattccttcgattcaaaggactatataggaaaaatcctataagaattaaatcctctaaaatttgtatgattttttttcaaattaaagggattttaaaaaattggttaccaaccagctgcttattataattttagtctccccaaacagggccaaagttttgctgacacctgngagatagtggtggtacttgaatgtacaatggccaatggnggatagctgcttcagaattagcaacgcaaacagataggtccgtgtccgctcacccaaaggatgataacatgaatcacaacttgtgttgacatatgctatcatatgtgcgatcgactttgcatccccacttgatagtagcttgcccntttacctttggccttccatggactggtaccgcgaattcttaatttaccggatttcttttggaatcaa

SEQ ID NO: 100400 - DNA, 575 bp, Oryza sativa
cactggctcagggtacggagctgcgactcgctataggggaattcgagctcggtacccattgataatatgataaatggggtcgctttatatataggatggactgacttgacatccaagaaactaatgttgaatataacggaaactaatctgatctctatctctagtttactaacaaacctcatatatttcccaactagataatctctagcagattaaaacaagctgttgttagcacattttctgtatgcacaaaagcgaagatggcatggtatgtgctcaatcagcagttttaagctttgacaaagcattaggtcatcagatatatccacagtgatgctcctttgtgataaatgaactcctttcaggccatgcactacttggctttggacctagattggatcacacattatgtcggttgtttgattgtatgcagactaattggatggtaaaagaacgtgtctcagacatcaatacatttcagaaaccaaaatttccagagagagagggagagagagagagagatatataccagagaaagagcgtcgtcatcacttgggataaaatgtttcagtgag

SEQ ID NO: 100401 - DNA, 540 bp, Oryza sativa
gttgatctcttcagtaacctaaatttcaagtccatactcttttagcagagactatggagccctatactttggggagtttcctctgctggagaaggatagtagtgaatgaagatgaattttagatgaaaaagtagcctgtttaatgaatcagttgctagcacacaaaaagatatttcataactaatagattgagcagcggttcgtatactgcctgaaagggaatatttattatttgcgttatatcctgccataagaagaccaatagaaacaatacttgaaatggcaattcattacagagcaccaatgctaagacctttcgactcctaactaaagaggtagccactgaagtatcacaagaacaaatatctaaatagaaagaaattgatgcttaagttgccgatttgaagtaacagcccaaatatttctcaatctaggtattgactcaagattattataatcctcatatgcagtagtacttttaattcttattgatatagttcataacctgccctatgactcgattcaacaaacctaggatat

SEQ ID NO: 100402 - DNA, 523 bp, Oryza sativa
tgcagccaaaagaatacgatttatgtcacaaaatgtcgagaagaaaagagaaaaaaaagaatacctgccaaatcacatcagcagctcttgcacttattacgaaaaacaatcaagaacctttgaaactgcgatctaacccatgcaaatcttctcccctgtgaaaaactagttttaaacgatcaataatgaagaggcacagatcaggcacacccaaaaaggagacaatctgaatctaatggaatccacacatataaaaaagaagaaatccatttaaatccaattattaccctgccattagtaatggatgatttagcacaatgataatgggtcaatcaggggtgtgaaatcggggaacaacacacaactgaatgcagtgagataaggcgagaggcatgaggaaggaaccaggcaatatgggagcgatccatataaggatgaaaccaatatgctattttagcttaaaaaataaaagcaatctcatatccaccgtgaaagaaggtccccaccaataacaaatagacaa

SEQ ID NO: 100403 - DNA, 628 bp, Oryza sativa
aactgatcaaactataagaaagtgcaacaaaaataatacagatttagaaatcaacaaaagaataaaatgtggataccacataacaagtaatatctacgcgaacagaaattattagacataataaaacaacctacaaaaaagatttcaaacagagaaagaaggtaatgaggagatgatgttgaaataggagattgaaaaattaatcagagtaaggcagcattttagccgatatcaacattaaggccctatctagtatggctccaactcctgaattcttttagaaattaatttcatatagtaaactaaagtagctttattaatccccttattttggtccaaaatatgaacacaaatgtttcaacctaataaccttaatctaccagcatctgtaactctaataattactgaagctagaaagaaaaaccaggcaagagaacattcaagtttgatttgtgctaaacaagaccaatgtgctagatcttttgcattgcccacatgttctctcttatcatattggtacaatttggttccaaaccaaatttttccttaccacaagtaccctattaaaatttttgcagtgataaagcttgtagtacatcacaccagactagccctaatagcacttggt

SEQ ID NO: 100404 - DNA, 746 bp, Oryza sativa
cggctttgatcagtagacgtaccatctcttcaggttggtctctgaccggcagcagtcgttcagccaggtgatgaaccgggtgacactgacgagctggatcaccagaaacgccctgtcaaaattgcgcatcatatgatccatcagttttacgtcgataacgagacccgattcagctgaacgtgctgaaaaacgtgtgttggttgcgtgtatgcatctctagttgatgcaagaggccggaagttatagtattttatattaaaaaagaaaatgtgcatgcggggcttaccctgctccgaaatgcgcgatcttccctgaaaatatgaaaattcagacgaacaccatgagcaaagaggaatcaagaacgggtgggtgagaggagctgaggagggtgacaatggcaacactgaccgtagagctggatgagaggcgaggggaggaagaaggggacgacggtgaagcccatccacagcacgatcttcgccggccaccactcggagtgccatgaattccggcgatcgtgcgtcttcctcgtcctcaccgtcgacaagaacatcacgaagaagaacagctggtgatcgccgtcgtcaaggacatcaaattcacaaaatgcaggaaaactcaattcatcccttaagatgataactcctcatttttgtatgtcacttaaaaagtcattgaaaatttgaaaaaaaattagtacgataaatcaatatgtgatgtcacttcacaaacatgtaaattcaaaa

SEQ ID NO: 100405 - DNA, 577 bp, Oryza sativa
ttagttacaatctacataaaaaaatcaaaataaacgtcgactcaccaccaaaatatgatatttgcatagaaatgttattttgcaacgtgatgtataaatgatattgcaaaatgatatatcacttggcatttattataaacttaaaaaagtaaatgactggtgttcctacgaatatatgccattgcatcataaaatctattttttttccaattgtaattaacatagtaatgtaatataagccaatacatcataatatctaagtttatgagaatatatataacttttccaattgtcattaacatggtaatgtaatctgaccaagttgaccacggtaaagagctaattttgagatttgataatagcacttgacatgtgaaatcgaatagatctattgcaaatttgataatagctctagagcaactaactagcaacaattgctcacttaaatatacaaataaatgtaaaattaattttccagagtgaatgtcagatcctttgtccgagctatctttcgaaaggctttcaaaattatctccacagttttgtgccccgaagtgagttggagtattgatataca

SEQ ID NO: 100406 - DNA, 634 bp, Oryza sativa
aggaaacattctgagactgaatctgaaatagatggaagagccaatgctcgtgctcccagaacggcctctgcttcaagagattctatccctaagaagactagaatcgtagaaagcatcaacaaaaatgttgaggtacatcttgcttacccattggaaggcattggctcaactgtcattttactgatagaccaatccgtgaattgatgtgtgagaatgcaaggggaagggatatatatatatatatatatatatatatatatatatatatatatatatatatatatatatatatatatgaaccaaggttcatatgcacccacctcgtatggctgacacatatgcacattgcactatggatgagtctagttcattgtgtactaatgcagctataatatatacctactccactctgttcctatacaaggctgcgtatgcatgcttgtttgcttggtacaagttgacttgcttctatgcttcccaaagccccccgcacctgcatgccacacctatattctgacaccaatgtcatgtcatcatcactacaagctaaaaatctcattcataaaatactttcggctctttttgttagctggcatgtctactgggtatatgatttgggggtatatctcttatt

SEQ ID NO: 100407 - DNA, 648 bp, Oryza sativa
tgtgctctggaggaaaacttcccagcaatttacatactgttaattagataattgcaaacaaaagaatcaacacaaataatcaatacaaatgcaccagcaaatcctatcttactataaagttacaacccactaactcctaaagcttaacatgcaaagatgccacgtcatcatccactaacaatcaatacatttaatatcatgcaaacatgctatactatctataatttaaaatttattacattttagagcttttaaaatgaaagcatgttaaatcatcatcccacataatacacataatatttcaatatatatcttcattattttttataatattttatgtacctatgtagttcatcctcacttggttaatgctatttctctcttctctaattaagccatatcacatcaattgtttttagtgcttatgtaagtttatgttttttagctatcttacacattattttttacttattgttatcatattgaactcccgcagcaacgcgcggggtttcacctagtaattaagataacaagacccatatccacaggaagttccaaaccatcaaccaaaacaagcaaccaacatatttttcagcagatagtggtcgccatatgagtgggtaatcacaccaggtccttaaacttatg

SEQ ID NO: 100408 - DNA, 667 bp, Oryza sativa
ccccgcagtacatcatattcatacgtacctacatatttgtacgttatattcatacacgtacgtacctacatatttctctaatttttatgcaagaaatcgagcatgagttaactccaataaattagttcgtcaacagagtaccatcatatcgttgcattccatgctcgatgttaagccgttagttttccttgggagagattttgatcagttggctgacgacgacaacgacagtgcgtatacggtaaaatactaatatacgtgacaaaattgttcataactatatatatatatatatatatatattgcaggattgttcataactattaatttgtagaggccggttaaatttatcatattttccaaagaaaatgtaaaaaaaaaatggtacggaattgtcgagagcttaaatagtttcctataaatattagagacagttctgaattaagttgtattggtatcatattttttatataaactttggtacttcctaaatatcctaagtactgggacctcgggtatggtaaattaaatttctcgtatcaaatagctggaaagagaatgggtagaaacacacataaggatgaaaaattataatcaaagacgatgaaacgtgtagcagtacgcctatcttgtaaagaaaccatgggaattattaaattaattaatt

SEQ ID NO: 100409 - DNA, 1159 bp, Oryza sativa
gcgcacgtgacgacgcacccctcattttactcgtgctcgctgcggcagtgttcctcctctttcaagttcagaggggcagctcgtcatgcacatgcaaaggcaagcatcgcctgttctgttttgcatcaactgatcaaactgtacacatacttcctatcttctaatacaaagcttgtgtgtgtttgattaaacatggccaggacctgacaatgtttctgctcgaattttttgtaagtaggtcgatcaccaaggtgcctgacactgtgttcctatgaaaaaaaatgaaaggaaaaaactgacaatttctatgcattaagcagaacaatggagcaagcgttataaaaacatcccatgtctgaataaaagcaccatagcaacagttaatatgtgacccattcaggtccagggcataggaaatttgcaaaacgaatccatatctgaaatatatacattgtgaagcagagaaaatacaacctatttgccgagaaaaaaaaaagaggaagccatgtctgctcttttgtgaagcagaaaaaattgttgcaggcctttaaatgttaattgtggttagttttatatctgactgcaatataatagttgtaatacaatagtcttagacatggttcaatctacatgctttttttattttaaaaattatagtccaatgataaaaagcaattttgcaatgacaaacagaagaacgattgcatagttgtaatgccctaacaataatgggttcctctaaattacattttactagccctaattttttgacaagccaaacatgatcaaatggctggatttaattcctcgtcaaagaaccatgaagcagagtgtccttgcaaatcaccaaccagcatgctttggagtcaattcatatgatcatcacaagaaaagggatgaacgttacctgctaggaatggtacccaacaagttctcttcctctactcttcctccagctaggtcaacatcacgatcatcaccggaggccatcatgcaagagatggttggggaacgtcgccgccgcctgcgtgcgcaagaaagacgggaggcaccgcgtcgtgtgcgtgggaacaggaaacgcgcgcttctattctcccgcgtgatcctacctaataggccacgtattgacctgccaggtgcggccagctgatgtggagca

SEQ ID NO: 100410 - DNA, 1297 bp, Oryza sativa
tgcaaaatggcaaaagaaagctgagtttattctccgcccgcacctcagccagattgccggaggggacgacgagcggccgccggctgatggccacgaggaattgggagcgatccctattttcctggcaaattttcttcgaacgggagcgcgagcccgtttggccgcctcactccgcgcgttcgtccgacgacgcagctgcgtcgaacgtccatctgagtcagaggatctggatccgaatttaagtttagggagcaaccaatggtagatgttcatgttaaatggcttataagctatttcttcaagataaattgcttttcattcacgattccaatcaatcgggttactgcccctcgcagaattaattaaggtaagcaatgctttacatttgtatttagttaaagcttcaactaacagcaaaaaaaaaaaaacatattaatgccctaataagtgaaatcgacgagatgttacagataaggaggcaaagacaatagtcccggcgtcacttgcaaactctgcctcatgaactcactacagcactgagcatatgctgtgaacaatgtgcaaagaacaagagtgacccatgcattagagatttacagtacacaggcggaaataatcctagcatcagaaatatgagatgctgcacttgcacctagctctattgtttctttctaactaaagaccaaattaaagattatcaagggcgcgcctagctagcttcttgagcacaaccttcatgtgccaccaagaaaatatgcatccatattgcagagatccagattacaaaaaaggaaaagtggacaaaaaaaaaagagcagtcaccatctgttcgccttaatgtatcttctgcccttttatgcagcaaatgttacgaccaattaactgcaagctccttatcttggaaggtaatctgtggttctcttttgtagggctgcaccaccttgatgatctcatctgcattgagaatttctttctccaatagggcatttgccacagcctgcagctgcatctcatgctgaagaaaaaaaaaatcaaatagctacctttctttttctatgttcaagtaatattcattgtgaggcaaacccctagtcctagttaagagacaaaccttcttcagcaaacgcttcactcgctcacgggattctcctaggagtttcaacacctacaagcccacattattagcacacatgacacattgaatctcttcacacgtttatagggacctatgaaatagtacctctgcattaatcgtggcctgcatttgtacacttggccatttttccagatgcatacg

SEQ ID NO: 100411 - DNA, 1355 bp, Oryza sativa
aactactataggttgtttaataccaatcggtaaaagtttattatatgttctgggtttcgattttagtaaatataccttgtatctatcatcagttgaatatagtggtttattcgtagttttgctccataggtgtggagagatcttgtgtggagggagggtggttcgtcgggttaacgtcaaggttaaaggcaagtgcatgacgaactaattgtgtgattcatggattgtttgctctatctatttattttcgatatatttctatgtgacatgtgactgcttatattcatattgttgttcacgccatttaggttttcatgcttatcctatgtttacaacgttattcttgtttcaatattccggattctggttctgggtaaataattcaagttccatgcttgccatggatgtgcaatatggtttcaatttggttctttgattctggttttcaattattcaaggaccatgcgtagttatggaagtgcaatttggatctttattcatgttcctgtgagtaagcgctgatcacgcttactcggctttgccggcaaatgttaggatgtattcactattgtccaggatggaatctactatttcaattcatgcctgcccgggatgggaactattattttctttgacttggtgtttgaaattgtgtttcttatcaaagaaagaaagttttctgttcgcactctattgctaatgatgtgtatatgtgctttctagttccatactgtacttgctgagtatttccgtactctcttgtgtttatttggtttttaggtacacattgagatcggcatgcatgggcgggaagtagcacccttatatacacatttttctgcacactaccaaactatattgcctaggtccataatgatacttaaactatatcatggttcggtctcgtaataatcttttagatatcttttagtttctttctatgggctatatggatggatcacattgtgggaatgatattattattagttcaatttataactgtttgtcgtggatgtccacatttacaggggagactttactgaaatttctaataattttgggagttagtggttttgagtgtattttagtgtggcactccaggtacgtggctacctgaggcgttacggttggtatcggagtggacggtaggtccatgggaagtaaatatgacaacttaaaatattgatatatgctcttctacgaataagatctgattgtatattacgtaaagctaggaggtataattttttttttcagttttggttcgttggtacggtgtatagtgtggagattaacgtttgcgcataactatattcggcaagctataagggagaacaacatggagttgctaataa

SEQ ID NO: 100412 - DNA, 1281 bp, Oryza sativa
tccataggacacgtacactcatgaattcatggtacggtctacacaatattggattttttttaatctcattagcattgtcttagatcgcagaattggatacacaaatggacctcatatataacaattaattaatagttttatctagcactttggatgatattgagacgtataggtgtatctctagtgccagaggtaattaattaacaatggaatatctatacctcacaataccttgtatggactaaggattggaaatggtcatctaataaaaataatgagagcagaacattacagtgacagccaaagcaagtgatacactcacatacgtgaacaaaaaaaaatactattgaaagcaacaaactaatatcctaaaatgctagtatgcaactgcaaacatagaaccttattttcatttagaaccataaaaaatgataagtatttgacagcatattgggttcaatatatccaagcgagaaagaaggctaattagtgtttatttatgtcatacttttgagaatctattttagccgaagtatagaattaagttcctgaaaatagaaccctacctgctcaatcaagacaggattatctcttgtgcggttaaagacataattccgtagcctgtccaattcatcgcgtaccgcaaagatcccatagacactaatggggtatgattcgttactggataacttcaaagagaagatttggagcgtatcatttggctcattcatcccaatagttgatgcagctgcaaatatgtactctcaagaaattaatagcacgtataagaaaagaaaagttgcaagagtgtactctctccgttacataatataagactttctaacatctatatgtatgtggacaacgctagaaagtcttacattgtaaaacgaaggaagtacatattggtagcaaagaagataaattgatcaaataattatcaatgaatcctctaaacagttggaatataattgaccaacacttactctcagaagtagtgaaggtcaggtattcgtgatgatcacagtaaatgctttttttgatgcagtgatatgatgtcttgggaaacagcctcaaaggatatcgtagaagttgagcataatcatatcccgacgctacaaactctttatatgcctccgtgtgttctgcattcctcctgatgtatgttgctagccacttgcgacttatttcctttggagtgaatttcagaaaaccctatgttttgaggctaatgtaacacataaccacaggttttgtttattttctcacataaccccgtgc

SEQ ID NO: 100413 - DNA, 770 bp, Oryza sativa
aacatgggcaagtatcacctagccaagtggcgacaagatacacgaagcgtgcattttttttcatttttttaaaaagtatattcttgcaaaatcgtgctatgaaagttaaaatgctatacaatcggctgtccatattgtatagcataatctctataagtttcctgaacatctgggaatcatttgaaccctcttcgcttgctgaaccccacgtagcccatatgagacttttgggcaatcagtatgaccagagaagtacgatcatttaatctttaacctactatttatattttttaaaaaagagcacatagacattgattaactatcatgtgtcaagaccccaatataagaccccaatattgtaggcctgaatttaagggatccagatcctcgctacagagggacgtccggcgcagctgcatcgttcgttccgcatcggacgaacgcgcggagtgaggcggccaaacgggctcgcactcgggccaagtcaatgaaataggatgggccgtttgagcagaaggctcgtttccttggccagaaaaatcggcgccgctcccaagtcctccaggacatcagccggcggccgctcgtcgtctcctccggctcaggcgctattggagcggatcccggacaaagcccctcccctcgtcgccgccctcctccccatccctcgccccctcgcgccgcgcgagagccctgcttcatccgggagatctgcctcgtccaggtctgtcttgacgacgatggcttccacggcggcgcccttcaccacc

SEQ ID NO: 100414 - DNA, 3146 bp, Oryza sativa
acacttaacagtagtattagtagtattaggctgtgtttagttcgtgtgctaaaattcttttaagtatacggacacatatttaaagtattaaatgtagactaataacaaaacaaattacagattccatttgtaaactgcgagacgaatttattaagcctaattaatccgtcattagcaaatatttacagtagcatcacattgttaaatcatgacgtaattaattacgctcaaaagattcgtctcgtgatttatattgaaaccgtgcaattggttttttttccatatttaatgctctatgcatgtgtccaaatatttgatgtgatgaaaaagttagaagtgtaaataaaaattttaaatctaaacgcggccttagtatactcctgtcaggctgtcactgcttgcgtgtgttttgttgcaggccggatacgtcttgctacagtgatacagatgcaggaggcgggcaggcttaattcgtgcgtgtggtggtgcagatatgtgtagtaggagtataccataaagtcattctttatgatatgtagaaaataaggtaggtgaagcgtcgttattattggtcaggtgtgtgtgtagcaacagtgtttacaaggtatgtactgttggatgtgtgttaggtatgtttggaacagtgtagagcataagtaatgttggtaatatgcctagcatgacagaggtagggaacatttccatcaatcttattggaggaaatttcacaagttaaactataaacatagtagccccatcattttacttatgcatatgcttatccgtattgcttattcggaaaaaaaaagtaatttgtgaggttaaacttttatatgtaggtctatcgcgattcaaagataaccgctataaaataaaccacgataaaaaaaaccacaaaattaactttaaattaagttttaaatttaaattttggcttataagtataagcattagcaaaacgatgaggctatcctaaattattgcacaaactagcaacctagctatcattttgcttatgcttatgcttataattatcgaacaacttattagtaaaagaaattatcagtaaatttttatatacgtgttcttagcgattcaaaagcaaatgttgtaaaacaaactacaataaattcacaaaatcaactttaaaattaagttttaaaattcaaattttgacttataagtcaagcacaagcagaatgatagagctctaggtatttaagattttatattgaaaaccaccaattctccgtttaaattatcacaaaactataggttttaggctttaccctcgttacctgacaagtaggtcctcatacaaaactacgcacgccaattaacggtgaatgtgatggtgaacataaaatctgtagattgtgatcgtttgagcacaaaatctgtagttctcccaatagaaactcctaaacatgtagttttctaataattttgacaaagtatttgtagttttgtaaattttagatttttgtctaggaacttttttgactttgaaaagtttaaagaaacattccttttttagttagagggagtacctcttgagtttttgtttttttttttgcgtgtaatggttctgctggttgtgcatacataactttttcaagttgatgcaatttggaagcacagcttgttaggttgattgtgaaatctgaatattgttttcgaccaggtgacaaatgatccttcaatttccatacacttttttacttggatcacaatataatactccctctgtttcaaaatatatgatgccgttgactttacacataaagtttaaccattcatcttattcaaaaagttttatattaatatcatttattttgttgtagtttgttttatcatcaaataaaatataatcttaacttataattttatatatttatactaaatttttgaataagacaaaatgtcaaacattatgaaaaaagtcaacggcgtgatgcatttttaaaattgatgtagtacaaaactctctttttattcggacttccatcttactaccaacttcttacttattgactttgtggcccttaaaattcaaaagtattatagcagataaaccttgctttgacacgaaaagagacacacctatcaattttgtttcatccaaaattgcagtcacacaaaacaacctttttcacatttgcgagatgaagtactgtacttgtacttgtattgtcatagactcatagttatgactgaaacaatcttatctataccaatacgcgcctaatcttgtcagatggaaccattgacttattagcaaaagaaataattcatacacgaccaaatttatgcgatgacgaaagcgagctgcaaaactttcattgcgacgttatgttgcatagcttattttcaaagtagtgatctcatgacgtgtggttatattattatgtgatgttaacaagcaagccattgactctgaccgacctagaactataaaagaattaggtgatgatgaagtcagagattaccttgtggcttcatatagaccaagtcaaatttatctaatccttagatcactctgtcctacttaatttgtgaaacagaacgaatacatatcactagtgaccaagctacttgacccactaatacaaaacaaggtttgtttcataaacagggaagtttgtctatgaagtatgaactgggcagtgaagcttggtaccccttctggttttaaaaccgacagtgattacgtttctttactttagtgaccttgtcctaaacttttggtattccttcgtagtatcatatcccattgaaattcctttttgacaactgaacccttttgtgaaatatatgaagtaggtcgtgttattatgatattttattattttttaccttttctaatttataattttaaaaacaaactctccctaaatttatttttccaaaatctaaatcttcttggccacgccaatccacctagcatggcgaaataacactgcacgccatctgtaatgggtgtgacagctttgttttgcacgccgcgctagtatgactggtatggttacaagtctcagatttggaaataagttttgggatagtttatttttaaagttcttaattaaaaagttcaaaaaaatctgttactatccactaccttatttaataatattaatttgaaatag

SEQ ID NO: 100415 - DNA, 1202 bp, Oryza sativa
agttgctcaccttgcctactatatgctattttatgggatatgtcgttgattaatttcatataggtgatttaatcacactagctctgttattatttgccataaacaagcttatgaccgatctatgtgtatctatattttacttacctaacaattataaggctaactctatttaaataactaataagtcgtgggttttaattatatttggacatagattagtaaatggcactaatattttcctaaacacccattaatttgaaggattgattataactaatttatttagttgctacagtgacaagacatgttaaatataattatgccactgtacaatatccattttcgatttatacatcctaaactattttgcgggtataaatattttgttagtataagtttttaatttaatctactcgagcattatatccatataatagggtagaaattttctatcgcgagctaagtatcggacgaaatcctggaaatattgtacgaattaatttagtctatgactaaatgattaaatataatacaagggaaaaatccgaatttctaccgtgaattgattatttatagggattacccaaaaataatctataataattcatcttttttgtttagtaattaactacatctaaattattaccgcgaattgatttcttatagaaattgccaagaataatccataatttatattaaattttgcaattctacgactataattaatccataattaaattctaattattttaaatcttctaaacttccctaatcttcctctaatttctatttattttttttccttctttttctctcctcttttctttcttttcttttctttttctctctttttctctcttttctctcctttctttttcctttctttctctcctctctctctttttccctttcttctctttctttcctccctcccggcttcttcctcccttcctctctctctctctcggctcaggctacccggggcggcgacggcggcggaacgagggaaggggcggcggcttaccgacaacggcggcggcgacggcggcgcaaggcgaggcgacgctcggcacagcacacggcgcggtgtggcggcaccgagggcggcagcgcggcggcacgagggcggcagcgcagtggcacgagagcggcggtgcggtggaaagggaagaggggaggaggagggaaatggagtgggggaa

SEQ ID NO: 100416 - DNA, 515 bp, Oryza sativa
aaatacttaaactttgtcataaggtgtagaatagttcttgggtccactaaaatcattatatggatatgccatgtcatcattcatgcaaaatctatgatgaattgtccaatatacccttacgtatatcatagaaaaataaatataagggtgaattggacataaccataggaaaaaaatacttatcctttttttcacccttttgaggtatatttttgctcttacattttaccttttgttttttattttcctatgatatatgtaaggttaaattggacaaatcatagattttgcataggaatgtaacatggcatatccatgtggcgattttggtgggaccaaggactatatcaacccacatgacaaaattaaaggacttgtttggacaatatgaaaaattaaggactaaaatgagccatgagcgaaactttaggaatcatattagctattctccctatttttttaaagaaaaccgtttatcagtttaaaaacatgcaagcgaaaaattaagaaatttt

SEQ ID NO: 100417 - DNA, 607 bp, Oryza sativa
tggaaattgagagcacaatgcgagtatactatactgcaaaatggccaggagacgtaaacgaaacatagacgacgtgctggcttctttctgtccttgactagtttgccaggaacatgatttcgtccggacacggttatacacaacagtgtataatgtatactattttgtattaattagtggctaattaattataactagcaactacatatactatgtgctacagcctacagattacacgtagtaaagatcatgttagtgtagaacagagtggatgaggtgcgaccaacgactaagacgacgtggctgcagtacatgcgtagctacctaattgactcacctcgctcataaggagtatacatatttcatattaagggtgttgggaacccatctcccatacacggaaaacggaacggtccattaacacgtgattaattaagtattagctatttttttttcagaaatggatcaatatgaatttttttaacaatttttgtatagaaactttttgcaaaaaaacgcatcatttagcagtttgaaaagcgtgcacgcggaaaacgagagggtagcgttggaaacttgctcttgcacacacacccttaaggtggtt

SEQ ID NO: 100418 - DNA, 614 bp, Oryza sativa
catgttcatctgctggcaattaggcaaaagaacattttcttgcagattgctatgtaaggtgagtggtttatatatgatcagtattgaaattctcaaatgtactccctccttatggttttccatcttgaaggggagcaattttcttggatgaacagtttttaagttttataaccacagctgtacagatttgttggcagatatgcagagagatagagagagagtggcgtacaccaaccactggctggtctcgtccccgtgaacaacggtctgaatgtatagaggctagcttttcagtttgtcagggagggaggggagaaggtaaggtactagtaaaatgtagggataggataggatgatggtagtaggaaggaagatgcatttggaattttgctctcgtcttgtataccgatgcagcagcaacagtatcatccagcatctcacatgcgcccatagaacacaccttcttcaaatcaaatacagcggcggctttcagcaagcttgtgattgtgaacatggaagagaatagtaaagtaggagtacaaatgaagagagaagcttccgtataatactcactacttcctccgttttacttcaattttttcaaagtcaaattt

SEQ ID NO: 100419 - DNA, 557 bp, Oryza sativa
aaggtggcgtacatacgtacagtgagtatgcataaaacatactatatttataaatttattctctactttatcttaaattcggtatgtttctaaccttgtataattgctcagtttttttatatctttctctacaatcgctatatctcattttatcttattttatctttttattgaataggtgtatgtctaagtagcaaccttctcgtatatatatttacgcagtatcctaatcagcacctaaatcaataaaattaatcgtgcatttattgtacttttgaccttagttcgcacgcacaagataagttcatataccaaaacgagtattttacaagttcatacactagattgcacacacccgacaagttcatgtacagccggtgcaatttgctcttaattatttgtcactcaatagacatgtgggccttcatgtgtctatgatatatgggtccagtgacaaattctaatcaccacttgtaagagtcgcaaataattaactcattggtttgcaaaattactccatagttaaggtgtctgtacgtcttttcttttgccagaaa

SEQ ID NO: 100420 - DNA, 1377 bp, Oryza sativa
ctccgacgaccactgccgccccggcgacccttccttcctagctccgaccaccgccgccgctccctcctccaactccgacgccgcaccatcgccaccccctccctccccaggatccggctaccaccaccgctgcccctccctccctggctccggccaccgtcaccgttccctccccctactccggtcacctccgcggctctctctttcggctcgggccaccatcgccgccccctccctcggctctctggctccagccaccgctgtctctctctctctcccttggctccggcacccaccgccgccccctccccgggctctctggctccagccaccgccgccgctctccccccaccatcggctcggccgttgtgcctcgtgctcttgcagctgatagaggtggcactacactgatcaggtcatctctgacgggctcatacccttacctgtgacgggttaagcactggtcacagatctgtggtcactgatgactcggagtcacctgtgacgggtaaagacccgttagaggtaaaagttacctttgacggactgaaaactaaaatccgtcgtaggtgaggtcacctgtgacagaggggtccgaattgggacacgtcacaaacctcaaaaatgagggaaaaataatattataagcctagctagtcgcagaccattaggcatcacaaatcacaaaaatgatcacattcacagtcatttcgacacaagacagaatcacaaaaatcatcgcaatcatattcatctggccaaagaacaaaatcacttcacattcacaatcatttgggcacaaaacaaaattacaaaaatcatcacaatcatattcatctggcggtggtgcggtggtggaggaagcggccaacggtcaagagggaggcggtggccggatccgcgcccggatccggcggttggcggtgcggtggcggaggaggaagcggttgacggtcgggggagaggccgcgatggccggcggtcgggaggttgggaggcggcggcgaccgacggtcgggggagaggccgcggcggccggatccgcacctcgtaggccagatccggcgaccggcggtcgggaggcggggaggcggcggcggccgacggtcaggaggcggggacgcgtcagcggccggcgctcgggagacggggaggcggcagcgaccgacggtcgggggagaggccgtggtggcccgatccgcgcctcgtatgctagatccggcgaccggcggtcaggaggcggggaggtagcggcggctgccggtcgggagacggggaggcgtcagcggccggcgctcgggagggcgccatggcccgatctgtgagggagagagtgaggagggagagaaggaagatgaggggggagagagtgagtga

SEQ ID NO: 100421 - DNA, 557 bp, Oryza sativa
taaagtttcacaaatcctcacccttatgacctatgtatgttgagcacaaatttacttaaaattctaaaccatggtgcatatgaaaattttaattattaagttctttactaaggctgatagtttaactcttcgctacattgaaaaaaatgtttcaaacatgctgaaactaatcaagatttgaataaggtggggttttatgaaacattgaccataagacctgtggttaagtgtcacaaatcatagcacctgtggttttctgcaactttgaccataaaccgtaaggttttctggaatttactcataaaataaaggttcataacaataggcatggaagcataacacccagttactatagtactataccataaaagacttactttgggcaaagccaatcacccttcttcatttctgtttcagttgtttccctaccctttccagctgagaacttaggctttgcaatgcccttgtcaaaagttttggtcttgctagaagtttggaatacaggtttaggaattgatggatcaattgttgtgtcgctaagcatagtaagctctgaa

SEQ ID NO: 100422 - DNA, 2043 bp, Oryza sativa
tccgtacacgtgaaggtataccttatcggtatattctataagtcgtatgatagatgatatgccttatctgtaaccctgacagaagtatattagatcaaagttcaaatgatcaatagtgtggttttatgaaacattatgaccataatacatgggactatccgcaacgtacgaaaatccctatagttttgtgcaacttagaccataatacgcgtggttaggtgaaatttactttacaaaagttcacttactaagtaaaaatgaaccacctagttaacatgcatttcttctttccagtttctatttaggcaaaatgcttgagttcctactacatagccatgctcatctaatttggtatcattgccatagtgattatttatagacaagcaccatatatgtaccagtgagtgcaccctcttaccaaacaatcaaagggaaaaaaacaaatgacatatctctaactcgctataaccattaaccccagcaattcacgtatgtgtaatataatcctttgtgaggttggaagagatgaagtagaagaactatgtgattttcaccataggtttttttttctatacctagcaaacgttgaatatgattggcccgtacaataatcaaccccttacatggctggtcgtcgtcaacaagattgcaaaagaagttgctctttggtgcgcagtcaggagaaccgacacaacagtgatagacttcacgccctaatacgtctctttccttgtttagattgtcttttcttccatcccgtgagattatccctagcattctttctctaaggccgctttgccgccatgacgacacgtacttaaaacattctatcttaatataaaaatgtgcatttctcttgcacattcgcttttaaatacataataaaagttgatagtggtatacttgtttttagaaaagaattaaatattacatattataaacctaacccagatagcttggaacaatgggtataagaagtttttgaagaaatcatatttttgaaaataatctacaaataattggcagccaatgaactataaagaacgggccgtatctagtttcaccaacaattgggccacgttggatgtagctattgttgcctttaggtcattccaagtgagagatgccattttcatattttcaagggcgccatataagcaataaaatatttaattgatgattgaaatagctcatatagtatatggttttaaactattggaaacaacatagacatcattgcatcacttactttattaattcctttgcaacatcataaaaatattgacatgacattctatttaatgacaaagaaactcctattgagaatagcactaggagtaaacgatggcaccatttctcttcagactcacatttacttcggtgaaagtgaaacaccatttccacctaaaaatgtaaatgacaaaaatcataacatctgcaacattatacgtggactatttttttcgtacgaaagttgtatcattacgtactagcctagcggtactatttatttgttaatattctagctaattcgaatgattttcccctttgtctacaccaatagttcaccagcgtgatcaccaagttttcatcttcatcattatagtttgaggggccatgaattgaacaactgtacgtctatgtattcatctcttatcatcaaatcagttgatatcatcacttagattaaattgcttactctttggttttcgcgtgtttccccatatagatgtgagaccagtacgtccggagtcctttcggccaaagttttgtaaatattatccatcatgggtttggatatcaaatgagcattagcgattacaatgaccagctagcaataagatcgaggtttgtacggttgtatcaattccatataatcgtaatttaatcataatatatctcatatgccctcttgtgaaaaatatttgacttttaacacaagatttagtcaaaattttaaaacttttaaaattaattttgtgttataataaatttgtaaaaacctatagaatttatagtatcatgataatacttttcaagaca

SEQ ID NO: 100423 - DNA, 565 bp, Oryza sativa
cccctattaatttcgagctatgcgggaagggagccagtgccatcgccagtcaacgagcccagtagaggtcgagctcgccctcccttctatgagggcgcctcgctcagcaaaaaaagcatgcggcgggcacgcagcgttcatcccttcaaccaccacggcccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaat

SEQ ID NO: 100424 - DNA, 507 bp, Oryza sativa
ggcgaatccgagctcggtacccgtgacgagccatgagcaacttcataagctaaaactacaaggaagagtacatcgcaatctcctgctagaagatccacatttcagttgcatcaaaagcatcacattatctggctcgtggattgttttgagcccgatggaatcactaggctcactcacaactctttatgaactcaagctaaaggatgacgcgctccggtgctcagaggtctcatgtttacaaaacagtttccctgagctgcggtacctgaaaatcagtggactaaagaagcttagggtgttccatgtggggaatggctcatttccgaatctcacccgcttctccatccacgactgtacagaattccttagcacggttgaggttatggagcatgctacaagactgcaagttctgaaaattaaggaaatgccgtcagtcctgcctgatgttacagatttttgccacagcagaaacatcaaccttatcagctgatctggcatcaaagttat

SEQ ID NO: 100425 - DNA, 708 bp, Oryza sativa
ttcacctatttcctattttacattttcctgatactatattatcatcgaccttgttgtctagcaccaattctatagccaaattttggtctgcatttcaatcacttgggttcaatcacttgaccagattacgccattgacttttatgaaataacgtttgattatttgtcttatttaaaaatttggtataaatatgctaaagaataagtcatactgatacggtatcatctatttaaaaatgagagtactatgatacgatgaggttttctgcttcgaacatcagatgctagatgacagtagatgctagatgacagtggaaacccttacggatgttaattttctatgcccttgtttagttccaaaatttggtataaatatgctaaaaaatacctgtgcgttgcaacgggtgaaggctattttaattttattattgttatatggtttagttaaaatggaattcactgtgagagttaggttggatatatatatttttagaaaatcatgagctgcagttaagagtagttagcatgcgagttcttttttaaatagatttcttatatgatttcttctgtattactaaaagcataacaataataaaccatataacaataataagattaaaatagatttcatccgttgccacgtacgggtatttttttctagtaatatgtataataggtaaagaaatacaaatattacatatttaactgg

SEQ ID NO: 100426 - DNA, 655 bp, Oryza sativa
gccctgccgctgcagccatggatgcctccgctatggaagaggtgaataccgtaccgaggaggaggaggatgcgaggatgtggtggcaacaggagcacgcgacggggaggaggaggaggaggaggaagaagcaaggcatgaagagagccaagaacacaagcaagcgaagagccgtgtgctcgatggctggaagtttcgaggaaggagggagagcgagaggaaaaaagttaatagaaaagatgtggaggagaaggtagttggagttttggataaggatgaagccgtccgatatttcacatgcgctcggacgtacgtcggaaagcatttttgaataattaaccctaggaactgtaccatttcaacaaactaagacaataatttggggagggataagtcagacttttcccaaatccaaatgataaatgactgattggagggacatcaaagaaatgtaatcctatggcaagtaaaaaaaaagaaatgtaatcctagatattattttcccctgtggctgtgttgagaagagtttaagattataagaaaaaaactgattgaatagttaagtttctaataaactagaaaagttagatttcataccttcttgcttcttgtttattttctgaattttataacatagattctaattaggttacgtt

SEQ ID NO: 100427 - DNA, 696 bp, Oryza sativa
cctatgttgtttttgggtgatctggactaagtaaccaaatttctaaaattcagcacaattattggctcatcatttcatcaatgccacaatgaaaatgcaagcatgtgggaaaattctggtttcattcctccaagctttcaagcttatgtgattactggaaaaaatgcccgtgcattgcaacggaagaaaacatgagaaatttaagaaaaggttaagaaaaatttacattatgtaattaattaaaatataaaatcacaactatacatgtatacgatgttgaagaaaagaaaggctcgtaaaaatcaaggtaaatgtggaaaaataaaattttccaaataaactatggctggatttattttttattaaattctccatgattaattacactatgtgaaatttttccgatattttcagagcaccattgctaatttaataatacaaacatcattttagcatttatttaaatggaaatctaaatgaaaaccctcctttctccctgggccattttgagcccattctttctttagcccgtagctgagccggcccattaacctcacttctcctcccttccacctcggcctgcaagcgcgcatccagcccatcaagcaaccacaaagtctaatcagcatcccttctcctcctctcactgtcgcgtgggtcccagtgctacagggtcgtcccctacctccgtccgac

SEQ ID NO: 100428 - DNA, 638 bp, Oryza sativa
ggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcaaggtggagatgtacaggcccggcagggtgtgcagcggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagagga

SEQ ID NO: 100429 - DNA, 651 bp, Oryza sativa
gacaatacaacaatatcttattagcatgttttttattgttggagctagatgacaccatgacaaagtgagaacatctttaggaaatgttctacatgaagaaatcctatagtattaaatattcattgccaattgtgctttctagttatgttgataaatatgtaattatcttgtctatctcttcattaaaaagtgaatgctgtcttgctaacttgctatatatatattgaatcgaaagctctgttgtctgttgctatgttttctggtagacccaatagctaaaggcaattccatacagaatattcaaaattagaacactcaggtagaagctgacataaagaagctggagttgttatcaagtggacttgtgcttcccacttcccagtaggatctaaatattgcaataataatatttttcagaaattgttctttgtttgaatagatgttcttaagccctgactctgaaactcttttcagtcggcctgtaaattgggaacaatgatctgtccttcaaatgtgccttcgcctgattagcacaactggctcatgaacattaaacttggcactcggcagccatttagtgtaacatgctaacacattacaaaaaccatatttggctatagctgataggacactgcaaatctgcaatattgt

SEQ ID NO: 100430 - DNA, 651 bp, Oryza sativa
cgcttccaaaacctctaatatagagtagcaattaaagatgaaattagccctaatttagtaagtacgaatcagcctgttatttgacctaacctaatgatatgaatttggacaagttaatacgtagtaatctggataggtaatcaatctcatcctagataattacctgcctagtttgtgatagtggtatcccatccttaattgctactacaattctgggatagatgaagtatgtcttaattcttgtagaaactttatatataatattgatttctcataaaattattttaaatctattattaactttatattatttaattaatgtatttgtaccatcaactatttattacaggccatatattcagctattcatccatttagagagaaaaaaataacgcatataaatagtaagggcccctttgaattgcaggattgagaaaacgtaggattttgatagaaatgtaagtgtaaaatagatgattgtaaaacgtagaaaaaacataggaatgaccatttgattgaaccgtaggaaaaacacaggaattagatgagagagatagacccaaagaaaatttagtaagaggttgaagctattcagaccatatattcaactattacagaccatatattcagctattcatccattcagagaaa

SEQ ID NO: 100431 - DNA, 594 bp, Oryza sativa
attaattaagtggtaacaagtacaacatgtcacttctagtacacaaaccccagtattagtttactctcatatcatcttatatttttcttggagattgtgtggaggttgccccttgcatatggggtggttcattctctctctcctaacttctctcctccaactcatcatctaatcctatatgtcaaatttaggggcaatatgtaggggtttatagtacttgccctaaaaagaaaaaaaaagaaaccacgtccctcccggaaaccgtgcgaaaaaaaacaaaacaaaaaaagaaaccgcatgctgcccgcgctcccctctcctcgcgcggcgactgatcgcctattagctatttcgaccaagtaaacagttgggttcgttgtctcatgagtcacaaattgccttcggtcggaccgtactaagagcaagtataatagtatagtcaactactacctccaaatcatctatagccaatgtaatagtcaattcatacaatagttacttactatatgtcagggttggggataccacatacctaatagtagttgactaaatctcgacaggacccaccatataccatgtcttatacggaaacaa

SEQ ID NO: 100432 - DNA, 639 bp, Oryza sativa
tgactggacactacccctcttcttaagtgttgaagaattataattcaagctttggcatagataaaactagggtcagatttaaatcataatgtttaattgacagtcatcttcattttgttttggcagaatgctgaagcagcaggcaaggttggagcaagcgccaagggcaagcgtaagcggatgagcagcaggcaagctggtaggagcaagtgccaagggcaagcgtaagcggatcgaggagtgctgaatggtactccctcagttaaaaaaaaaaaacaatcctgagtatgaacctggacacgtgtgtgggctcatacccaggatttgttcttttctttttaggacggagagagtagtatatttctgttgcttatcatgtgcgcctagcatgtcgcttttttggcttacatcctgtgagatgtaatgttagcatgtgtttggtttcgggactaagtgggatgggatgaaaccatccctgattttggagttgggatgattccactcacatgtttggtttgtaggatgggacaattctaattttttgtttggttgaaaggatgagggagaaatgggatggacgccgtttgccatcaccgtcaacgaccgtcgcttgcgccacctgcatccacgcgtggaaca

SEQ ID NO: 100433 - DNA, 684 bp, Oryza sativa
ttcaatttgaatactcaagacatcctattgggttttactgacatcaggtttataaattgcaagaggttctgtgccaatttaccaagtgctaagcagaaaatgaagaagtacaggcacaaaagttcttaagcacattttaagccttgctgcacgaaagcacatatataagcttgcttggatttgaataactgcagtacaaacaccagctccatattcctgccttaggctgtattcttttcccctctttcccaactcatttccctcgttttccgcgcgcacgcttttgaaaatgctaaatagtgtattttttgcaaaagttttctatatgaaagttgctttaaaaatcatattaatccatttttcaagtttttttaggttagtacttaattaatctcaccataatcgtgtgcttcgttttccgtgtcagttgggaaccttgcctcctgaatacaacctaatcattgactagcgatgatataacaatggagacatacggtaaaataatccgagcaaaatattttggaaattccaggcaaataacttgaattttaacaaagcagacacattttttaaacttatgttcatatgggaacagtgtatacaaaacattatgctggttatttaatagcaaagtcatctggcatggaacttaaatagataatgtgtaggcaactacaaaatgga

SEQ ID NO: 100434 - DNA, 570 bp, Oryza sativa
caaattttactttgctccatagcaggttgaaaaattaaaatatcctcttcgttcaaaaaaaaaatcttaattgaagtgtagtggtagtttgtatgttagttcatttttcctcaacctgtataagataggatgtgcttattttaccctgacgataggatgttgctttcttgtttatataaggagttttttgatgataaaaaagatggcgtaaagtctataatctaataatctcataatttttcaaatgtatggaaataattgaacaacctgtgattgtgattatgtttaatttttattcatctacatattatgatgatatcttcactttttttaataagcaacatgattgctcatctttgtattaaaagaaataatttatgtgcaaaaccaaaaagaaatgggggagagggaataaaaaaaagaaagaaaagaaagactgcctatgatctaatctcacgatgactttaaaatgaccacgccatacagttattacagcgataaggtcgacatcggagaccaggatatatttgcatttgctttagagtttttaacgtatatgatgaattagta

SEQ ID NO: 100435 - DNA, 686 bp, Oryza sativa
catggtcagggtaaccgaggaggtcgccggagaaactcgaacgtcgccggacaggtggcagacgattggccttgcataagggaagccttcatctttactcttatcatcacaacttatcttactcttaggctttggaacttcactctctgaaactgctggaacagaagggaaaaaaattcagagatagaattggccagtatacttctatggctgattttactggggatttaatcatgtactaggaactattgagtgtatcaagaaatctctgaaactgctggaaaagaggggggaaaacagaaatgaatttggccagttttctatgctgattttactgagaaattaattaactaggcataaaataagtgcatcaagaaatcttttgtattattgttggtaactctaacctgtctgtggtgattttgtcaaagattctttctttccaggagggggatcattctctgtagagattgcaacctgtctctctgatcttgatttattctctgaatctgtcccattcttaaaattttcatttttaaacacggaacctgcagagcattttgaatttgtaaagatttttttaaataaaatacaacctctccctcacctcaactaaaaaacaatgcaagaatcctttattggcaccctaatcattaactgaaagaaaatttagcagattgtcacta

SEQ ID NO: 100436 - DNA, 690 bp, Oryza sativa
cactgttggttttagtcttgcacttcagaatgctgcatcttttagaatctacttaggcttgtaccaataatgcattcggtaattgatttcaaaacctctctatattcattaattaggcaattcactcagggagactctgaaaataatactaaactgagggactctgaaaataattcttaatttgaaagttacaactatcaaagttcaacaagagccaggtaattttcattggttaagacaaaagaaaggaagcttgtattggataagtgaaaccactatgaaataattctacaccaaagaaaacataacaccaaccgtgtatacattcggaaattgattttgaaaactctagattcattaagtaactaattagacaattcactcaggtttgtattgaagaagtgaaacttagaagactgtaaaaataattttctagaaaagaaagcgttccggaagcatggatatcttaagcttgtctcagattggaatatgttgaaagcatcatagcacagggctataaagtaagaaaggtcaattaaaaatagtattgcgccaaaacagtgagccataaacgcaaatgggataattgataagggtattgtactttttgtcaaaaataacaacggaaggctacggaagttgctgattttttttttcaatttcagtttaaatttgagcctctgcatactg

SEQ ID NO: 100437 - DNA, 576 bp, Oryza sativa
actaaaataggaaagtaatgcggtgtcaaaaaagaaagccagccatatggggaggggtgatcgcccaggtaagggtgggcagaaaaagaccaaaccgaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctctctgtttccttctcctcatccacccagccgccacacccgagcgctcctcttctttttaacgctctccccacctgagcgctcctcgttttctctcgcacatcggcgtcctgttccgtcgccggtgcctctgcacgactgcagcgtcccagcatctcctcctcctcctcctcctcctcacaagtgacaccacgacgacctcctcttcttgcgtggcttcagtggacacccaggccccacagccagcccgagccgcgtggaggctccccccgggggcacatccgatggtgcctcctccactccgacg

SEQ ID NO: 100438 - DNA, 501 bp, Oryza sativa
atacataacgcatttcaccaacccatttgggttctcacgtatagccatctcgcattagtcattcttcagtacttagtagtattaggtatggtggaggaaacaaaaggtgtatcaagtgggatgacgtaaggttcgattacatttcatacatctttgatctttgaaactaattaatttaataatgagggtaatgcgtcaaactaataacataatgctttaatggcctattttggcctgtgtctctctctgtattgctttatgtaaaatagaacgagaaacatgtgacaacattcgaattgtgaaagttatttttttaattagacactttggtttgatcgctgacgatggtcaatggatataataattatcttttcgaggcaatatgcttccgtacgtcagggtgcccgattcatggagatcacaggagtagcttttggttcatcatttatgggattattgcccacatttggtgagataaattcatttctcataaagtctggt

SEQ ID NO: 100439 - DNA, 579 bp, Oryza sativa
atatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaa

SEQ ID NO: 100440 - DNA, 543 bp, Oryza sativa
gatatactgcaggaggaacctacaatttcacctcaactgagccattgcaacatccaatcattactcaagttgagagtgatcaagatgatcttggtaacactgagattatatttctagattatgaggacaccttggcttatcaagtacaagatgatgtagatgcaactgaagatgataatgcaaatgctgaaaggcttaaagagatgccgcatagaagggttgttgctgtaccaagaaacaaagaagaaaaagaacccaagaggcaaaagaagagtgttggcgtagaaggacttatggaaaggtaccttgatatgaggaccaaacaaactgaagatgaggctgcacaattagcaagagaaaaggaggctcatttagcaagagaaaaggaggctcagttagcaagagaaaaggaggctcatttagcaagagaaaaggaaagtaatgatttttcaatcaagaggtgcatatctgttctgaattcgatggatgtgacaaaggcagaaaaggtcaaagcatataccgtcttcaagaattcagagaaca

SEQ ID NO: 100441 - DNA, 637 bp, Oryza sativa
tgcagcccaattatgagaaaaacaaaatataggttataccataatttgatgcatcacaaaatatgcataactaaataatatttacttaaaaaaatatttgagtcatatcctagctgtttgtccacctatatatcattccaaccttaagatagaaatgacctattctgcaccgaattctacttgataaggcaatataaattatatggaactaaagataaagctattttttttctgtataacatgataatataacggtaatgttcagcttcagaacaagcaagcaaaagctgcatgtgtattgccctatgtatctatatagtatatatgaaaaatccattaaacttcctaaaaactctcacaccgtcaggtgagactcctaccaatgctcctaagttgccacgtgtcactctaataaattagataaaaccttacaaattttgcgaaaaaacaaaaaaaacccaaccctcgattttcatttaattcagcggatccactatttttaaacaattagattagattcatttaaaatacatctcatataattatatatatatatatatatatatatatagagagagagagagacgcacacacacgtactttctgtctatactactcacggcaaaaaagggaaaaa

SEQ ID NO: 100442 - DNA, 565 bp, Oryza sativa
gctgtgcgtaaagtactttagataataaagtactccctccgtccaaaaaaagacaaaccctagtttccgtgcccaacgtttaaccgtccgttttatttgaaaaaattatgaaaaaaattaaaaagacaagtcacgtataaaatattaatcatgttttatcatctaacaacaataaaaatacgaattataaaaaaatttcatataagacggacagtcaaagttggatacgaaaatccagggtttaccttttttttgggacggagggagtaagtcacaaaaaagtaaataataattccaaatttttttgaataagacgagtagtcaaaccgtgcaagcaaaaactcaaaatcccttatatcataggacggagggagtagttcagtagaggttgtacatacaagtgaacaaacagccaaaccaacaagggaagaccctaggatccccaaatcgttttcaaattaaaatacatcttataacgttttcaaattatgtcgttttcaaatgacacttctggcacgctccacgaaggccgtcagattacgatccgacgaccctcctttcccta

SEQ ID NO: 100443 - DNA, 535 bp, Oryza sativa
ggcaccagactaaacttcacctgttgatcacccttgtctttcattctcataactatataattagctagctgcctagctgtgattaacaataactacagaatgcaatggaatgaaataaaaagcataactttccttatcactgcaggccttaataagttaatatcttctcttactcctccgtccaaaaatatatctatttctggttataaatttataattactcattctatcttaaaatgcaattatttatagctaggaatttagattatctaaaattgtggctaaaaatagctacattttaaaatggggaagaaactattatcctcttgatcatcagctacactttgcagtttgctgacttcttctgtggcagatacaaatgtgccttctagcagttactgcattgtcagaaacccatgcatgcaaggaaacaaacaattgtgtggtgagctcagttaattgctacagtactctatcaccaatacaaagatcaaattggtgacataagactctgggccagcatagtcactgcttg

SEQ ID NO: 100444 - DNA, 540 bp, Oryza sativa
cgtaccaacgatacaatttacgctagaattactcaaaagagtatactatgagatgtgcttctatgctcttcaaagaaaaaattgcacaatttttaaagaagatgagaggttcagattagaagtacttcaatagcctaaaccgttttaacaagggcatttttgtctttggagaaaattaccctgtatcaccgcccctttctcccgccgttcttctccacctccggcgccatcactcgaccattttgtcaaaatcaccatggcggcgctacccccgaacaaagttgtcgtaggcgccagtatctactctggtcctctcgatgaagcttcttgcccgtgattatgtcatcgtggttaggactgcactgcagcctgatcccaacactgagcagatccattatcatctctgatttggttgctttaatcaatagcatcacgattaagtaattcagctagttctctcaggtttgatgcagaggctacaaataaaaaaaacagatcggcttataacttttgatgctgtttcaagtgatgaacgatttg

SEQ ID NO: 100445 - DNA, 552 bp, Oryza sativa
tttgggtcgctattacagatgtctgtttgcctaccaatgagacagccactggggggaacttttcatatagcaccctctttcatcagtcccccacctcctgtttgaatacctatccggctcaccatgtctgtcatcaatcccatgttcataatcaagcctcacactgtttcttgagccatcagttggaaagccagtttctctgctagcatgacaggatcgtaagcagtccttggaatgagcttcattatggtttcttgagccaggagatcttctagaatgatattccacaatggcttcatgaaaagcatgatctgactttgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagttaaaaagggagcaagggagatctccctccttaacacaatgttcattgcttatgatactacaaa

SEQ ID NO: 100446 - DNA, 529 bp, Oryza sativa
aattcgagctcggtaccccagatcatgatcgcacgtggttgcatgtgattgacgtggaggataggatagacttcagaagtagtgtaacacatccggcggcatggaggtggccaccacggcgttcaccagccttgttgtcgctgtgttgtccgacgatggccaccacgggtcggacctaagctgtgccaggtgtggagtggttggagaaaaaggatagagagaggagaagggcactgcaagtaggccctacattttttcttatttttcccatcacttacatgtgggccgaacttctattttgtgattgggctaccacgtcaacacatgcggaccaagtcaacacgtcacgtcagtgaaaactgctgatgcgggagtccaattatacatgttttaggccctgtttctttcagcttgggattattataatctagattattgagtcagattagtataagctagattgttataatctgtagtagaataagtggttagttgtttcttttctagattattagagcctagattatta

SEQ ID NO: 100447 - DNA, 533 bp, Oryza sativa
tatttttattgttgttagatgataaaacatgattaatactttatacgtgacttgtctttttaattttttttcatattattttcaaataagacgaacggtcaaacgttggacacggaaacccagggtttgtcttttttttaaggacggaaggagtatatcggaacctttgatccgtacggataaggtttttttttcatttttcatttatttatttatgaaaatatttataaacataatttttatatttttcaaagtattgcagatttaaagattctacacccgagcttcttgatagggggtaatatttgaaattacaaattatttttctaaatatttcaataaaaaaattaataaaagaaaaaaatctactacgttgcgaacccacagcttaggaaaaacgctaaggtcacccaaaaacggcgcgcgtgagacgtaagcaactcccgaaatcggcaaccggctccgccgcggccgatcgattcctccctctcgtataaacacacgagcctccccgccgtcgccggcgccccccc

SEQ ID NO: 100448 - DNA, 604 bp, Oryza sativa
aacaagtaccatgagcatttaagcacaagactcaggattatcacgtataattaaggccttctttagtttctaaaataaaaacttttcacccatcacatcgaatgtttggacacatacatagaatattaaatgtagacaaaaagaaaaaccaattacacggtttgcgtgtaaattgtgaaacgaatcttttaagcctaattgcgccatgatttgaaagcaaataaataaataaaattattatgttgtattacctctgttttttaatagataacaccattgaattttgggtatatacattagattatccatcttattaaaaaaaatcatgtgatcatttaaatcaaatgatctactcactctatcgaaaaaaaggcaaccttccagattcattgtcctaggtgatgtcaaatcaccacctatgttaccctttttaggagagggagtaaaaattaacaacgccatctattaaaaaacagatgtagtattcgagtggaggcaatgtgttatatgcattaccccttaattaataactactccataagattattggtgattatagctccgatatatgagtttttttcttttattcgctgatggatgagtc

SEQ ID NO: 100449 - DNA, 527 bp, Oryza sativa
attgctagacacggcgacgagctgatgtatatatggtcaagagcaagggctgtttagcagggtgtgttctttatttcttcactatttttttttcacgaacgcgcaaaaagattgcacgtcaatatattagaaggaaaagagttcttattacacaatgcaatcagctatataggcttatgccaaggggggaagagagaaaaaaacaaaacaaaaactgcagctaggtttactatggcggctaaacgcaactccgatcagcgggaaaggatagagccacactacttatttcttcactataatctggttgtttacccagagagacatatttgccttttttttcaaaaaaaaatgttttaaaaagttttactcattaaatagggaaaaggaatcaatctacaccgttaggtcgtcatactggaagtataaattagaattgaattgtactctagagttatcaccaccgtaccgtcatgttaaggtgcaaaagagaggcatggaaagtgtttaccgatgtgatgggtgttgcc

SEQ ID NO: 100450 - DNA, 549 bp, Oryza sativa
ttatttatttttccttcaatctctttgactctagtaatattaaacaagtgaacttgcatcagattattcttctttcctccagccaccattctttggaaccttgaccctcgacacccccccaccccccaccaatgttttgaacaaccccaacatctttaaacaaaggaacaaactgaaactactcttgtatttttacttctatcactaacagtattcccacggtctttgaacaatcaagtcaaaaataaagggataaccatcactgccagcctgccatgtcaacatcttctagttcctcctcactagagaaaaagagcctccaaacaaaaaatcatttagcaatttgattggactaacagctactatctccgtcccaagacataaaatgttttaaaattagacatgagtattataaacataggtgaaattaaatatgaaaagattgtgattggtgaggatactaaaaggtaaaagatcgtttacattttgaaacaaattttgaatgctataaattgtaatatttaagcacgaaagtagatttaacaaaca

SEQ ID NO: 100451 - DNA, 523 bp, Oryza sativa
attgttaatccgagcaaattcctttttttaataataaaaatggattacatctccggcttctgtcataagacacacagccataaatttaatagtaataaaaaggtaagataaaagtaaatcaaaatgagaaataaggtgatgggacaagtccccaagcaaattcctttttacaaagttattcccgactagctagctagcctagctgaagccagacatctgttgcagcaatcatccaagttgccataatcttgaagctcgcctctacctgtacagtgttagaaaatgtattttttttttaaaaaaactaaggcagcgttcgaaagggtgagagagtgagtttgtttgtttcgttttccgcgcgaacgtttcccaaactactaaatggtgcgttttttgtaaaattttctgtaggaaagttgctttaaaaaatcgtattaatccatttttaaaatttaaaatagttaatactcaattaatcataagctaatagctcacctcgttttgcgtatcttcccaatcaact

SEQ ID NO: 100452 - DNA, 554 bp, Oryza sativa
aacagagtaggggaacatttaccttgtgaagaggtgttgtgctaattttttcacaatttttttctattttcactttatgcaactgtacaataagaaatgccatatcccaatttttttagcacattctaggcccaacagacagtgcatgtacatggatatgttattgttagtgaaatatagggaaaaggtatgataacccctcttagaaaaatgcgataacatcaaatgacaaacctctagccagatgcgaaaattttaagtatagctgaagcaaataagggaatatctgcaacctatccttcattatcctgaagcatcccagatatcttatgcaaatagctacattttgatggaatctagctgaggaaaaggaaatagtcatattgataactatatatctttatttttctgttcaaaagtggcatccctgtgtgaaactgaaataagatgttctatctatatgacttctattaatggttagattagattcttagcctatgcaaagaatctatcaagtacaaatctactatctactactactacttaaaaatact

SEQ ID NO: 100453 - DNA, 613 bp, Oryza sativa
ctaaaaaggtgtttagcatatatatttcaatagaaatttagtggggttgtagatttgccatcgatgtgcctagtgtgtgtgagtgtttcatgtaaacacaatactataggaaatttttaaacaaaagaagcagtactaaaatactatagggttacagcgatgttttgttttgggatttgaattcttggtagatatagtcaaggctactattgcatatagcagtgttggttaatgggtgctgtaaaaaaattgacattgcaaataagcatttcctggagagcaagtaattgaggtgagaattgtgtgtgaaactcgggcgctttctaaatagatgttgaaaacttgcacgcaaaaggagaaacgtgattggcatataatcagtttagtaagaaatgatcaataaatttatttggatttttcaaaacaacttctatataaaaattagaagaaaaaaacacacactgtttagcagctttaaaatcgtgctaatgaaaatcgagaaagtagccaagccgaatcctggtttagaacatggcgtaattaattagtggttcgtgtgctgctgatggaggtagctaaaccgaggctggaaagggaaagagagaacaaataa

SEQ ID NO: 100454 - DNA, 1665 bp, Oryza sativa
ttgcctgcctgttttcttcttcttgaagagaactgcctccatcgcgcgcgggcgatggcggccaggaacaaggaggaagtcttcttcgatcccgtgtgagggtagtgaggtcctcaagaaggaggcctctctgggtgtcgaggaatgtcccggggtccatggagtgctggttggaggagtctgggaagaaggtggtcaagtacaagatgcctaatgttgttatcaaacaaatgatgagctacccctacacctacccggagtacgcctacaccgaggaggagctggcccaacgttctgcctcaaactcagaaagttcatcgatgaaaagatgaacgcctacgagcagaacctcatcgaccagtacctcaaacatggctatgcgttcgacgaggagcacaagtagcaacctgtctgtgttgtgctgcaagatccatgcatcgtgtccctgtgtctgtgtgtgatccacctatcctaattccttcctaagtgtaagtgtctgctcaccaatgactatattctagatgatgggcctgcacacaaattttgtaatccattgtttacatggtttaataacgtgcaataatcagaaatgtgtgctaaaccaaaatcatatagatacaaaaccctgagtatcgatgataaagcatatggtgtcggttttgaaccctccatctacatgccagccagtgtccctgaccatttgaccaaacacaagtaaaatgacaaccggtcagcaaaacattatattttccatagatgccttctcaaatagcttgcaaaagagtcagtttctccaaattaattgctagactgattgacttcatttttcttttcataaggagcaattgtaaagtccatcttgaagcatcccagatatcctatgctaatacctacactccccctgaaaggcatgcatgaatatggtaactctgagatcacacaattataacttaatatttctgcatgattatctctaagtctcttagcgtgattagaagatctttacttgttccttggaaacctcatgaacaggtgtgcaacattctgtttaatttgaatcaggcaatgtgctctggaactaaacactcggtaatgaacactgaaatgcagccaagagctaactaatcaacacaatacgcacaacacgtctatgataatctgaaacaacagcataaattcacaagaaattccttcgagtgacgtatatttataacctgtcacctaacatcttccctaaaaaaatgttatatcttccctgaaaaaataatccagtttccacaccaaaaactttcaaaaaggtttagacgaatttcccctctattgattttgcatatcaatttagacactgtacttatttgaacccaaccaaacaactcccacgggtcctcgagcagtacaactatctaaaaacttcaactgtgtatattattatgccatggtatattgaatggaaattaaaaataatgtgaaaaatcataatcccttcatgttgaaatgcatttttgaccctaagatataaatgctgggataattcaatatggttagaggtaaaggcaagcttcacatggtgtggcaagaaagctgggttgtaagccatggaatctagtttcagcttccaagccacgtgtattgaacacgttaattgactgcaaaaccacgcagatt

SEQ ID NO: 100455 - DNA, 522 bp, Oryza sativa
cctattgggccactgctctttattttttttcacttttttttctttctattaaagatcttttttttttcttgaggacagatgatgctttggttgtgtggaaagaaaaggatcgatcgatttggagatcgtttttgctactgtttgagtaaatttgtccaaagtcaacggtagatccgtttttttcaatacgtcatgcctgatgcgatattgctaacggatcctctctgcaagggatatttcagtgtgtttgaacgagaccagcacccgtaggccgtagcccgcgactccacgacgtggctttccaaaaatcaaagtgaaatgacttctcaagattgccgtcttgaattcatcggcatattggcaattggcatagcatttcgttcttttttggagaccacgagcacggacaactcgaggtttacgtttggaatgtctcgccgcaacgagatgtgctatttctgttcttgtctaaaatatataggtacctaatatcttggtgctacttctgtctaaaatatatag

SEQ ID NO: 100456 - DNA, 525 bp, Oryza sativa
agatatgaataaccttgtaaaactgcggcattttgttgtccaagatgataaactctactctgacattgctaatgtgggtaagataaagtgtttacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggctgggtcctaacttatctatcaaaggtttgcaatcactttgtataaacggtgtatgttgggacaagtttccacctctaggggggttgtggttagttaacaagcatggtgaaaaattcctggcttgtgcaag

SEQ ID NO: 100457 - DNA, 506 bp, Oryza sativa
acaattcatcattgcttttatctacattactagtagacgctacagcactactataaagagtagcaaatctatccacttctgaaattttaatctggttaatggactcctttatttctaaatcattctttcctagagaaacccctaatttagaaaaatttgcagcaagagtcttatctggaattgaagcaacagaatttgtggtattaaacttgttacctgttagcgtctcgaggttatgaacctttttaagcagctctgcccggtttgccaccggcgcatctgcatttgccatcgccttctgtctttcactttgcctagttggaatagggtccactgggcgacgaggtcgccttcttgtcggggatcgagctccaactgcctgtgctgcatcggtgggctttagatgtggcagcactggaggcactaaggtggtcttcattggttgctagtgctgccgtcaaattgttagtcgatgttactcttccatcgcctgcaagctggctatt

SEQ ID NO: 100458 - DNA, 654 bp, Oryza sativa
  unsure (1)..(654): unsure at all n locations
aatttgctcaaagcttctcggaattacgaacggggcagaaaggcgaattactttcttttgaaacttcttgttagaagcccttgttttctgctgaacattttgtccctccatttctccctctcaagaggatcttgagacatagcagtcctaccgccaatgatgggaaaaactttcaaggaacttgntaatccttttttattgggggaatgtttttgtcactgtggtaggccccttcctctcgagctccagaagtctgaatcttcgtcagacaatgaagccttatttgcaagaatttgcctcctcgattggatgccatcttggataaatgaaatagcagaatgcttattatcatctaagtcacgttgtgattcaatactgtcttggttgttcaatgattttggtcttttccacccacatttcaaacagaatgcattcctcttgaagttcaaataattacacctgtcatgaatcaatcgtatagttatcttggaaaattttttatagtaagcagaagataatcatgacactgaaagaccagacaaagccactaacatcattttgttgccaagttctcatattgatactaactattaagagaatgcaaatatgcagtgatatgtaacaaaaatgccactcacgagacacactcccatt

SEQ ID NO: 100459 - DNA, 608 bp, Oryza sativa
attattgtaaaaaacactaatgtgcacttactgaactgaaagggccccgtatcactgatgtagaaccatcaaaggttaagctagctaagccaatcttggataagtacttgcattagacttattattcatatttcaatggtagaatctctaaaaaaaaggcaagggaaccctttttaaagatttataccccctataaagtatttaaattcaataaagatcgtattgacggctcacaatttataaaaatatattgatatggttaaacatgtgtgcagtgggatggtctttaaaacaaaattgagtagtcaatgcgtatttaataaaataacttataatgtcaaatgttaaggtttaagtgacttatggatgggttttgtaaatatctctttcgcttgacgagttcggcgtctactgggtgtgacgtgcacaaaactggctttacaggtggacagaacattgtatttttccccttgtaagcacaccgccacagaccaatgccatggtcgatgttttgcctttgacgaacctttatcctagaaaaatataccatcggcggtaccccgatccattttttttctgaatgccccaaagtgtctcacataacgaac

SEQ ID NO: 100460 - DNA, 615 bp, Oryza sativa
  unsure (1)..(615): unsure at all n locations
ggccgactctagaggatccccgatcttcacccaaaggagaaatactcatttaaatttctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgccccgtaaagctgttccgttaggccaaggcccaaattccaattaacccaaggccgggaaaaaacccaattttttttttccccccccctgaaaaaaaaaaaaatgaatgcaaaaggcgaagctgtcgtccattagagcaacagaactacctgtcaactgtgtcttatatgagttacngatgccaactggcaataattgtacccacttagcaccatcggcatccatccgatgatatatgnagnactaacaattggcgccggccagccttgcctcagaggaggacaaaaggcacaatgaacaagttgatgaatatttattggtacgagacaagtttcagactgttctggaatcggctgaatgcttcagatttcatttcgaattgaaaaaaaatatggtgtgcttgggtgagaggga

SEQ ID NO: 100461 - DNA, 1203 bp, Oryza sativa
ttgcccgttagatgcaccagcacctttgtgcgggacccacctgcagtctccggaaactacagaagtacatatttactcaaagcatccacatgctgatcaggtcaaagcatccgtgcagaggtaacacaaaagcatgtaggcgcatatagctaacacttgattatagaagcatcaaaatgcagaaatctaatacctaattactgatcgcttcatgagacttcaggtgggtcccaaacatcaggtgtcaatgcgtgtaatgggtaaggctaaaactgtagttttgtgataacggagacactcaatctgtagttttataagacaagttcttaaatttgtagtactgtgatagactagcataatacctgtgagttgcaacagatatcttttaagaaaaatagctcatcgtatatattctaaagcccacaataattgttcttattgcctaatattatcatcatgttacttttgcagtcactttctaggtgtctattgagctagagttctcagggtctgtggccttgggggttgggaaataggcaaagtctccctgtttatgggtcccacatggttattgggtacttgggtggtgattcaccaccactaccactaccatcttttacattagcacagatatagattgtgcaaagtacctgttgtcttgtgaaatttaatcattttcttttatggcagcctccttatgcacattatcctactgacatgtgggcccagacccaccttgtgagttgtgagtgatgcaacaaatgatttgcaaatttaagtttgcatttatgtagttatatttgtgagtgatacacaaatgatttgcaaatttaagcatgcatttatgtaattatattttttagtttatatagaagtaacacttggggtaatatggaaagaacaagataagttatacattgggtctggaactctaaataacaataagcaactttttattgagcaggttgaggatggaattgtatttctcacattaatattaaatgttaactactaatctttttgtgataaataggtttattgccaagtactgacatggtgatggtagtttggcactgctgcaatggactccagtgtaaaggaattggtgggatgatatctgctcattccaccactcttctgttatcaaaagcatacccataagtccagagatgctgtgattcagaaggaaggcatgggaggatg

SEQ ID NO: 100462 - DNA, 595 bp, Oryza sativa
tgtgctctgaaaattccactaaaatttatttacacattttaggcttttaggaaatataaaaaaatcctcccagccttatttgacttttaactttacacattttaatttttgatagatttgactaggattttaattattctagacataatttataatttaaaggatatattttagggtacttctgggacgtgacatcacttcactggcgtcatccgcgagcaaaaccgtcatcgtcgaccaatagttggacagggccggcgccttgttcttcttccccacgccgccatcgccatgcccttcttcccctcctcctctgcgaaccgacatccgccgcctaaaaatagccggcaaagccccttcttttcccccacaactgagcttcgagctcttcttctctctctctcctccccatgccggccatcggctgatctccctcgttggagcattgccgaccaagccctcgcgccaataccttcgcctcgacgaggcaaacccattccctaaccttccccttcctttctccttccgatattagccaccaccgttacctcccataccggccggagctaagtccttgccatcgccgttccggcct

SEQ ID NO: 100463 - DNA, 705 bp, Oryza sativa
attcctgcagccctactattgtctacatttatatatatattaaaataaatctagatattttctagcattatccacattcatatatatgttaatgaatcatatatatctgcctagattcattaacatctatataaatatgagcaatgctagaaagtcttgtaacctaaaacggaggtagtacaagatatagttagaaaggtatacttcaataaacccttctcttttctctacctgcgtaagcaactagccaactacacgtaaaacacaatgtatcaagagaaaactcaaggaaaatcaatagaaataatttcaattctaggaaaaatctaataaaaaataacaacaaactacccctatagccagaaaattcctacatattccattgcccctaaaaacaaacaatcaagcgtaggaaaaagcacgcaaagtccttcaatatgactagctaactcaaatcaatgagcaaaactagcctgagaaatcaccttaaaaaatgcttaaaaaccacacggaaaactaataaaaagctcgccaatccgatttgccaccacctcgaaaaagcctcaagaatggcccctgcgatttctccacctcaagttgagttggttttccacaacagcacaagtcgctgttgaccacacggaccgatgaccacatggtgctcaccgctgatgagccatgatggtgagaggggggaaggggggg

SEQ ID NO: 100464 - DNA, 671 bp, Oryza sativa
acagtcgccttgatattactatttgataggtggtaaaatttggataggatagatatgctatacatgttattataagacccttcaaatgtaaaaattaaaatcatatataaaagtaaatttaaatgttaatacaatgaaattattttatcaaataaaacttaatttgtaataaaatattattgattaaatatttaaaaagttaaattttagacacttgttaagagaatatttgtaagttgtaacaactgagatgggttagaatatatccccatatctaattaaaaaaatgtgacacaatgaatcgaaaataatctaacacctattcaacttctcctcataggagctacaaaacacctacaggaagctggggtggggggcacacgccacagcatgccttagtgggtccacactagggatgacaatttcccccgcggggccgagtcccctgcggggacccgcccctacgggggtaggacgggggcggaggagattttcgacccacgggtgcgtcgggtatggagccccgcatttgggcggggaggggacgggggactaatttcacccgcgggtgacccgtggggcccgggggtacatataaaccttaaagtataggtcaaagaaagccaaaaaacccatataatagctaatgtaaacttacagctaattccttg

SEQ ID NO: 100465 - DNA, 699 bp, Oryza sativa
gagtaaagcaatgtttcattgtcactaaagttaatactatgtgaataaatgttttggattttggtttgcaatttctctctttctaaatatacatattgtatccaggacttgcttttgcgaattcatgaaattttggacaatgtttggatcaagtatgtaagaacaatatttttttcctagggtagagatcgaggttgttgaacaagtccaacaagctaacacacgagacacggggctctttacttctcaaagggcaccatggtctagagcatcatgactcattgcaagggagacaaaataagtttgtttttcaccgaactcttgcatactaatacaaagcaaaaagactagaataccctctactttatcagtcccctacttacctaattacaattaatgcatttgtcccctactttcataaaatccaatgcaatgatgactcaaagatgaacttattttgggacatacaagagggggcaaagataattatatttcagaacagagggactagaagcttgcgacactatagaaaaacatgaactgcctctccatcgatatggatataaggaaaagggaagccaattatttgacctcatcaccttgaactcttgtaggaggataatggcaccagtgaaagacaccatctaccaatactgcaaggatgactctcagacggaggggagtgggtgtggaaaggga

SEQ ID NO: 100466 - DNA, 618 bp, Oryza sativa
tagaaaaacttttgaccatggatttatcagaaaacatacttttcatgacagcagtactaatgctgtgtaaaagcacactgtaaatctattggtataatatttatacaactaacaatgttcaagctatgcgttggagattattgagtcaacaacacgatcaagtcttgaaaacagccactctttaacttccatgagtcctacaataatgtatggagcatgcgaccttatggactgaacgaaccaagtatacaatatatgttttatgttgtctgcatagaaacttttagaatatttagaggattcaattttctaatttttttttctatagacccctttagttcatatagaaattgtaaatattccatagaattgcatttctacggactaattccacaggattacattccaaaaaaaaagcaagagataagaccttttgattttttttagaaaaaaaattatcctgtggtgtagttaatttcttctcttctcatttccggtgtttttggttactatagacttttttaaaaaatacaactttattcttgtgtgttttttctatcctacctttcaagggcgataattttgcaataggcacattataatttcttagaaagctcc

SEQ ID NO: 100467 - DNA, 729 bp, Oryza sativa
atcgcggcatctacccaaatagtggctaaccctatagaggagagagacagacacacggcatcgcgagaccgcgagcggtggcagagcatcacgctccacccaccgccagcgccccgcgccacccctggtccgccgtcctcggctcctcgcgacctcgcccccaccatcttcgctgtctcgtaccgccgccatctcgcggcgctgtccagccgtttcgcggcgccgtctcgcggcggcagcgccgtcccgccgtttcgccgccgctaccaccactgacgacgacgccacagccacaccgacgagccgacgacgcctcgcctctgcgactcgacagcagccagcagcccagcggcagcagccaacagcccagcggcagcagccagcagcccagcgacgagccgacgagcctaaaccattgatttgatttcttttgtgctgcagatttatgatggaatcatcaaatgcaagtagctattttgtgattgaactaagtactgtactaatggactgatgtgtgttgctgttttgtgatgactaatgattgatgaactatgtactgatgatggagtgatagctcatagcagattagcagtatagcactgaataatagtgtatactgtataccttataccatggtcttttgctgtattttttttagaatatttgttatgcaaattatatgaagttatagaagaatagtattttgctgttgaaacgatttcatataat

SEQ ID NO: 100468 - DNA, 1266 bp, Oryza sativa
aagagccaccctgacctcatgggagagttgtgctatggctagattattaaggatccctagtggaaggaccccacaacagcacccgactcggcatgaggctactcatgatgagtaggtaaggacccccgcccagtgttctgcttgaagagccctaggatctagaatcctagtcggcctgagcccatgaaacacgtggtaccctgacccatcccatggcaggcgagccatgaccggtcgccattccaccgtacatgttgcctaacctccctacggcgtcatatgtcttgaaatctagaataggtccgatgcactagggatgcctcgatggacctagattcgatcaccaaagctactagagcaatggctcgtgtgcctcatcattgaacgaaagacttcaatcgaagttctagttgaaggttgtgctggaggacgtggccacctcgccacacactaaaccatatgtaccttggtaaccgtaggtgcaaacaggcagcaatgctaaagcagtgcaggccccgacggccggagggatgaccaccccctggaggggtgaggatggtgaagcctacgatgtgttaaagggtactggctcaagacacaagttaaggtcgtggcataagcaaagccactaatgtacatacaacgtgctagccagaggggcagaactgtctttttctcatggtttccccctccattaagcccaggaatgatgaaataatgactgtggtgtccactagtaaatcacgtgtcttttaggagtcctagagccatgtcacgccttttaggagttcgttaggaaataccagaaaatttgaccgtcctctagcaaatttttcctatatattatgtcgaattgcagaaggtaagaaaaaggatagtctggaggccaaacagtaggcaaggctaagccagagagaaggctacatgaagagaaataaaagaaacagggaacacagaaaaaaaaaagagagcaaatttctctaaactacatgtactttgacaaaactatcacaaaactatatatttaaggtgtatcacaaaactatagatttaggaccaactttatcaaagaactacagatttaaggtggaagatcaccaaactacacatttagtaataatattatcacaaaagtacatgttttgcaacatgttaagtacaaaactacaacatttatcactctaacatagcagtagtggtagggatttaagttgtaaaatatatagttttgtgataactctagtattaaatctttagttttgtgat

SEQ ID NO: 100469 - DNA, 555 bp, Oryza sativa
tggtaccccaagttttgaagttcttggaataaccggaaacagaggtagccttttgattctttcacagacaccactggtagatgtgattttccaagtatgaaatcgaagactcaatgatgacttacttgttatatgatctttgaacatgattctttcaagtatgttctttatatgttcagctacctgtagttgctgcatctaatttaatagagaaaatctcctgtgtacgtttgaaagttcacctaatcccttctgtatccctgaattttgctcaatcccttacatacccctgaattttagtttggatcccttccatgccctttccgctagttgaccattagttgactattaaattcttatgaaaaagtccattttgccctttggtataaagaagcatataaattaatagagtatattgttgaagcatagaaatttgttatatgagactactatgtttatgagatagttatgcaccatattatttgcgataaatatacttttagatatgatataaaaaattaatatttatttattagtaattaaaagattttttag

SEQ ID NO: 100470 - DNA, 957 bp, Oryza sativa
cttcgagtttgacctaacacgacaaccgatgttgacaccagtgaggcagtgacctttcacagtcaccaggactctggtagcataatctggtattatcctttttcgatgatgatatggttcaaattctggtatccatatttcgctttttggagtgcttaaacttttttataaaatatttgtggcggttttctgaacggtgtttcaaagtggtcctaaggttgtattcttccctctcttttcctaactcacctccctcatttttttttgatatactttccaaagtactgaacggtgtgtttttataaaagttttttttatagaaaagttgctttaaaatatcatattaattttttaaagtttattttagttaacactcaattaatcatgcgctaatgcatgctttgttttatgtgcaggagagaagggttcccaatccttactcctaaacacagcctaaatagcatcttgagacagagagggcaagactaatctcttttttttttaaaccttggagccagccagtgaaagtttttactcttgtgtttgatatttcctcattaagtatccctgagagaggcaaatcattagctgtcactagtggagatttctacatcacaaagtggtgatcagaggttgcaacagtgacaatgactgatgtttccctatcatctttctcctctgagaattgaagggcagatgtgaaggggaaaagaaagaatgtcatttctcttctttcaaatgcttagttatgtcttcccattttttttccttttttttttgagagaacatgtactacctcattgctcatccatttcatcactaacccaaatggacaaataaagcttgcttttggtgtaccaactgccaaaaaagatacatacttttaatatatagagttataacagttactagtagatttgtgatgtcagtaactaatggttcgttgtccatttctac

SEQ ID NO: 100471 - DNA, 570 bp, Oryza sativa
ttgatttgaagaaatacctcaagaacgcgaagaacgagtgaagaacgcggtgaagatcaacgatgtaagtgcccacaaggtccccaaacgtgctcccacgaggatgaagtggaggagagcgtcggagagtcggcggagaggaggtggtcgccggggaggagtggatgggggagaggaacccgtggggaaaaggatagcaaagagagagaagaagagtccatgggttggaggagagttttatacccccgagaattttcggaagtttccgaaaattttcggatttacagaaccactgagcacgcttctggatattttcggaagttccgaattttttttcggaagtttccgaaaatatacagaaacacagggattgtttgtactaaggcagtaaattttcccctgcgagattatttacagcacagtgattgcgtgtgttcttttattttctggtttcctgctttacttgaaaaccctataaaccccattgaaattgataggttgtaatttttctgtgtgtcgcaggttttattttttgacatagttcagctaaaatttcggattcttgcatga

SEQ ID NO: 100472 - DNA, 663 bp, Oryza sativa
ggatcccctttggcatgtgggtgttacaggatttgttctagtaatttggcacatgtaataaatttggcacatgtgcgtggatatagctaaaactgctgatttagatgacaaatcaagatgtattatggtaaaccttttttaacatgctccaaaataaatacatcaaatacaaaaatgagagagagaaaaaaatgatgatcgaagtggaacggaggaagtacggtggtaattaagctagttacaagctccagcatacgctgcaagatccctagaacacactactagaaaaccacaaattggggacatcctctatctacaaggcctttcctatccttcgtaaattcttaaattaaaaatcaacacctataacgtgccaatttttctaaaaaccaacacgtataatacaagtgcctgattttctttaataaaagcagtacaaataaagatgtcatatgtgctaggttttttggcacattattggagcagcagcaccagcggaaaaaaaatcacatagacatacgccatatctcctcgtgacctcgtccattcctttcttatatccgtctctctcaaaccctctaagcctccacctaagataatcttcatcttttctctcattgtctctcactctttactcctctccacctctcagcatcctagcct

SEQ ID NO: 100473 - DNA, 695 bp, Oryza sativa
aggtagactttctctgtgagcttcctttactaggccggattgaaggagggaccaaaaatggactttggaggagggatcaggccagccgaaaggaagggagaatgagccgaggactaaaggtgaacttttccagtttcagcctgaaaaggaaaaagggattttaattacttttccaattaaattaatcactgaaatgatctttgaattgttaaaaatacttccaatgctcaaataatttcaagaaaaatcctgaaaatacttggacacccaaagtacttaacaagattataataagaccatttaatgattaatttaatatgtggataattactgaaatgttctttatattattaaaattaggaattgagctccgaaaaatctgagaaaatttcagggagtataattaatcatggagaattaaataaaaattaaatcccgccatgatttatatttagaaaattttatttcctatatttaacttcacttgtaaattaatgaacatttaatataaattctaataataatttattaaataatttataaatcctaaaacgaaaatcaggatgtgacatagcagctagtgtgggagggagaatattaaaggtgccggtttttggtcgagaaccgacacctttgtcttgtcataccaagaaccggtacccttgtgtagggccccccgtcggggctgcaggaat

SEQ ID NO: 100474 - DNA, 530 bp, Oryza sativa
ttagtcatttgaccctattacatgtgggacccacccgtcagttctctcttctgtcttcttcttctgacgtcgcctcctttattcctccgcgttccctccggcgccagctgccgtggcgccgcccctccctcccttcttcgcgcgccaacctccgcctccctccctgcttcgcgcgccaacctccacctccctccccgctgcacacatcgccgccgccgcaactcactggcaggagagagacatggagagacatgtggatagggttaaagatgggtatggtttcctcaagggtattttgggcattatgaattttaattatatttctttttttttaaatcaaatcttagcgatgtagtgaaacaggtcagacggaaggttcgtttttgaaaattgacagttagacttttccctgacttttagcatcagttcctcgcgagtcgcgagttcagcgcattttttgggggaaaaaaatgtactccaacaacacacccccttcaattctcaatagtcaatttcatcacattaatccc

SEQ ID NO: 100475 - DNA, 648 bp, Oryza sativa
tgatatgatcttgataagttgcgggtaaagggaggcatacctttttatttttatattttagggagttaaatataagccatctattggaaggaagtatatacctatacaagttatccccacctactaatctcctgcactgtggttgctccacgtcatcaagttgatcacacccattcgatcataagagacatcttgaccatactctcacaatggccaattacagtactactaggggcagtagaataaaaaccacttcaaacaaaacgccaggcaaaaaaaaaaaaacaccaattctcaagagtggattttaaactctagagggaacatgtatatcactcgaataattatgaaaaaatttcaaaacaattaagaaattgtattaacatgtagtataccactccaaaagcatgcaagttataatttaacttttataagtaaaacacatataaaagagtagcaaattaactacaactagttaacatatattcacattaaatttatttttttcgttgcaacatataaaaaattaaatttaactttacatgtttatgaagttataattattttcataactaagtgtcatacaaataacgagatgacgtctcgagttcttcctgcagccaggttttgaaatttcggttcgaaatt

SEQ ID NO: 100476 - DNA, 682 bp, Oryza sativa
agctctgtttgtgcttagcaaaaattattgttaattaacaattactgtagaagtcagtataatacctagagtgtttaagaatagaaacataaacagtaattttgcttgccagggcacgccaacgctgtctccagtttcttacttgttgcaaagcacaatggacagtgcattttaagttaaattgaaaattttcaataacaaaaataatgtcaacaaaaaagatagtagcatggcataccgcacacctctaattctttaatctgtcacaccatacaattgccagtgtattttcaagttaaattggaatttttcaacaataaaaaatgatgtcaacaaagatgtattacattgcgttctctgcggcgagatccaattaaccaaataatgcgatccagaatggagagcttgtctacaaattgctgataatacctcccagtagatggatggtataaccctgcaacaagttgtaaggcaatatcaccaactagcgtttcataaaaaagaagtcatcaagtggagcatccctttcttcaatattgaaattgtgtacattgctcaaatgtgtttatctgctgtagatttctagtcatgtacatcttcaacattctagtcattcacaaaagagaacatatgagggctaagtttatgtgcttcccaaacaagtgaactgggctgcaggaat

SEQ ID NO: 100477 - DNA, 604 bp, Oryza sativa
gctgctcaaccgatattaagtctaaaagttttaactcattgattccagcaaagaagtaatcatgaaattgcttcttaagatcggcccatcctcggatagaatttgatggtaatgatgaaaaccatgtgaaagccaatccagtcaaagatgatggaaaaaaaatctaactttcagagcctcctcaaccgatgcttcaccacattgagctaagaatcggctgatgtgttccattgtagatatatcatcttgccctaaaaacttggagaagtctggaaccttgtatcggtgtggcaataggaccccactaaaacaaaacacccccaaagaagacatttttataaagaatagagacgttttgtttcatctctagtagatagttgaggcatttttataaagcgttataggaacacctcccccaggaccgtctcaaaaatatagagacattttacaaaacacctctacaaaatctgagacgttcactggacacgcttgaagcacgtctccataaacacatatagtcgttttagctgtttctctataaataaataatcatttttagaacaaacatttgcgccataactgaattaacgtggagacgctctta

SEQ ID NO: 100478 - DNA, 1025 bp, Oryza sativa
tagaaatcaggagtccgaaagcctttggaagagttcgggtatgactctactagctcttctcttctcttttgtacgctttgtactttcattagaatactcttctatatacatttatggtattgaaatactttctgagtatatgaatgcctactttacattatgttaatgttatactgaatatacggcttttgtgcgggtataatatttacatatgcaattactctatgtcatgacgatgatattagagtactatctggtagtttagatgtggtgtctagattgcgggatatcattatttggggttatatgctgcggatgagaggtgggccgcttatagtgacagctcagtacgggtattcctccgcgcctgtatataatcctaagttaattccctggggagggtattcctccgtatttagccccggttgtatggtcatgacgggctgtcgtaaggaactcggcagtcaggggtggcttctcgaagtaccaggagggcatcggatagagggtattagctagtatatcaaataactagaatgtatgtatactatgtatactagaagtataggaatatatttcctttactaatttctttccacttagcttagataatatattatatgagtagctactgcttgtgtgtcactctacccttggattatcttaactcctgcttaggctatgattatcacaagtaacatataaattattaatcaagttctctctacatgatcttcccacaggataaaattaatacgatacccttggaatactctcgggtgaaatgttacaatggtatatccgtgcgcttgcggatgaactctgtaaccataatataccagaagtatttctgtggcattgctgagaattatatttctgtaatgtcgttaagaaataccaacaattgtaaaatagcaacgctctgtatacaataaaaaaatgtagttaaaattaaaccatccagcacggtgaaaaaaaaaaaacagaattgctaaacttcagtcgacagaaaaaccacctccaag

SEQ ID NO: 100479 - DNA, 706 bp, Oryza sativa
ttaacagttctaccttttttgtaagaataatatgactaattattatacttgttgtcacatttgccatttgaacttttgttaaacatatcaaatgcctaggaatgcatctcagtatatcaaattaggtacatatacatgtattgatatgatttttactcaatgacaactgtccagacattatgtttcttaataagtaaataagaatctggtaccaatttcattaatttacttggcaaattatgtagtagcttacagtaactgtttgtcacaacatcttcatcagcactgtaaatttttctatgtaaaatccatctaatggagcaacttttttgattgattatcgcaaaatgttaagagccatcatcagaacatatgcagtataatatccctatttaaatagattcttgtgtcaattttgacagtttacctttgaatcaagctgtagcgttgatgtgctgtataatcgcacatcactgaaaacgtggtagacattaacagccgctggttgtggagaggagcaagaggaaggggtcgtcgttgccgtggctgtcggttgaaatgctgtgcagtgaccagatttagttctccagacctctgaatggcgggatccagaggtgcacgccgacggggatgacgtcggggggtgcacgagaaggatagcttgttttaccctaaccatccatttggggggagggggggggatagg

SEQ ID NO: 100480 - DNA, 571 bp, Oryza sativa
ttagtttttttctatatttaatacttcacacatgtgtcaaacattcgatgtgacagagtgaaaaatttttgtttgggaactaaacatggcccaagttaaagacatgaatttcacccgacattgaatttcactgatcactgctttctgttcccgacatggcctactttatcaatcacaagcagccacccttattgcgagtaaagaatagtagtgactgttttgttttacaaaatcaaggtgtcaaattggcattatcaatgaatggtacctgacctaatgttttttcctgggtttcggatctgtgatgtgaagaaagctggatgtgtagctccggaattcaggtattgctttttgttcaggggtgtaggaatgtttagaaaacaaaaatctaaatgcactcgcacatacttcatacaggagttgataattgattagctaagcaaatcatgtggggattctgaagcacagattgaaaaagagcacacaaaaagtccatttgggaggttctgaagcacagattaaatctataacatgcggggatgaagcaatcaagaggatgaggatggaagaa

SEQ ID NO: 100481 - DNA, 578 bp, Oryza sativa
ttataccaatcccgcactaaagatcgctatcttagtcccgggtgaaataaccgggagtaaagatcgatctttagtcccggttggggtcaccagccgggactaaagatacagctgacctgttttgttttgcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtgcacatgcatatagaaacatatgtagtcatatattaattacaatccattatatgtcctagctagctacgatttctacgtattagtactcgtctgctagctcagaagctaatgaccggtgaattgtgttttcgtcgtagtagaattcacccttgggatcaaggattttttctttgatgattcccatgagttgttcttgaaccgccgcgataaattccttgtgtgtggtcaggttatcct

SEQ ID NO: 100482 - DNA, 664 bp, Oryza sativa
gcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatcct

SEQ ID NO: 100483 - DNA, 743 bp, Oryza sativa
tatgcattgatttaatttgatttgtgcatgtggtgaattcctctatgcaatcgaagggactaaatcagattcatacgtacattgattatcattgtttatgacgcagtgaagtcctcattatcaatcaagtagaggtcctcattatgactaacaagtggtatcttcttgcctttaatttctttcaaaaaaaaaaaagaaaaagacaaacaagtggtatgcgcactagatacaatgaccatattccctccggttccattttaattgacgttttggacaatgaaaattgtgatctatctaatggcactattaattagcctaaataggatcttttatttggtcttttgtttaggttttcattgtttgtgcctagttgcggttgcggattttcgtcgatcagggatttctcgaagattcgtgaagatcaagaccctgagcaaggcaagccacctttgaacatcttgagcctataattgaacttaattatattacttgcaaaatattatgcattgataggattgcacataatatgtttgccccgtctgcgaggcatattagtgggcatacctaacttgttgcatttgatccttccgttgttaaattgttatgtcatgtttccttgtaaccacctggtcgcgcctcagtattcttgcactcggtgcgagtatcgacggtcgccgtcaaacttaaaaatggtaaacatcttgggtaaaacttggttacaaaacgatgggaaaacagacgcc

SEQ ID NO: 100484 - DNA, 722 bp, Oryza sativa
taaatgatttcttttatcaataaccaatctactccatcggttagttatcaaatctaatacaatcaattagcgattatctttattatttttaatcttatattgcctcggttatgtccaacctatcaagattatgattgataaggaaatattcctaacgattgtcttttatttgatagcgacttatgatgattcattaaattgtttattgaagttattgacagttatttcaatgcatcggctttatcaagattgactttactaaagacaaatcattggaaattataatgtcaagttttggctaatatattttttcttatgtttattaatattccatcggttatagccgttgatccgaaatttcatcgtctacaactaggcagaggtactatattggccctatagctaatcgactccatgatctatcttttatttctatcttgttattagttgcaggatcaaactaattgcattgctctaaacccaattttaaaacatgcactagagctaaacaaatctcttaggccttcgtgtgtttatgcgaaattcgcctcaacacctgttcaagtctcaatgggaaaccacccaagccaatagttcacctttgcattatttgatagataatcaaaaatttttatggatctatacggctatgattgagttgccatcttgtcaacatactttggtagatggttggtctatttgggtaatcatttatgttaaag

SEQ ID NO: 100485 - DNA, 673 bp, Oryza sativa
ccctctgttccatatatagatggtgtctttttcctatgaaagttaagttttttacgcaaaacaacgtggtattagcgtacaattgattgagttttaattactaaaaatttgaaaaatagattaatatcatattttagagtaattttcatatagaaagtttttacgcaccgtttaacagtttgaaatacgtgccacaaaaatcttaatcttcatataactcttattggagaaaataacatgaccatataaaggatttaaaagagatatgatatattctagtactacgaatttgaatactcagtctgtctagattattgactctctcacgtcatctatacagtctgatgttcgtagtccatctccagtgtgcctggaaacaaatcgagagaggcaaagaatgatatttggttggatttgtacactggagcaaccgaacaccaataaaacgcaaatttcttcggttggaacaagggggacaacaaaaacaaaaaaccaaagtagttcaagcagcattagctagcaaccacacctcagtcctgttcgtggtggggagccgaggaggaggagcagtgcccggcggccagggatcgaggcagggagccagccagccaccccaaccgaggtagccatggccgtgaagcctgctgcttcccatgactgtcgccgtcggatc

SEQ ID NO: 100486 - DNA, 714 bp, Oryza sativa
ggccgagcacaagccagttatgctggctcactccgtgcgttcgtccaatgcggaatggacgacgtagacgtccatctgacgtcacgagtgatctggatccaaattatactggatgtatatttgagggactcaaaatggacttattctgccaacatgtactgtcaacacaaaaggtccattttgcctcttgtaggtagggatgaaaacggtacggaaacggacggaaaccatctttatcgttttcgttttcatatttttttcggaatcgaaaagcccggatacgaaaatggaatcgaatattatcgaaaccgaaaacggagcgaaaacgaagtggcacaaatacggtaacgaaaatttatcggaatacagaaacccctcaaactgataaatccaattctcaagtctcaacggtcaacaattcatcgtaaaacacaatcatataaatccaattgttaagtctaaacaatatatcacaaaacacaatctatgaaataaattatctatgtttaagagagtaatgttgttgataaatcccaacgcagaaaaaaaatattcttatgtaacttcatatttacataacaaatatttttttaaaaaaaataaaagccaaacaccatcgtattcagtacttaaaaaaagaattcaaagtatttcagtcacaaaatttccggaaattccgagaaaatttctagaaagttctaactgattccggaa

SEQ ID NO: 100487 - DNA, 667 bp, Oryza sativa
aaaagagggctagcaggatggtaaaaaattaaatttacaagcataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtattttcgaaataaaataatatggatgcccgcgcggatgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattttcacttgtaaccatattgcaaggtatatgtgcagatggtatgcatgataattagctaggagtagtttattactttgttgatacaaaagcaattcaaaacagttatcaaattagtctttcttttattcaaaagtcgatgaatggttgttatatatattaagaaaaaatataacccatgaatcattttaaatgacatt

SEQ ID NO: 100488 - DNA, 731 bp, Oryza sativa
tggctagttagctcgctcggttcatagccaactcggctgttatgttttcaacaagccgagcagctgttttagctcgttacacataaaagctgctcacgagcttaaacgagctagaagcataggcagagaagttagtaggccaaggcccatatgtagaaaaataatccatcccacggtaggtccaaagaaaacagtcaaaaaggaaagaccagaacctatttgatcagtgtagcttttcatcttcctctttcccctcatcccgaattcccaatccagatcgaccttccttctgccacacacggccccgccttgttgctgcgcctcacgtccttgcatcacgctccctccatcggcggcagctccgccgacccctcgagcgcctcgaccacctgcacggctctcccgttcttgtcttggtcaagtggtgtaatggtcgggcaggaggaggttgcaggcatggggcaatggatccaggaggttgagcacttgtgctcgatctcgtatatcgccaccagaaaacaagattattgttaaaggtagagctaccatgaatactgattcatttgttgaacacttgagctagcatgtgatttcttggtttgatatggagatacaattgccttcgtggacattttggttgtataatatgtatttgcatctgttcgatgtattggctcgcgagctaaacgagctagctcgagctgagaagcgagccgagctgagccagcatt

SEQ ID NO: 100489 - DNA, 774 bp, Oryza sativa
gatatgattcagagcaaacctttaagctttttaattgctccctgcaatggacacacaaacaaacatgcattagaaatgcagaagtggtgtgaagtcggttgtaaagataatgccaaactcacttattagcactgttgagaaaagtcaagcactcttgagctagagatttctgtgggacataaaaaacaagagagaattcatcaggcaagatgattataagaaggtacaattaaacacattaagcgaataaaatgagtcagtgaattaaaaaaaaacaggttaaccttaatcccagtgctgtgggccataagtttatccttgggatcttccgcttgctcaaattacaaatgcacttcaggagtttttggctctggtgcaatcgtgttgattctccggacacattctatgttccacttttctgccctcacgctcactggccgagtgctaagaagcttcaatgagtttgaaatctctctcagtcggtcactcaactttggggaggatagggtactgctggcaggagtcttctcaacaaggttatctgggaatgccagtcaggtaataatgtgatcatactttgcattcacgtaatgaacttggcaacaaataataagagtgatgctataacagtgatcccatgtcaatacatgaattcctatcggccagtcaggaaaaaaaattggggaactaaaccaggccatagtcctgaacaaagtaacaggggcactacgtatttaatacagaactgtaaacagataatgagtattccttgca

SEQ ID NO: 100490 - DNA, 770 bp, Oryza sativa
catgtggggacgttatggcgccacatgtcagcttgtgacgttggaggtaggctcgaacgccaccactagcattatttaaggtaatatagatacacctagcttttatcattcattgagttcaacaaactttatgtatatttaaagaaacaaatatatctagagacataaacactagtactacagatttggacatctatgatgggtcatctgagatgggccgaaaagtatcccatttaaaatatggctactggggagggcctgtcatagatgcgacgtcatctgtgatgggatagttgtaacccattacagatgatctatgacgggtcacaaccaaggctcgtcataggacatgccatctgtgacgggtgtagtgttatgaaccatcgtagatgagatcactcatctctgatgggtcttaattgccttatgtactggtggtagttacgatcagtcatttccaaacaaaatcccggatagagatatgccttatatataagttgtagttctggatgatatctacaactttataactaaatgtttttattagagatcgtttacatccccaaatatgtattacagtgatgagatctattttgaagaacaatatttcaaaaatttcaaattacctcggatggaaaatgccccatatcaaagtcatagagctcaaccagatgtacaccattataattgacgatattttcatttaaatagtttgcatgcccgaatattgattataagttgagatctatcctaaaaacgaaaatttgaat

SEQ ID NO: 100491 - DNA, 4186 bp, Oryza sativa
atatacaaatacttgtacttatgacacttctaattttttacagcctaaacacattttttagatgggtagagcatccacatggctccaaatatctataaaaattggtatttttacatgtgagcatcataactgtacatgaaaacccatttttacaaacggccaaggcacctaattacgatgatttttccccaaaacattaaaaaataaaagcaaatccagaaaccctagccaccttccttgtgaagccaccgtcgttgttgccgtggcattccattgctatcgggcgccaccgtcatcacagctagcaactggcaggtcacggtcatcattgtagccctcatcgtgatcgaggtcgttgtcgcaggtggcggatccactgctttgccgttgtcaccgccgctacacgaaacccggcactgccaccgcatgaagcctgaggccactactctcaccatcaatgacctccctggctacagatccaccgctcccatgcatgcaggcggtgtattcacccaatcggaggccactacactcaaacccacgccgctacccatgagaggcgaggattctggtagagagtgggagagagaggagagggaaagtgggactaggggagaggagtgggaaagaggaaataaatggtaggggtgggggagctgaaaagattaaaaaaaaggaaaggagcggaggagggcggccggtgcggagacctgaggtagaggagagagaaaccaccgttcgtaaaaatcgatatttatagactgaacatcaccagtatatttttgcaggcgaatctcttttcagtccattcgtaaaaatataaaggagtatcagtaaaaatcattttacagaagaaaaacacaatagggaattagagcggtacgcatgggattctttaaggttatgggctatttaggccctatttattttagcttaagactattgtaatttagattacagtaaaataataagttgttagctgtttgtttctctggattattagctggttgtttggtgttagctatctaataatctaaaaaaatcacctttaaagtggattactagattatagtaatctggtttatagattataataatctagattataataatcctaagctgaaacaaacagggtcttaattaagttgatagctgatcagattaaggacgataaatgtatggcgaacgcatgcatgcagttaagccacactagcagatggtcaaactgggaactgactatatagagtgtttagtacttaatttgctaattaagctataagctgatataccgttgttgagttgccttcagcgacgacgacaggtacaccgtatttgttcaaaaatctgagttggataggagagaaaagtctaaactgaatgagggccatctccaaggcccaactataatataccggacacattattagagatccgagtggtcaattgtttaatatagagaagctgtagaaattttagtactttttttatactccctccgcccctaaatattcgacgccgttgacttttttaaacatgtttgacgtttattttattggatcctatcatttgattcatttccggaaaagaattaataattacttaaatttttttaataaaacaaacggtcaaacatgtttagaaaagtcaacggcgtcaaatatttagaaacggagagagtagaacttagtgatttgagtacctagatagactcacttgcttcaatatgtagtgcatgtatttcaaccataatacgtgtgatgagttaaccttttcaacgagtcgtatttgttttactaggagtagtgttataccaatttaaccactacttccaagcaagctaaggtccaaccctttttacactaccattttgtctgggtgacgcattacctgtttatatgggcattttctctgctccacctgtaaccaaacgtctgcagaaaatcatggatttttacaggtgcatcataaattaaccaccctagaaaatatattttacgcagacggatatcctttctccgtctattgaaatatgttttgaatgggctattactaaaggcatccgcccgtggaaacattcactactatccaggcgatgaataagctgttttcactggcattttccactccgcatgcaaaacaagggcctatgaaaatcgtggacgtttgcaggtaccaagaaccaccccaaaaaaatatatttacgcaaatggatatctgtagtctccacgtatggaatacgttttgtacgggctgttatttcactagtcagatctaaactatgaaccgcgtgcattgttttattaattacgtatgtcgggttgatatatgtcgccttgaattgaatgtgaagtttgattggatcaatgcgttactgctaccccgagccacggggaacgagctcagggatagagcccagagcacagcccatggagggccgcacccagaggcgagcatgcctcgaccatagcccacgggtggcatgcccaaaggtggatgtgtcctcaattctagggcaaatgtgccccaagctcagcccaatggggggccgtgcacgagggcaagcgatagatatgcctcgagcagtcggagattggactttgcttcccgtttcttcgacagtaatccctagccttaaccctataatggatccacttaggattgaggttgaggcccttcctaactgacatggatttgaatatcttgagcattggttcgaccagttccttgcccacccatgtgttggtatttgatacggtcagagataaatccacaagcgcacgaataccgctgtagcatttcatttaggagtattccatgggtatcgttatttgtttttccacaggaaacacggtggtgtaaagagtaggttgatatattcataaccatatactataatcaatataccatagtccaaacatgggtaaatgataatgatagtatttgggtaatgtgacacacaaaataatcatcccaatgtattagctagctagtggagaaagaactaaagaaatagctatggtttcaaatgtacttctatatactaatcatgcttagtcgatacaacaaccatatacatacacatggctaggacatagttaattataggcaaccagaatctaccaggaggccactccctgttggtctgccagtgtggctatagcattttatgaactcttacatcatacccgaacgtggaggaatatagagaacaaataggggttgtcaccacctgctgcctatctcactttccgtgaggaacacccgcatccaaacgacatttaattaatccaagcaccatgcttacattaataaataatgacactaattcctccgggacttccaccctatgaatggagaggtaagaactagtgcaacccgttaataagatcattagaccgataatatcgtatcatagattgactagcccaaaaacatatggtatacactggtggagaaaccatctttggtctgtcgacccaaatccacaatagtctgggttctattaaaaaccgggactaaaaacgatttttagtcccggtttataagaataacagggctagataatctttattcccggttggtgttactaaccgggactaaagatggttccctatcagaccgtgtcaggcgcctaggatctttattcccggtttgtaacaccaaccgggactaaagatataactttagtcccggttggtgttactaattccgggaataaaaatctaacacgtactatataatccctattacttatcctcttctctcgtccacacaacaaactctctctatctctttttttcctctctaactccctccctctttcctgccttatctcttttctttttggatagatcaagcgagagcgctgagagcgagagcgggccggcgcggagggccagcgcggcggggcggagggcagtgcggaggcggcgggcagcggcgcagcagtgggctagcgcggcggtggccggcgggcgcggagaggaggcggcagcggccggctggcgcctctgtgatttttattttagaatttgtgatttattgcatgatcctgtgatgtattgatttgtgtgtgatgtatttgcgattaattttgtagaacttgtgatgtaatttgatttgtggcaattttttttaggatttgtgatgtatttgatttgtgtgtataagtaactttaaagatttg

SEQ ID NO: 100492 - DNA, 1193 bp, Oryza sativa
catatacatatacatatatacatatacatatatacatatacatatatacatatatatacatatatatatatacatatatatacatatatatatatatatacacatatatatatatatatatgttggtttgatctataggtgttgggtcagtatgcaccatatatatgtgcatgaatcaccactcaccatcgatcgccatcacccatatcaccaccattcgtcatcctcctttcctatcttccttttcttcctttctttctttctattcttctttttaatttgtggggagcaattgcaattggaatgcattttgctggaccggcatgcatgtgccaatgttgatgcaagcaatgtcgacaagtcactacatatagtgtcagccggcaatacgttttggcatataccgatagaagaaaaagggtacacatattggaacaaagtgaccatcatcgatcgagatcgaactggcaagtgtgaattatattaggtgatatgatctttatggaccagatgctctaccaattggggggtgtgtgatttaattttgaggatgggaaagaaagcttatagcatcggaataatctgatgatgatggacgctggcatcatgtacgcatgctccttttgggagtcttattatactaaggatttcgtttgatgccggccgtcagtgttatggaaggaattaaagagctacctcatatagcaaagctacatggctacattatgccatatatatgtacgtgtgttcgttgggctagagcaattgagttgtagtccattaatcaacttagggcatgtctagtttccaaacaaaattttttacactatcatatcgaatgtttggacacatgcatggtgtattaaatgtaaaaaaaacaattacatagcggctggcagcaagccgacggcggctaggctgcgcgtgggcggcggcggcggctaggcggcgcaaagtcccaggcggcgggcagcaagctgacggcggctaggtagagggggaggcgcgtcggccctgcgatgaacctggcgaaccgccacatcggccgaggaagaagaccacgacgacggcgacgaaggatgcgggcggcggcggctaggcggcgcaatgtcccaccctgccttggcaggggccagtggaggtggaggcgcgtcggccctacgacgaacctggcaaccgccacatcggccgag

SEQ ID NO: 100493 - DNA, 1659 bp, Oryza sativa
gggggggacatgtgggaagcaaatgtcgacatagtgtggtgagagagaagggacggtgatctgatctgattgggttgggtggtactttccgtgtacgcgcgggcgtggttgctgggcccactttggtttgggcttttctgtgtgtagcggctcctgttttacggcccatggagttggagtcgtgctcccccccgtgaattagtgggccaccttggtaacaacattttgtggttgttctgccgttaaccccgccaccaactcaattttttttctttaggccttattcggttacgctttgatttaatctagaccaagaatgataaatatagtaagaaatttataatagatacaatgagaggtcgggatttattccggaccagaaaccaatttacttatgatagggacaataagagaccgtgattagttccacacctcttgaccagttgattgattcccggtctcttattgtccctattataaataaattagttccctgcccagaataaatctcggtctcccattgtatttatcgtaaatttcttactatacttgtcatttccggtccgaattaaatataagcgtaaccgaacaaggtgttaaggaaaaataatatgtgaggctgatccacgtaccaatgattcatggtatgagattaaagggtccacatgtcaataactaatatatacagcaattaagatacagtaataatatgttaatgataattttttttgcaacgtacgagcaatatgctattaactagtaaaggcatccaatatttcaacgtcaaacaaagtcacagatcaaatgacgataaaaaaagtcacagatcaaacttttttttccaatcaattgcataagtatctatcctatgtactacatctagcatttgaaccctccatatataaccgtattatcacctttggcacctagccatttgtccgccatttctcttcttttgacaaaatgatattgtttacatacacacaagagaaaataatatgtatgattgcgctcatctttacacgcattcgctgaatggaaagattcatacacttatgactaattctaaagttctaaaaaaaatactaattctaacacctaaattaatggaacataacaaagacattgtggccattataagttttatactctgccatggtgagctacgactaaacaaaatgacattacacatgttttattttttgctaattgtaaaacaaaattaaataggggtttgaaacaaacaagcatgtccaaaaggattaagtgtatttattttaccctcaactcttgctcctgattaaatcgtctcccttaatattttcatccaatgtggtgttgggacccacaagttaatcctcccttgctcacccttacctcttctctccctaccctccctggtctccctttcttctccatgggggactaattgacagagaccgacgaggaagcatagggtggcgaccgtcggtggatgatggagacatacgaggcagcctcggagagcatgaagatcagcgacatccaatgctagttggaaaagcagtttgcgagcgatagctccatcacgaaccagagagcgacaaaccccacagggggaggacgcggacatggcagtgagcggaagcgccagtacgcgcatgaggctagcgagcccca

SEQ ID NO: 100494 - DNA, 742 bp, Oryza sativa
tacatagactttgactatgagcatagttttggattggtgccactgaaatggtgttagttaattgaaatacactgaatggtggcctgtgggtgtatggttttgctggtcgcacccatggcaattaaggaccggttcacgggaaaccctaggagacttaccgtgcttaccacaagcgggagtgggtaactgcttgatctgaagtatagctcgaccctttcctagtcaccggtggcgagggtgggcgtgatggagttgggtcggccggggtgtctggttgtccagctgccggattcaccgcggcgcaagaggggaccgcccactgccttttgaggggtgggggtgaaaccttagcatggtgtggatggttaggggagggttatgcggagggtcttgtcacgattttcccctttgcagtatcatggtgatacttcggggcatggcgacatgtgtggaatcgtgtcttgtgggtacagttgtacacctctatccagagtaaaactattcgaatagccatgcccacggtaatgggcgatcaaccagatttaccgtgattagtctcaccctagtttagcttaatgaactggtgtagttcaggtggttggttgggcctgttgcaacgtggtgtagtgttggatagtgattggttaatattgattaattactacaactgttttactgctttcaactactgctttgaaatgtctgctttatgcaaaagtacatttagcctcctttggatata

SEQ ID NO: 100495 - DNA, 541 bp, Oryza sativa
gatttatacaggttcaggccttcttattcaagaagtaataccctactcctgtcccgggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagatgtagcttctaccatatttttagcctgttttttcatttgccggctag

SEQ ID NO: 100496 - DNA, 1268 bp, Oryza sativa
ggctgattttgatctctaaatcggctccgctagccggtttaggttttgtttctacaaaacccatcttgatttggccctttggctagatcgaggtggttggcgactccatatcaccgcaaggcatttaggtgttgtgatcgtgcttgtcgacttgtcaaaaaaattaccaacacgatttttggcgactccactaaggaacgatctaatcggccatatcacggctgaatttcgtttaatacagtagttttcgtcaaattgagagtttgggctaaacagccgagatcaatctgtacaacttatcgctgctgctacgaagttttcctcggatcagtatattcgacggcggtactgtttggtcaccaagtggaattaatctacatagctcagccgacgctatttggtttcatctgccgcagtcagccggcgtcgccgttgtctgtgttgaggccgatcgattcaatcggtttgggagcagtacgctgtccttctattttgctgtgcacggctgaaattttgagtcttcgtcctattcggtttgctatatacaaattcctaaaaacagaagaaatcaggctatcaaagccgatctgccactgcccacataccgaaaatcaggctattagagccgatttacctagaataagacaaaaccaaatcggtttctgttattgtgcattaggcaactgttaccgagaaaaaaaaaagggatcgaagccgattcatattgtttcggctgttattgtgagacatcgattttctgaatttttgcctacacacgagacagaaacagttctgttcttgctgcacgctgttaccgaaaaaaaaaatcaaatcaaagccgttgcagtgcatcggctgttattgtggaacatcaatttccaaatatttgctagctatacacacagtagcataccgaggaagttaagaccgtatattaatttattcggtcaaatatttcggctattagctatatggccggatttaatcaagaaatgtcttcatcaactattacgagcgggaacgggttaaacaatgttactacacaatacttcaggaccgatcaaggcgtcgtgagaggaaacgtcccgctacctcaagttgtaatttcaccaaaggtaaccttcgtttcgcctaacccgtcctttgctattcaaaacgttaataatcattgtgtagatgcatatgctacttctagttttgctcctatacaatatgcttataatgctacgggggagtcaatggatgattatacgccaattacacagaaa

SEQ ID NO: 100497 - DNA, 591 bp, Oryza sativa
aattgagtgaagagtataaattgaaattttcttagcacaagagcaattattcacaatatttgcaataatactattcttgtgccgaagaggaaatcaagccacataaattaaattggtggctagatcaaaaggaggaatttggatagttggatcgagaatcaaaggatggttttaagatcaaaggatgggctaacaattaattccaatgagattggaattactttggtttaggttcaagggcaaaattggaggatttcttggaccataattcataatagtaaaaatggttttcaaactaaattcgaataaaagagttttagtcgaaagaaggtttaatattcgaaaataaaatttcaacaagaaataccaaatatgtttttaaatgaaaaacacaaaagggattaaataccagagaggttttatgcgagttagttctaggaggtccagctaattatattttcctaggtctagaaggttattaaaaacataagaatcagcatgatgcaagattagaaaatgacacattttcaggatgttacaaaacaagaccatgcaacttctcgctaaagtatgcaacaggcttaccatctt

SEQ ID NO: 100498 - DNA, 1106 bp, Oryza sativa
ggtgggtcccactaccaccggcgagggcgcgcgacagacggtgctcgattgcggcctacctagtcggcaaaaacatagtggtttggccgactttcggcccaagccaaaagagtatttaaaaaacctttgtcaatttaaattattcatacaatgcattccatttgattaagaatacttccttgcctcaaataaatcccagaaaaatctaggaactatagaattaagcgaagtatttaataatattttatctggcacaatttcatattcaaatttattatttcaaaatagatcttctcttataggcttttaatatcatttctaataattccaattaaccaacgatttatatatttcggatttttagggtgtgacataggtgacgaatatttgtcacacgaacgttagatttcacaacatgacttaaaattcaattttcatgacgtaaattagcatcacctacactagtggagaaaccctttttcctcccggttcgtaacccccctttagtcccggttatccaccgggactaccaatccgggactaaagatcgctatctttagtcccgggtgaaataacctggaccaaagatcgatctaccaatttttttcttatttgcatggccctattgctgcaaggtttagagtttatgttacaatacatatatatgcattatatatatatatatatatatatatatataggacggctctttcgtacactcaggtgtatgtacacccttttattaatggatgatccaattagcattcaaattagctatgaaaaaaattaataatatgaatttccaaatgactgcatgcatgtggcatagctgcacaccggattgagtgcacatttgaacaagattgttggcatgcatttgctttcaaatttgataacttaccttagatatccccaccttttctagtatgcaactgtcgcgtcccaaaacgactctaaaatgcatcctcaaaaatgtgcatagaataattaaaaatccatgtgagagcctccaacaattaaaatgtgcaaagttaaaagacgaataaggcttggaggatttttgtatattttctaacagcctaaaatgcgtaaataaattttagtgg

SEQ ID NO: 100499 - DNA, 1141 bp, Oryza sativa
aaaaggtaatttatgattttcgctgtctcatcatgattatgccaaatatacatatacctaactcatgaatttttctatgcctacctctcaccatttatgctatgtctaagctagacgattttgttatggccatacctactcttaaatttttttatgtcggccttgactcagccgccccaatagaagcgacaaaactgctgttgttgcaagagttggattccttcaagaaagtgatagatgaatctgaggcatcaagggagcagtaatcaaagaaaattgaaagtttgattggcctaaatgctccatattttgctctgaaatgttgatagttatgttaccaatcatgtatcattgtcattttcatagccttcatcatggcgttgcgaatattatgaatataccaatggatcaacctgcacgccctaagtgtgcgcattcttaaaactccaaggtaaaaagacaaaaatgctgaagtgtgatgcatgcatatgtacatattgctcctcccaaatggacatcatgcaggatcgggacttgacaacacattaaaggctctcatgctacacgcttcttgcactgtagttaaacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactagatataagattttttctttgtttctcaattctttcggtcaataacgagcatgtgtgttattcatagaaacggaggtaggtagtatttgtaagaagtacggtatcgaatttcaaaaaagttccgaccttgtccgataatatacacacatattaacctacataggcaagctagccagacctagaaatataccatttctaaacctattcggtcacttactcacgttggggagcctaactaaactaacatggactcacatg

SEQ ID NO: 100500 - DNA, 1253 bp, Oryza sativa
atctcgtattgggtacttatatggaaacttatttcaatattctttatttttaattccgaattttagctatttttaaattgtatttctacttggactctccttttcttttttaattttggattttattttatttttatttcgaattttaattaatcttgtattgggttcttatatggaaacttctctcaatattgcttatttttaattccgaatttcagctatttttaaattatacttgtactttgactctcctttttcttttttttttctttttctccgattaatatgggaattatttgtattccaaattttaattaatctcgtattgggttcttatatggagtcttcttttaatattccttatttttaatttcgaattttatctatttttaaattgtatttctattttgactctcctttccttttctaattttggattttattttatttttatttcgaattttgattaatctcgtattgggttcttatatggaaacttctttcaatattgcttatttttaattcagaatttcagctatttttaaattgtacttctacttggactctcctttttctttttctttttttctttttctccgattaatgtcggaatttctagcccccacagcgaacgtaatgtctcctttcaaaaagttattttaataatataatagatagatacttccaccgtttcacaatgtaagtcattctagcatttcacacattcattttgatgttaataaatatagatagatatataaatgtctatattcattaacatcattatgaatgtgggaaatgctagaatgacttacattgtgaaacggagggagtagatagatattaatgtagtgacatccaaaaccacaagcatagtgtctaattgttaaataaaaataaaacatgcaaatgttgtgtttagtttaccgattgaaatcacaagactactaccaagtgtccaagtctgatcactgtttcacgagatatgcaaagcaacgtttatttagctgcttagcttcgacttgggcttttggaaggtcaaacgagtgacggaggatcacacgtcgcatacgccgtgatcgtatgacagtcgaacgtagtagtcgtttgtctagcattttcaaaagcaacccgcggcgccggctcctccagagattcagaatattcgccaggtcacttcgctaccaccgttcttttttttcgtacagaagcttcttttcctccgtccttttggagaaatcgccgagtaaaag

SEQ ID NO: 100501 - DNA, 801 bp, Oryza sativa
ataagatttaattgctagaagttgttatatttagaaagagagagtacttatgaccataatttaagtaattcaaaatttaaaatttgactaaaaatgtaaataaggaaaatctttcgccctgtttttaatctttaaaaaattcttatagtaatatttatgaatggttggagtagcatattcttgagttattttgcttttgatggtgagttcgttcgaagataattagaaaaaaaatcctcgtctttcccacgcacgcctctgttttataaaaagtttagtgtttaatttattgcttaccttattttacttattttttcaatcctatttgttctcctgctctcagtcactgagctagttgcataaccatcgtttcgcggaataagcgaaatggcacatttgtaaaagaaaggtaatttgtgaataaaacttttatatacgtgttcttaacgatctaaaaagaaatgctgaaaaataaacttcgataaaaaaaaccttaaaatcagctccaaatctctaaatttaatgttgaaaatttcaaattttggttgataagcgcccttagcctgtgcgtgtagtgtatgccatgcattgggcttgaaaagatcagcagatcgtgtgacgtactacggccggtctgctgccaaaacaccgttctagggtcaccaataattggatggaatctggcactacgttacatcaaattattggccagatttttttcccctttctttctctcctcgctttcacggtcgacaacagccacggccatggtgctggctggacccgtcgtctcgtccctgt

SEQ ID NO: 100502 - DNA, 616 bp, Oryza sativa
atcattccttggcttgtagattcatcactccaacctctgcatccgtcctcacatagccttccgcctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcaggagtagcccctgagctcaaactctctgtgactctgtgactccctggaagacccacccgttggagacccacttgtctccactcagtgcattagatttagcttagctctttggtttttggttttttctctttt

SEQ ID NO: 100503 - DNA, 784 bp, Oryza sativa
cttacgaatctgttgaccataaataaacaagccagaagaactaccacacaagaaaattgttggtgtttctgacattttggctatggtagctattatattttataacttcattagaaaaatgttttaaataaaaaccataggtcatgttttattcattaggttctgtccatgccacgtaattatgttttatgtcacttaacgtattttcaggaatcaatttagtctgagcagagcatgatagcattaatatctaaacaaccagatccacagtatttattccagttttttctccattttgatcactttagttagcagtgcgatagtgcatgctagttatattgtacctccatgcggaaaacagattttcacctgaattatttatcattgattatctacttaattatacagacaaattaaaataaacttaacaaatagtttgcaataagtggactaaacaatggtagaaaatatttaagaaaacctatctctaagagacgtgaagtaaataatatgcaacgacaatatgatgaagtattaccttaaaacagcgcggaacagtgataaattatgaattatctatttagcttggtttgtaaatcttaataccacatcgtgtgacgaaaaacagcccgtaaaaataatagggatcgaattgtattcatattattatgtttgttttgttgttatccactcatatgtatatattaattattcttattaatgttttgcagcagcagatcatgacctaacgaatcatgtgtgtatcacaaaaagggccaagttg

SEQ ID NO: 100504 - DNA, 625 bp, Oryza sativa
tgggaagatcggctccgtcatggtacgggcacaagactgttcgagctgggcctacagctccacttgtgggctgagccgaagagaggtaggccgagcaaatagaggtagcatactaggctaggactagagctgaaaaggaaggaaggaatgaacgttcggtccaaaaccaaggaagaattcggtcttaaatcaagggagtataatgtatagatcaaatcctggtgcaaaatgtggggtgctgactgaggaaattgagatatctaaactgtctgcagggttgggggatcagctaaacaaacaagaggtatctgtgagtcaagagcaggctctggttgtttggcagaccgaggggatttcatctcaaccggtagacgatcctgattctcaggaggagggagaggattgccaactggaagctttgatggattgggatttgcaaaaaggttttgtgaatcctattatggaagatgatgaggaagggaaatgtgacattcctacagaatcagatatcgagaagatgagggctgaggaggatgagttagaggatgataatagttctaagcagtcaccttcgcttgggggggggggaagtttttcaagaagtcaagaagaagaagctaaggaa

SEQ ID NO: 100505 - DNA, 680 bp, Oryza sativa
tcggcggccatgacggcaacggcagctgccggcatgaggttgggtatgaccccgacaggtggggccgcgggtcccacctgtcggccaaagaggagagggaggccggctggggaggcaaagtagacttcggggaggagagggccgagcggcgagctgggccgagggagagagagggcccgagagggggaggaatttgggccgagcccgaaagcaaggaaggggaaaaatattttcttttctttttattttaattggttaaatgaactttgtgactttaaaactatttctcgagctccgaaaattcacggaaaattccggagagtattttagggcacaaagaatattgcaaaatattcccggccgatgatttttaagggaaaattttaattctcccaataattcacttgattaaattgcttaactttttatttaatttgtagaaaatgcattatttaatgatttttaatcccgaacgaaaatcggggcgttacaaatctaccccccttacaggaatctcgtcctagattctgggatggctagaaagaaagctggtgtaggcagtcggtttgactgatctacgggtatgcacactgcactgcccctttctatcttgaagtgcctgattgactgattgatccaacctgcaccattgaaatggggctgcaggaattcgatacgag

SEQ ID NO: 100506 - DNA, 535 bp, Oryza sativa
ccctcctgtgactaggggtcgggctcccccgaccccctctgcgggttgccacgtgcggtgggttaggtggccaccttcgagcgctcacctacccgcattaatggcaacctgagcaggcgcgccacgccacatttaatgtggcgtgcagcgcgcccaaattggtctgtgaccggtcgaatgaccgataggacccggggtgtcaggtgcactaccgcatgggtcagaaggcgtgcaccccgtcctatcccatcagtcatgatggcgaaaggtcttaacctctcatcctggccagggtcggtccatcctccctggtcaattggggtttccatttcccggcgtaagcaggagcccagaagtcttcacccattaatagcagctgacatgggcgccctcccatgtcaggcggcaagatttgacatgcccccaacatcaagatgacgtgcgcccgcttcccaagtcaagaaataagacatgcatttaatgcaaagaatgtaatacttctccaccaaagctaggtttttgggcccatgtggta

SEQ ID NO: 100507 - DNA, 530 bp, Oryza sativa
caaaaggatagcgacgtgacgtgacgcacgcacgccgccagccacgcctcgcccacggcccgcgcgcgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacataaaagaattagaattaaaaaataatttattattatcaacttaaaagagtatatagaagatatatatatatataggaaagagagtaatcacataaaaagactaaaattaagtgaaaaatatatgcatggtgtcataattttagcaatcccgtctaattttgcaggggccaaaacgcataattttcctctggagcagctatatatatgagactttacgtgctcactccatcgacactggccatccatcccgcctatgggtagcacgggagaagtaatgctggcat

SEQ ID NO: 100508 - DNA, 575 bp, Oryza sativa
tcttatactatcatcaaacctcccaatcactcccaatcacattgcttgcattcatcaaggtgatccaaccaagaaagtgataaaatgttttcttggtctttgtgttatgggtggttatgccttatattttgggatggatcgagggagtaaacaagttcaaaagcaaacaccaccataggagacaaagagacaacaaagacatccagatcaagtctcacaacaaaaaatttcaactaacaattcaatcttcccctacaattccacctagattttgaataaaattccataacagtatcaagaaagattgataagccgtttgatttcatatatcatgttccaacccatcccagctcaatcatcccctctccaatatgctactattgacaaccagcccagtccaactaatatgtgtgagatgcttgatttagaagcaggctgtaagaatctaggggttcaatttctcagcttctgacttctaggtagattttggattttacaactatagatcttcacatgcactcacatgcactcccacttcctcagtgaacagcgtgagctagctagcagggttcaat

SEQ ID NO: 100509 - DNA, 662 bp, Oryza sativa
gcacccctgagaataattatggcgtgtttggttaagtgtcaacaatgcgggcacatatgtctttactgatcgaacgtcccatgtgtcgcatgctgtgtcactgttatatccgatggggactacatcagacggataaaacccaagtcagctaacctttgtggcagaacccggatgcactaccaaaaagtccagcaatttggccataggcctgcagcttccaagttcttcgctttgactttgcacaataattgatgattgcgtaggtagtaaaattcacaaattttatgagggaagaaatttaaatgacccattaaccatttctctttgtaatcctgcctccgtacctatataagatggacatggagcccttaaataacatggccaaaactcgatcgccatataaatacaacaccagacggatacaatatctaaatatgaatagggtaatacttcttatcgagaatgcctcaacctttctaaatttgtgtccctttacttactcattttaaatctcgggataccccttcttactaccgatttatagaatcaacaaggtcaactactataaattaaacatgatgttgaactcataaccgctgggcttgtggactgtcataaactgatgttaacctatatgcgtggaaggaattcagactcataga

SEQ ID NO: 100510 - DNA, 797 bp, Oryza sativa
  unsure (1)..(797): unsure at all n locations
ctgaatccatatagaaattagttttgtaccatatcgccgattctgagacaacacgacctgtttattagctcgatttgatcctattccatcgccaccccagagacgcccaccccgactgcaatgggcagcggtagggcgtgtatccgccctaccgtttcagctgccnaaaaaaaaaaaaaaaaaaaaaaaaaaaaaaaaaaaaaagcagtgaaaagatcccctactggggcacggcaggcgaccccctgccggccagctgcaaaaaaaaaaaaaaaaggagcagtgaaaagatccctacggcaggcgaccccctgccgaaaagatgccctatagaggcacacagtcgggtctctcggtggaggcagcgctagacactagcgcttggctttttgaaatttgtaacattagatttatttttttcccctgttgaactcattgctactcactcatgggataattgaaccaattgcaaaatagttcgattacttcgtaacactcctccatatacaacatactccatgtgatagtatatagactgatcatccaataatttcagtaaatgtttgactgaaacctccaatattttcagccaattgtctgaagatgtgaatatcaagattccaaatgactagcgacaagatcatgtatgtgcagacgacccctgaggctgaaccaaactcatccaggcatggcatggggaaaaaacagaccatagctcatcccggcatgaacgaagaacccgacattttgcatattttttctgatgctctggattcatgtaagcactaatttttgat

SEQ ID NO: 100511 - DNA, 563 bp, Oryza sativa
gaggatattacatggaagagaaagcgactgaattttcctgtcaagaaaaactcctaccagcttaactgcgccacttttctgttatctgagcaaacgcgatggaagacccttctattccgctgaagctagatattccaccaggttgtgatctctttctctctttctttcaatctttggcttgatacgagcgaaaacaaagacaccaatcagacatatattatactcgtattgcataggggataaaaccaaacttctgcaggcacaaatttactcccaaacattgacagtgaaatagcaatcttttactaaatttactcccaaacattgtgatttcatagggtccattgcacgcacatggtaatctgtgcagccactatcgatctattaaaaaaaatcctaagttaattttaatttttgagaggcaccaaacatagagaataacttgggaggagaaggtaattggctatggaacagaggaattccacttaccgctacttcatcgtcaaattccggtcgctggccttcgtcagccattaaaatctttgccttttcgcccacagttg

SEQ ID NO: 100512 - DNA, 714 bp, Oryza sativa
tacactggagtccattgcagcagtgccaaactaccatcaccatgtcagtacttggcaataaacctatttatcacaaaaagattagtagttaacatttaatattaatgtgagaaatacaattccatcctcaacgtgctcaataaaaagttgcttattgttatttagagttccagacccaatgtataacttatcttgttctttccatattaccccaagtgttacttctatataaataaaaaaatataattacataaaggcaggtttaaatttgcaaatcatttggggttcccccccaaaaaaacccccaaaaagggcccttttttttcccaaatctttgggggcccccccccaaccccaaggggggtttgggcccccattccaggaggaaaatgggcaaagggaggctgccataaaagaaaatgattaaatttcacaagacaacaggtactttgcacaatctatatctgtgctaatgtaaaagatggtagtggtagtggtggtgaatcaccacccaagtacccaataaccatgtgggacccataaacagggagactttgcctatttcccaacccccaaggccacagaccctgagaactctagctcaatagacacctagaaagtgactgcaaaagtaacatgatgataatattaggcaataagaacaattattgtgggctttagaatatatacgatgagctatttttcttaaaagat

SEQ ID NO: 100513 - DNA, 708 bp, Oryza sativa
  unsure (1)..(708): unsure at all n locations
aagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctactatagggttgcacaggaatatatagccattgttttcttattccaaagttcgccgtgacatttcacgcagaggtcaaatgccccattgagatcattggagctcagaacgacacactgacaccaccaaaattagtgtaccagtatgttcaggccttgcgtcataaaactgaccgggggagntcccctggtaaaattcttttcacggggtatttaccaaagctccccacaattatgccctttttgccccccggaaagggggaaccccttgttggtttcacaaataaaatattttattttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacggg

SEQ ID NO: 100514 - DNA, 574 bp, Oryza sativa
tcctgcagccctgggactaaagagaggggatctttagtcccggttgatgttaccaaccgggactaaagagacaatagcggcagtaccagatggtcgccttttctttttcttttttcctttttattttctctcgaatcaagtaggcaaatccccaaatcaatcccccaatcaaagcaacatcccaaattcatatcaccaaatacacatcacaaatcataaagttacttatacacacaaatcaaatacatcacaatatcctaaaaaattactcaaatacatcacagatccaaacaatgaatcacaaatttgtatatctcagtgaatcacaatttttttttaaaaaaacaatgccgctgctaccaccactcgccacgaccgccgggcgcggcctcaccgcccgccacggccgcggccccgccgcctgccgcccaccacggccgccgccgcccgccgccggcctcggccccatcggccttcgccccaccactctccaccggccgtggccccgccggcctccgccgggcgccgtcccgccgcccgccgaggccccgccggccgcaggcctccgccgggc

SEQ ID NO: 100515 - DNA, 513 bp, Oryza sativa
tttactttagaggttaaaattttgtcttgattgcccatgcagaaccttattattcagctttgacgtctcatttgctaatttcagccatttctacaattaatccctagttagctagatatgtcctccccatgtcttttaattttacagtttcctaatgctatatagcctctaccatcttgtctagcgccaattctgcagccaaactttgttctgcacttcaattagttgggcttaaattgctctcatattatgtaaatttgcaagcagttcttgttgagattgacgccattgcttccatgaataattcctctgatgtcataacttcacgtagtgctccctgtagtgtttatgggtctcatgtcactgcttttatgtagtggatcttttagttcccatacgctaatatgatgaggtttcctcctttgaacatcatatgctagatacagttaagacccttacagatagtaattttctatgccatctaacattacctgtgttgctactagtctccct

SEQ ID NO: 100516 - DNA, 524 bp, Oryza sativa
cggcgctggcctttatactggctaaataaaagcaaaagcaaaagcaacaattaggtttggcttagctcagtggtaggtatttgaaaggtggcgttacagtgaccagggttcgaaccctctcctttatgtttttactaaacttttttttttacttagttctcaacttgcggttttaactttttcaaagctcaggtatttttaagtccattcttttatttttaaatatgtactaaatgtgttattccttttaaatattttttaaaaaagtgatatttcttttacaagttcaagtgttgttttaattttattaaaacacgtgacattttagaataaaacttacccttagttctcaacttgttgtttattttttttaaaaaaaaactcaagtttttttaaatccattcttctaatttcttttttataaaaaagtgatatttcttttaaaagttgtctctaaacttttttaatccattcttctactttttaaatttgtactaaatgtgatatttctttttaataaaaat

SEQ ID NO: 100517 - DNA, 592 bp, Oryza sativa
tgtgtatgcatcatatcgcaaccactttcccatgtagctctcgatcgcgagatcatcaccaactaacagcaaataattaaatggacagcaccaaagctaagctccaacataacaaccctgcattatgcatgtgtgtacatgtactctgtctactgcgtgccaccaggaagatcattcaatcagagatttttgtgcctaatcattgggcttcttccataatgcctgattgccttgctattagcaaagctagctccatgctgtatgtgcgtatatgtccataaagatcaatctacagcacaactcctgcactaatcgctttttggataggcaaacaagtactgcattcaaacctatacgagaagtatatgtatagtgcacattactgccaaattggttagcacatgggtcatctttgcagcttgtgtccagttagttttgaaaatgcatggaacattcaacaaccttaatttatactctatgcaccgtcacaaatgaatgttctgtcaaccttttcattctttgacactaatataatacttgatggaagctggaaagtcttggggttttaactatttgccacctttagatttgg

SEQ ID NO: 100518 - DNA, 616 bp, Oryza sativa
ggtacaaaacactccacacaagttcattttctctttcaacttttcacctctatccagttttcagcaatttctcatgccttatgggtctcccattaagttgcctcttgacaccaaagctacttttcattttgtttttgcttttgcatgctttaatttcaccaaagatacggcgataaaacatgacaatgacctcaaattattagataaggcgtattaaatcttatgtccaataagagagaacatagggtcttaattcgctcaccatatgctagagaaatcgctaaggagtgcgatgagaatcactaaaaactagatagaggagggaagttacaaaactaatttgtaggggagattgaaaaggtgcgttatttggatttttccctaaagttattatcctaaacctcggcaataccttctgaaacaaaattttgaagtggaacaataaattagtattcctttgaaacacaagaacgtcttttcaaaaaaagaaagttcatggaaaattagttcaattcttgtaggaatcctacaaatatactctgttcaaaaagaggctcactcttataaaagaaactacatacttagcaaagcatggaaatgtcacataattttacaa

SEQ ID NO: 100519 - DNA, 1020 bp, Oryza sativa
tttttcttgatattctttttggagagtaaattctatcactaaatagcaggtactagttaatcacggaaggggtctaaaccatgtaatggttgatcacagaatgaagggtgtggatggctgtaacggcaaactttgcctttggactcaaaggcagatgatgtgaaccccctctactaaccgatactagacgagaagcctgtaactgcttgcagttagtactaattaatccataaattctcctcgcctaacaattggaggcccctcaacttctcttctgtaaattaaaccatggtagctgagaagcctgtaacgactgaaaatactgatatctcaaataccgaattttgggtatgctatcttgtattttattgggccacgtggcaacatatattttcagctagaccccatcccgaaatctgccatgtgttctcatgagggtctctagcagtttccatccaatgtgctagagccagtgcacctacagcctgtaggctacaggtcacatatactactagagctttagagcactagacaaccagcgtacaggtgaagtgtctagagaaaaattaatgagttaaattacttggctcctggagaatataaaggggcaactcctttatggcaattttaagggtgaaattaatccccttcaatccctttttcattggaattaagcaaataaggcctaaacaatttttactccatctcagtttgatcaaccccttatcaaaaggcgtcaaagaccaaagacaccaaagcatttaacattctgaaattaatcctaatcgatcaagatgttctgtcactttgtgtccaacagaaagctagtaattcgcttgcataggttgaacaatataaattaatcctagctggttgtatacatgcgtgctgattattacatgatgcatatttactctatgcacgaataaataaagagacactttgttttgttttatgatgatcatctttaaaaaaccttaggtatttatcaaactgggatataaagaaaacctcaaagag

SEQ ID NO: 100520 - DNA, 719 bp, Oryza sativa
cgaaggcgcccagtaggtcttagttacggtcgttgcctgtggcaatggcgtgccgttgcctaaattccgctgccttatctatttctgcttttggaatgtattccggaccgctcggttcgatgatttaagaactatgcctgcgggcttatgatgtaataagccgtactagacactcgtgtatgtgcacttggtatttcagctatgaattcgtgtgtaccagactacttgatccagggaaatagtactgtttacacgattgattcctgttataaaaacgggggtccacaccattctctctgagagaggcaagtcgcatcatccttgtgatagcccagggccgaaaaccacacctaacattgcaactctctgtgtttttcgtcctcactttaacgtaaaaattccggaatcggagttaacactacccaggcaaatatccttataagctggtgttgatcactctcaactagcgaggtgggatcattccagctacagtacccagctgctactactcgctgctctgcgtgctgtgctgctgctaggccgcatgcatgggtaggccaaggcccatggcctgcacgcctgcttgccctttttttcttatagggttttacatgcacccaccctcataagagttgcgacgtccccatcgaactaatctatacctgtgctttcccaaatgaccaggaacaaatattatcttagtgtacgaccgtacgtgc

SEQ ID NO: 100521 - DNA, 835 bp, Oryza sativa
tgggggatatgtgaggggtagtgttttatttattgcgcatcctaggtgtgttttagtgcatctctgtatagtactattatactttttttgcgttgctacaatgtacttgtaataatcataatgaattctctttattgagaagtataattgatttctttcaattcggccgaatagactcttctaaaatattcccaataccataacttagtactaactagaaacacaacatgcgccagcccaattaggccaaatagaggtattccctgttacatttatatgaacaggagagaatggcaaaaaaaaataaaaatcacaacaaaatacatgctactatacatgaaaaaagaaacacaacgcggctttgtcgcgcggaagtgtacatgcaccagcccaattggaccaaatagaggtattccctgttacatttatatgaacgggagagaatggcaaaaaatgccaagtaatggcatgactattttcgatgaattttctgcactaagtaagaaatgtcaaagttagtacatcagtagtgataataccatatgctaataatacattgcaaataaaaatggtatcaatgaatagctataacagaactaaaagaacaaattcatgatacagatcatcaagcataaacctttagccttttgcagcccgaaaagaatccctttggctatcaactattatcaagcacaccatatagtagcatcaaaagggataaaaaattggaccaacaaaatggctgcaaagtgaaaatggaaaaggggataacaaattgaaatatgctttttttttaatctccagaggcacaggtggtcctaaacgaagaacagca

SEQ ID NO: 100522 - DNA, 1296 bp, Oryza sativa
gatgatgtgaatcataggacactgcaagcttttgatgtcacttgcgacggggcctcctatcaaattaggagaataaatgatgcgggcttataggtacatataatttctttatctatttatgacaaaaataaagtatatgccaattgcagtgatgtggtatgtttcaatatatattcatggtgatatttgttatgcaaaaaaaaatgcaatcgcatatagtcattttccatgtaatacttttaattgcttattttgatattatgaattatttaaggttttcgaaaattcttaccaaagtcatactgtcgaggcgtaaacctctctagcgggagatcgtggtatccccctttgtgagttcggccgggggaaagagctcgcctctagaaatcacgtatccgccctgaaggctgctaggcagcgtgtacgcgacaagattatataggttcgggccgctatgaagcgtaataccctactcctgtgcgtgggatttaggttgagagttacaaaggttcctaaactccggagagcgttctcgcttcttttctcctagagctcagttttttgagagtcatcctctttctcggtgggcgaggtcctccttttatagctcaaggggataccacatgtaccgcctctacctactcttttaccggatggtgacccaccctaccatgatcggatatcgacccgtgccttcgcctggaagctaagccacagctcgtccttgagtagggcccagcgccgtctctcgcctgacacaggggacagtcctatcattccctcattaatgggtgaagacttgtggtggccgctctctcgtggagagagctccaaatgaccctccgatggaacgggtcatacctacctctactccgccggagacagatgcgacgtggtggcacggccgtccgtccagtcagacgtgaccggcgacaggccggtcacagaccggtcattcctgaccgacgcacgccagtcgggcacgccgcacgtctgcccctaccgcattgaatgcggcaagggtcagttggggcgctgtgcgcattaaaggtggttcagcctgggccccctccccgcttgctccccccgccagatggcagctgggcgagggcctcggggcaaagcggcacgagggcccgaagggcatgacgtggcaccccgaggccccccggccactcctgcgattcgcggggtgtgggggtagggccaggctgtaaggtcacgcgacaggatggaaaggtaaattcccctcacttcgcataccccgggcccatatctctgacacatacatatttt

SEQ ID NO: 100523 - DNA, 595 bp, Oryza sativa
agcaatgcaatggattattgggtctcgaatgcatattgctttccaccacctgcattctgtcaaatatacgaagtaccgcattctccaccatggagaatttctgtcctggtttctacatgagtgaaaagaaaccatagttataatgaatcaaatgcacaacaaagctcacaagaattaatataaaatcaaaagagtttctacattaaacatccatcataaaagctgcaaaattatgctatgtacatcacgcaatgaaacatggtgcataaaaacatttatggggaaatgttcaaacctccaaggctgatactgttatcgcacgttccatgcaccgatgaacaggtccaccgacatcaacagaagcaccagagttaacttcaattgctttgataaccatgccattctttcctatcaaacctccagcaagagttacagggcagagtagtctaaatgaaaattgcatgacacattcagtttgttcaattcctgtagcaccctgtggacaatcaatatgaggaatgctggtgtttgcacgctcagttgacatatctgaatacaaagatcccatttcaggctcaggcactttaggaaatgt

SEQ ID NO: 100524 - DNA, 645 bp, Oryza sativa
  unsure (1)..(645): unsure at all n locations
cagccctgctagaaactctttgaaatataacgttaccatctgtgtggtagggcggtagttctcaactcttttggctgtgttttttaacgactcgtacaagacaatacgaagttcatagtgacagagcaggaaaaaaaattacaagatcgtaaccaggaaaaagagaaaagaccaccactcacgcaccgacagctccaacatatggacctcagaggaggctagcaccgaaccagtcaccgctaagcgtgaccggccgcctctggccaacagagggactacaactgggatcgcccaagcctaaccctaacaaacaaacacagaactgcactctaaccacaattttgtgattgagggagagagggtgcaagannnnnnnnnnnnnnnnnnnnnctatgccttctgtcgtggtcaacttgtataagctagagcgccgacacaagaggactgaaatctagagcaagcttgcactggttgtctgggcggttttggttaggggttgcctagacgacgtctccagggaggagtcatggaaacaccaccggcgttgttcggtcaggcctcaaaggagagccgagactgaatttttacccggcaaaacccctagaggtgatgggacgtcacgacaacacccttaagagggaatgc

SEQ ID NO: 100525 - DNA, 604 bp, Oryza sativa
  unsure (1)..(604): unsure at all n locations
acgcaccgacagctccaacatatggacctcagaggaggctagcaccgaaccagtcaccgctaagcgtgaccggccgcctctggccaacagagggactacaactgggatcgcccaagcctaaccctaacaaacaaacacagaactgcactctaaccacaattttgtgattgagggagagagggtgcaagannnnnnnnnnnnnnnnnnnnnctatgccttctgtcgtggtcaacttgtataagctagagcgccgacacaagaggactgaaatctagagcaagcttgcactggttgtctgggcggttttggttaggggttgcctagacgacgtctccagggaggagtcatggaaacaccaccgccgttgtccgtccaggcctcaaaggagagccgagactgagtttttacccggcaaaacccctagaggtgatgggacgtcacgacaacaccctcaagagggaatgcaacgctcgaaagcgatgttgttgctggcccaaccaaaaacaggctgggttttcacccatcgtccgccacctgtctatccaccaatgtcgccgcaatgctccgccacgatcgaaacctccatcagctcatgggcactgaa

SEQ ID NO: 100526 - DNA, 532 bp, Oryza sativa
acacaaacctaggagagttagtagctcaaagctagcatcatgcagtgcagggcacgtcttggcaaagcatgcgagcacgcgacacctcttactcgtgagtaaatttactctttttttttgcgaaattcaatgtgatgacacgttggatcagccattaaattctaatcataatcgcaggatcagcgcgaaatctgaaggcgacatgatcgcacgaaggttctcgtgcaggggatttcctgtgcacctgtttcagttgcttactttagaagataaatttcggccgaatagggcttcggtaaatcgacattggatgcaatttttaacttgtttttgccttttgaggtttatgttcttgttaatttgtccttgatgaggcactattttttttctataataaatgattcaccggattattttctatgcttcgaaaactacgttctcttaaaaaactttcttctactttattgctataagatcacttgacttgagctatttatttagcttatttcttataaattatataacattccta

SEQ ID NO: 100527 - DNA, 1071 bp, Oryza sativa
cccgtcgccgtcgccctgggccggtaccgcgccgcccatcccaacacgccgagccccgtgctgctacgcgcgtcgcgtcgccccgcctgtcacgccgcacgccgcccgcccgtcgcgtcgccgccctgagccccgcgccgccgcgccgtcgcgtcatggcgcgtcgccgtcgccccgagccctgtgcgccgccgtcgccccgagccctgtgcgccgccgtcgcgtcgccataaagcggccaccccctctccttcttccccctctcccctataaatacccccaccctgtccccatttcttcctaccccattcccctcttttctcctctcttcctctctaccacgccgctgcgccgccgccctcggtaccgtcgcgccgcgccatgtgccgcgccgtgcatcgccccgccttgcgccgccgtcgccgccgccatcgtcagtaagccgccgccccccccccctgtttggtcgccgttgccgcccgggtaggtagagagccgagagggaagggagaagctgggaggagagaaaaagaaagaaaaaagaagagagaaaaagagagaaaaataaagaaaagaagagagaaaaagaaaaggaaaaataaatagaaaattagagagagattaaggaggtttagaaaatttaaaataattagaatttaattgtagattattggtagtcgtagaattgcaaagttttatataatcgtagattattttggagattcttaggagtaatcggttcgcggtagatattcggatttaattactaagaattgtattttgtgttgaattttaaaggaggtacttttgaatcacaaaatgacttagggtgaatgagcttaaaattggaataaagtggttttgcaaactttgtagtcgatatagaaagatcgattcgcgttcgacttttatttgagtttatttggattttatttgaattctaactgaattcaaatcatttcttcgcacgtaattttagagcccgagggagttgcggatccgagcaaggatcaagacccgcaggactacgagcaaggcaagtcatcactattctttgacatgttgtatccc

SEQ ID NO: 100528 - DNA, 637 bp, Oryza sativa
gcccgggctttggctggtggcctcctcttttgctcccatgtgtagacttgtgaattttggaccaattggtcgtgtcctttctacattcttggcccattcattgataagtctgattctcgacatcgttcaattgatagatcgcctgttttgatgtcgattctccttcattttatgttcattctctgtaagaggttatgtcacgtcctgataaattcatcccgaattaaaaatcattctctaaaaggaataatagaattaattaaaattcgaaaagaaattggcaaacactaaaatgcgtacaagaaaaattcaaatgtggcccggagaattcttgttaaattctccttggtctaaaaggagccctcaaattttagtggaattttcagagcacaagtaataaatgaaaagaaataaacaaagttaaaaaggtttataaaaagaaaaaccctaaaagaagtcttctttcccccccttcccttcatgggccggctgggcccaattccatccctctctctcctctcccccccccccgcggcccatcggcctcctctcgcgcgcgcgccgatgacaggcgggcccgcccgccaccctcgctgacgggtggggcccacctgtcatcgccttcctcccgccgctc

SEQ ID NO: 100529 - DNA, 585 bp, Oryza sativa
  unsure (1)..(585): unsure at all n locations
ccaggaaaaagagaaaaagaccaccactcacgcaccgacagctccaacatatggacctcagaggaggctggcacggaaccagtcaccgctaagcgtgaccggccgcctctggccaacagagggactacaactgggatcgcccaagcctaaccctaacaaacaaacacagaactgcactctaaccacaattttgtgattgagggagagagggtgcaagannnnnnnnnnnnnnnnnnnnnctatgccttctgtcgtggtcaacttgtataagctagagcgccgacacaagaggactgaaatctagagcaagcttgcactggttgtctgggcggttttggttaggggttgcctagacgacgtctccagggaggagtcatggaaacaccaccgccgttgtccgtccaggcctcaaaggagagccgagactgagtttttacccggcaaaacccctagaggtgatgggacgtcacgacaacaccctcaagagggaatgcaacgctcgaaagcgatgttgttgctggcccaaccaagaccaggctgggttttcacccatcgtccgccacctgtctatccaccaatgtcgcc

SEQ ID NO: 100530 - DNA, 2330 bp, Oryza sativa
gtactcatatactccgaaagtatttcaataccataaatgtatttagaagagtattttaataaaattacaaagcttacaaaagaggaaaggaaaactgctagagccatacccgaactcttccgaaggcttccggactcctgatttctactctattcctattccactagctagatactactaaactaaacttaagagaaatgagagagctattgcttgaggtgtgtgagtgaagtgagaaggtgaagtccttttatagctgaactatgacggttgtgatggttggaatggttggtaatagcctccaaccgtcattggggcttcatctcaatggaggcgagggaggttcagccgaacctggggccggttcaatccagcccaatttcggctggcggccttctccgttgttcttctccgcagacttgtgaatttttgcccaattcatcgtgtcaattctgagttcttggcccattcatacacaagtctagttcttgacatcgtccgattgatttatcgtctgagttgatgtcgattctcctccactttagtgtcattccctgcaagaggttagtatacctaatactagtggaatattattattctaacatatatatatgcattgcaagcatcactagttctcctctattttggtaatattgacggtcgaaactgatcaataacgaccgtcaacaaaaccccccaagcttgaacctttgctcgtcccgagtgaaggacgaaaggaaacaaaaacttggttgttgatcaggagttgctactatgctgcatatctcaaagatacatgtgtaaggtatatgtactctatctcagattaaataatctttggcacggtggcttacccttacccctgattcccacgagaccactgcttctccttgccttgggcggttgaaagacagaacaacaattagagcaccaatcacccaatttttattcaacttttatttcggaaggtttcaaatgattttgcaaaagaaagccaagttgctcaaatgattcactcagtctctccaagtgtatcaatttgaatttctcaccaaatgttgcctttttgattcctactctaaggtttgatatgtagagctcggtaggaatcagacatggcatacttgcattcacacttatcactaagtcaaaaacttagactagagcagataactaaacatattcaagatcaagatcgtgcaaaatgtgtgtgtggtatatggtggaaatggtatatgaggaaaaataaaagaaaaaatgcttctcatttgtgcttactttcttctcccaaaaatccttcttttattgattaggagagggcatggttacaatttttttttcatcatcatgctcatgtttgatggagcataactttatttctcataaccacgcctttccctccctttttttttcttttcttttcaggagaagaaagcacctgaaagcatggagaatttattttggtggtaatatggaaatggaatggaatattgcttagctcccagtgtaggaatttagcatgtgcataaatgtgggtgtatgatcttgatcatagagcatgagaagtatctacacaagtcacaagagtttgacaaagttcaatggaatgacaagtaaccaaaatgtatatggtttaatcatgatagcacatttttggctctggtaggaatttatatcaaatgaggaactctcaattttatcattttgaaagacaaaacatccggaattcaagtcaaactagtatccggatcacaacaactcatatttactatctcatatctcgcaacaacctagacttagatcagcaagtgtagctcatttacctcaggttcccggataattgttggctacttatatttaacttttgagagagcatttaccaagaatccatatataatagatataaaacagagcaactattcatcatttcaacaaagaggactagcttgtcttacctagcatgactcaaacctatcctatttttttggtattttctattttgcaaatttttatgttgttttcaagttttataagatgcaattggaaagcaaatatgcaattggaaagggaaatatgcaatgtgatacaagttacctcagtagggggagcgatgtctccctcccaagcttgactttcgctcagggtccttgataaggattgaacccctgaaaacgaaagtacgcctgaaggtcatcgtgctgttgctgcatcatgttgttgatgttggcgaactgagcattagcagattgttgccattcttgcgtttgagttatgtgttctgcgaggttgtactggatctcccccgtctgcatatcaaaggtgtccattct

SEQ ID NO: 100531 - DNA, 944 bp, Oryza sativa
  unsure (1)..(944): unsure at all n locations
attgattgatgaactnctnnnnnnnnnnnnnnnnnnnnnnnnnnnnnnnnnnnnnnnnnnnnnnnnnnnnnnnnnnttttaggcttgggtatgtggtatttaaaatgtatgtggaatgaaatgtgagaatgttgtgattggttgagaaaaaaaattagatagaaaatttttaaatgctgaaaaattgttattggttgaaaagagaatgtagatggagaagttattatattttaggacagtttgaaggctaaaaattgttatatttttggattgtgtaacagtagcttttccgaatctagattataacttgggagttttttattctgagaaaagttacggtggccggaagctcctccaaataggttcttgatcacacttcaaagtccaaagatcacgattcctttgaacttcttgatcacacttcaaagtccaaagatcacgattcctttgaacacatgatttttaaacaaggaataggatataagcataagaatagattatcacaagctatgtaatattacaggattttaaaatactatatatggacactataggtaacattttttgatggttcacagtaaatagaggaattttggaggaaatcatacgtggaagagtagagagaaagagagaatgtgcattggacttagcaaagaaaaataaaatatgaaatgtgagctcatgctaaatttcctaagaaatagggtgtaagaattgcaatacgtaggaatatttagtcctattcctttgatccaattttttgcgggccagacgggctggcatgcttgcctctggctcaacacggcccgccaaagtgttgggccgttcgtagtctccctgctcggcacgttgggccatcacagcacggcccgtttaannnnnnnnnnnnnnnnnnnnnnnnnnnnnnnnnnnnnnnnnnnnnnnnnnnnnngcatntcaacgct

SEQ ID NO: 100532 - DNA, 742 bp, Oryza sativa
  unsure (1)..(742): unsure at all n locations
gcatgtgttgatgacatgcagatgcnnnnnnnnnnnnnnnnnnnnnnnnnnnnnnnnnnnnnnnnnnnnnataacgagataaattaagtaacaggcctataaaagagtagagtgatggcggttgatacgccatataaaaaatgttaataaaacaacaaatagaatcctaatgacgattataaggagggacgtcgggcatgccgtgaagcaaacaagtaaggcagtagccgggacttctagaaagtaaaaaaatgaacccaaacgatattattgttcgatttttaaaatctcaatgacattaaagagaaaagacagtggacgggtcgtaaaggagtttaatggcaacgttggacgggccatttagaaattttaaaaacgaaacccattgggacattaaactttaaaactttaaaatccaaattttaaaggttccaaaaaaaatgaaatgggtctggaagctgttaagcaaactaataatcgttgtcctcggttaggtctaatccttactgcggggttcccggggcgcattttttttattaatttgcagctcaatcgttttggaattgacttaaaatcttaatgctaataagtaataaaaaatcttttttttttaaaactttcatacatgttgtgtaaaataaattttgacgtaggaactaaaaacattcaaataaactttaaaaattaaaaggtaaaaatcaaattttagctttggctagaagctaaagaggaagggatcgac

SEQ ID NO: 100533 - DNA, 733 bp, Oryza sativa
  unsure (1)..(733): unsure at all n locations
ccatgaaccttatgagccnnnnnnnnnnnnnnnnnnnnnnnnnnnnnnnnnnccagagtttcaaagaatatgtgatcatgctgatatcccgcaaacatgttacaggaagcacaattagttctctaatgcattcaaccttagataactctcgtgtccatcggacactctgccatattactggtataaacaagactaatgctatctattcgcatcacaatgattgtataccttgaattgaacgaaggatgcagattctaaccaatgtccatgcaatattgctgctgccggagctctcatttacagcgacatgagatatttattgctgatgtaaacacatgaagctttgcttctgacagtggcagtagcactagcactagtgcttaatgggctacatatacctgccaacaatgttattagcataaaactttaattgaccttatatggcattgtgattataagcagaaatttatcatgtgcttgtgcacaagatcatgtgagattggcacgtaaatagtgctagcccaggatcaaacagacactgagactctctttcacatgcgatatgttagccagctggcaaactattggtgataaacattattgagcactaagtatttagatttttgggcacttgccaacgatctgcgttacattatttacaactgactgagagctcgttactatggggctaatagtacatactgtcaagttcttttccaaggcttaatagaag

SEQ ID NO: 100534 - DNA, 719 bp, Oryza sativa
  unsure (1)..(719): unsure at all n locations
cgcggattgaagattgtataacnnnnnnnnnnnnnnnnnnnnnnnnnnnnnnnnnnnnnnnnnnnnnnnnnnnnnnnnnnnnnnnnnnnnnatatacagactcacgattctatattggttactgcaaattccgagctatagctaattttgaactggatccctaccagaactctgcttacagtttatttagctcagtcccgaattagcctaattgtgatcacgagatgtaatataagctcgcgcttgggaccgtacatgggccgtcgtacatattttgacatctcctatatttattaataccaaatttcagctatttttaaattggattcctacttgaactctcctttccttagctgatacaggagcataatataatactatctcgaacttagaataaacgagaattgggctcttatatggaaacttcgtccactagtgctaatcaataaatctgagaaacagctatttataaatggtgactacttgggctctccatgccctttataatcaccgatttatttttaatttaacataaattttaataaaaacacgagttgggaacctatatggactcttctaatgacatatcttattaaaaagaacgagtagtagctagtaaccaacgggacatcaacttggactgatcgtgtcttcgctaatggggatcatataactgatataaccaacttgggtaacaaggtgtggctgtcatacgaaac

SEQ ID NO: 100535 - DNA, 752 bp, Oryza sativa
  unsure (1)..(752): unsure at all n locations
agtatttcaggaatttagacattctccacatatttgagtataaccctttatttatcttcagaatgtacaacaaatgtctgtccaaagagaaaatttgggttggataggtcagtcaatggagcagaaacacatcagccggtaaagttctcctgcagcaatattataattttcagtttagtcaattctcaattaattgtaaagcgaaatttgtactaattaacagcacaaaaatattgtacgcgagctccccgtcgtcggacagcacgctggtgatgccgccgctgctcttcttcctctcagaagaaatttccagcaagccgatgcggatgctgttctgctgccctcatatgccccttttctttatgaagatagctcagagctgcaggactaaagagagtaaattttcagtccatttttgattcattagctaaccaaaggtaggaataaggaggaaaagctcagagttgtaggagcttaactgtctgcaaagatgacattttgattcgtatgatgatctgatctcctagtaggtcatgaaaaatgaagttattttttgatggaggaagtagaaaatagagagatagatggtgatgtaaaaatttgtttttaaagtatactcattcacatactttttttatgagatataaaccaataataatcatgggttccaaatcataagcttgtnccgnnnnctcccnnnngangannntgcntnccaggtttnnnggcattaatggngatcattaaccact

SEQ ID NO: 100536 - DNA, 736 bp, Oryza sativa
  unsure (1)..(736): unsure at all n locations
gcgcttnnnnnnnnnnnnnnnnnnnnnnnnnnnnnnnnnnnnnnnnnnnnnnnnnnnnatactattttttagagctaaccaaatgagcactttaattttaataggaatcttgaatctccagattttcttaaagggataaccactatcttgcaacttcattgccaattgagatcccctgcagtactgcatgtgcagtactgtaggctgacagggcccacatgtcagcctgcagtattgcacgacctgtgtcccttcattgcatagtaaaaagatttgacagtaaaaaccccactttttgtaagtgtccaaatgagcttgtctttcccattttgcaaaattttcccattacaaagcttttattaatggtctcatttcacagccatatccccacctagtgtccttctgaattcaaaggcattccaacccatcttaaagacctttgctattgttactattttagggaaagttatattatataaccgaaaatgctgcaagccgggcgcccgacgggggtggagcaaatcgggcgcttcccccgcgcgccccgttccccacaccggtgcatgcaggcgcctgggccccaccatgttttctgcccccacccgcatgtgtcctcactatattactcatttgcacaaaataaccccatttgttttttgaaaaccctttattaaaggaaattgcgttaattttttgttccacaaaaaaggtgttaacaatgggccttaccaaggtg

SEQ ID NO: 100537 - DNA, 724 bp, Oryza sativa
  unsure (1)..(724): unsure at all n locations
gcggaatganttcgtataagccnctgacannnaccccnnnnnnnnnnnnnnnnnnnnnnnnnnnnagcatctttgngccaagtatccatattgatttttgacgcggtcaccatctgtagactgcagtgttgtgaggggactaacctgacatttgttttcagtcttaaaggctccagctcacgtccactattttttagtgtttatgtttttttttagatttcattaaccttttgagatgttacgatttattaatgcaagcttcataggcagatatcttttttcctgaagtaaaacaaggttttatcacagctcggctgtatttggactgcactgcacttaatctcttccatatttttggttgcacaccgttgtgtgcagctattccatttgtctgctatactgtgcagatactacataattcatagaattggcccctttcgattttccccccttttggtgtggtttctgccttctgaaaacagtttgtttgatttcgtgaagcttatcatgagtggagatattgattctgcattcaaaaaacttggagaatggcatacacaggtgataaaaggtacaggtcttttctaatttctttgggaatttctaaaaaattttttttttttaaaaaacttattcatttactcattgcagttttcacaaacttttaatgtgaattgataggggcagactccaattctcgccctgaacttgcattttactttgg

SEQ ID NO: 100538 - DNA, 662 bp, Oryza sativa
  unsure (1)..(662): unsure at all n locations
ccgcgttgataatactnnnnnnnnnnnnnnnnnnnnnnnnnnnnnnnnnnnnnnnnnnnnnnnnnnnnnnnnnncttccctactaattcactactgttttttaggtcatgagaatcaagctgcactaggtgagaactagaaaattggcgtgcccttggcgctcttactacttacaaccaaatggactactctagcatggaccatacggccgcggccgagctgattcgcgacaagcgcatagccgtggttggttctggcaaatcggccttcgacaccgttgcgcaatgtgccgatgtaaacggtgagattgctgcaacagaacatgttcaccttgatcacattttccaaattgaatttgaatttgttatgacaatttttaccgtatgatatataatctatctatctattatattattaaaacagccgtgaaagaaggcaccacattcgctgtgggggctagaaattcccacattaatcgaagaaaaagaaaaaaagaaaaagaagagtccaagtagaagtccaatttaaaaatagctgaaattcggaattaaaaataagcaatattgaaagaagtttccatataagaacccaatacgatattaaccaaaattcgaaataaaaaaaaataaaatccaaaattagaaaaggaaaggagaggggtg

SEQ ID NO: 100539 - DNA, 751 bp, Oryza sativa
  unsure (1)..(751): unsure at all n locations
cggccattgtttatagtantactggctgcgancnnnnnnnnnnnnnnnnnnnnnnnnnnnnnnttttaactacgatttatctaactttaaagacttttaatgtttatgcctgtaattttgtaaatgttatgaacggtaagtttattacatgtaattagttttttttgctacaataatttaatgctcaactttttttatctacaaaaactttgtttaaataagtaacaagccctttcccttgttaacatacctgcatagagtgatatttgagaaatagaacgaatgcttcgatctcacatccttcctgtggctgaactgtgttgatggcattaccatatagaccagattcttactgattctagctaaaaacaatatttttaacatcatccaagatccatgactcataatcaatatgttacatctcatcaaagatcattacatacaccatcataacaatctcaggaaaaactatataaacccaaaggaatggatcaccttgtcagctaagagtcagtaacatgctctcatttcactactcaatttactaagaactaaccaattatgcggataaagatcaataagaactcaaccatttccaggagcagattcaaaggagatcttcacctagaaaagactgcaatcaacttattaggatgagatgagaaggtggtaccaaggcgttcatggagactatggaggcaagccagcttggcagccatgactcacaacttcaggaactgcaaagcaaggt

SEQ ID NO: 100540 - DNA, 1141 bp, Oryza sativa
  unsure (1)..(1141): unsure at all n locations
gaaaattgaagtgtacggggtgaaaaatgtttcccggggggtgccattttgaatttcctttcatataatataaattcgggcactgcaaaccttataatatataaggaattataagataaacgttagttttgaaaccccgtgtcgaattttgaccatgccttatattatggaataaagggagtagaatagaactccaatctttactcaacgagctccaaccaattattacataaattcggtgcaaaaccagcgcacatcatcaagtttaaaaaaccacgcccaaataattgaagcaaacgcaagctaatattcgctcacacaaaatagagcccccttatttttgaaatgcagatgttatgccgccgcggaatgtggcgagatggcaaagggcgagggggggggtcggctttctaattacgccaggctgcgaaaaggggaatgtggtacacaggaagagattagttgaacaatnnanntnaaannannnnggncgncggggcgtaggtggcggcggaagagtgtacagtgtgtacttcacttggcgcgacgagccggaggacggagcgctcagggtagctgggtgggctcccttcttgtttttttttttttatcttttcatcgaaagaaaattaactcgcgatcattttcaacatgcacgactcgggctgtaatttcttttcttgcccgattgacggtggggattttattattactggcaaaaaaaaaaggaaacacttacatgggccaaaaccgaccggaattaagaaaaaaagaaaaatacttactggtcgaaatttcgatgaatttgatcggaattttaccaaaaccgaccggttttcgagaacttgtcggcaaattcagggaatttgtattcaaattttgatttattaaatttgttcagaatttaacagttttccaccggatttcgcgaaattccgaattccgccagcgcccgaaacggaagggcttgtcggaatcgtaaaccctgggcgaaatgtgtcactactagaaaaatcgtttttccagacgaccaaaaatagctttttcatgtgcagctcgatacgtgtacatgtacctgctcgtannnnnnnnnnnnnnnnnnnnnnnnnnnnnnnnnnnncagcaggcgttctagngacac

SEQ ID NO: 100541 - DNA, 670 bp, Oryza sativa
tgaatgaactgtagagactgtccgtgttgttcagcgggtgaacagttttgactttctcatggagaggcgacgcaagttcgaattttttttcatttttaatttttttttcttttaatatttacagaaataatccatcggcacaaaaaaaattacaaaaatagaccatgccgccctccactagggcggcaagctgacgtggcaaacgggggagggacggtcggtgacggcagacggtagagggagcacggaaaccctagggcggcaaggggcccccatgcaaaaaagccagcccgggcctagtacttttttgctggtacttttgctagtcgctcgacctcaactctgcgactgtattcccctcgtttaatgtttattgcaccattcaaagaccgcttcagctactgactttcataaaattcgtctttgcgcctcgcctgaactcttcaagctcctccatatcgcgtgttaacgtttcccttttgccgggtggccttcagatttgcaactctcttttgcgccagtctatcattcttaccatttgctctgggttctatagctcccgtcatttgcgactgtcccttcacctgccagtttagccctagacgattgcccgcaccccattagctctcctcccttgttacccctttttttaaacccggcttgatctttc

SEQ ID NO: 100542 - DNA, 1814 bp, Oryza sativa
  unsure (1)..(1814): unsure at all n locations
tgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccgccgcccaccacggcgaaacctcccgcgcccgtcctggcatcgctcgagggtggcgtgaacccgaccacctcaccccgcgtcgcaaccaaccacgaacccccccaaccacagctcgtacgaggaaaccaaaacaacaggaagaactagggctcccggatctcaccgacgacaggtcaggcagggcgggggcacacgccgacacggcacggcacggcacgggaacgagcgggggggtcgccggggagcccgcgaggcggccgctgcggcggcggaggcgaacggatcggcgcgggtggcgcgaggcgttggggaaatgggcgttcgatttgtttggcgctctcgctttcgagttggtttttgaggaaggggaggcgaggagaagattggagagagagcgcgaaataagaaaaaaaaaatggagggaaatttttacggcggtgcgtcgatttgttctcttttcgcgcctttgttttgatggaaattcatgtttggtttgaactttcaaaggttcgatggatcaaaccatacccttttttaaaaaaaaaattaccatgggagtagtactattttgtttgccgtcaaacatttttggctttaccagcagtgatgttgacggtcacatgatattcgaatattcgaccggtgcaaattgtaaataatatattttgtaggtaatgaaaattcgaaatcttttcaaaaaccaaaaaaagggaaagggaaaaacacaaaaaagaagaattgattttttttttgcgtagcacgaactcctacttttgtgctttccttggtgtgccggtctctccacgtggcaagaaacgtgacacgtggggcactcacctgtacgttcgtggtcgtgcgacacccacgtcgcggcctcgcgggtgacctggtccagtcagtcagtcaccggcttgtatgcaaatgcaatgctttttctttatctcagaaaaaatgcaatgcaaatatgcgattaggtttcaattttcagaagtctcgggttccattttaaaatggcaacccatatattttgattggtataaaatactagtcattttattattaccgtgacaatttgtcatcttaaactattttgcacacccctagagcaaccacaatgtataaaaaatgtgaccttaagacgatgtttgcacttgtaaagtgggccatatacattgtggaaaatagcattagtttagggtgtacctcatgcttaagatctaccataagcaaaaagaaatatttttttctctctaattcactttatgaataagagatgaaacaattctttttccattgtatgtggacttatcttatggctaaattctaagagcaaccgcaatgtatactaccaaagtggataataacgtgggcccggggttcaggtggtaacagttattccaaagctcacaatgtgctatgcttattttgaaaattaagccccgggtccaccttaaaaataatcattgtaaaaccatctcctatagccatgctcgtgggaaaagattctcatatctacagaaaatattattctttattgtcttgtgngggtnccaagcgangtgtcattcaatgcacatg

SEQ ID NO: 100543 - DNA, 785 bp, Oryza sativa
  unsure (1)..(785): unsure at all n locations
aaaatctgtcccaaatattgcatgtcctgggtgcccgattcaagtacctttcaaccaaaaaacaacaaaactggtatcagatatattctgtagattcatgataaaataaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggtcaaaaccccaagatgctctatgtcaagctcgtcctcatcatcctcatgtgtgggcttccttcgtcagccttctcaactccgcatcntattcatcacaacgatgatcaccacaccagagtgagaaaaaaaacccttcaaattcatggttttattcgcagatttttttaaaaaagcaataaagttgtaacaaatattttctttttgaaagaataagggntacgatcatttaccacanagcttccacaatattgtacataaaatgtg

SEQ ID NO: 100544 - DNA, 659 bp, Oryza sativa
  unsure (1)..(659): unsure at all n locations
ccaaaaatcctactacaaacctaagacacagtcctgtctgaataagggttgttcagttgtttccatttgtcttcctttggtcgcatgcgtgttttcatttcatctcactcactctcttaacattccttttgcttcaggtgtgaccttacttatgttatatgcaaagacagagttggtgtgcaactctgacagagatgtacacaactgaagaacaagcagaactgtactacatactacttctactcaatcattctggatgataattcagtaatgtatgatcaacaagggacattttcttggtacaggtgaatggaagagtagacatgaacagaaaagaaaactaaaagaaacagaggttcttttcctgtacttccaatgtagattggctaccatatacacaagcaggagaagctctgacgttcaccaaaccccaactgatcaactgggaagaatttgggtggacctgaagcaaaaaaaatgtgcagtgcctttgcacccaagggatgactgaatctgaaatttgtttaggtaaactggtaaaatgagcttaccaaaaagggttctacataagccaggtagtgaatgtggtggaaaggcngacaccacacaagtcagcccaccaaaaccctggcctgaaaaaggaaaggaaaggaaagggg

SEQ ID NO: 100545 - DNA, 672 bp, Oryza sativa
atagcttggggtggatggaatttttcctgtggttttcatgtgaaatcagcatggaaggaaactttcccttgattttttcctacaaccaatttcttccatccgaaaggcgtgttaaggaaaactcccactgataagtatccctccaaaagccccatggaaatcgacttatagggtctctttaatatgtttgaaatatataggaaattcgaaggattatcctataggaaaaatatgatgaaaccccacgcgatgctgcgagagtttagtatcatagcaataagtataaataatgtgtaaaataactagacgacataagcttacataaattaatatggtttatgataatttaaatagtatatagaatgataataaggtgatatggctttcaggctttatgagagaagaaaaggagagatgtaatttgggctatagattaatcatctgaaggtttaaaaaaaagagatgacatggcttaatgagagaaaaaaaaattaggaagataatttagaccatagataatcatctaaaggctagaaacaattgatgtgctacggtttaattagaaaagagagaaatacctttaccaagtgaggatatataggatattataaaaatgattgagagatatagtttaatatatgaactatgtgagatgataatttacatatttga

SEQ ID NO: 100546 - DNA, 524 bp, Oryza sativa
ttgcaactatttaagagatccctgaatctttccagattatgtgcttctgaacagttggggatcatgcatcaccataatttgtctgggtgtgcattgtagattctactgcagcactggtgatcaggccattagctcaaaatcgttctttttctgtccatgaacagtagattctttcttggtttttgatatagattttatcgaattgtgtggtgtttatgtaattgtttggtttgggagttgtcaaaagaaagaaagcaagaacaagtgtaactggaagtccatttctctctgattttaaaatcacatgtaaaactctgacatgaaaaatcaacttttgatcctatcgtctgcctactgtcaccatcctctgctctaaagatcttctatctcatattgacatccctgattgctgacctgccagatgaatgctgtcaaactccaaaaagagtgatctactgaaatttctttgagcttctgctagaaagatgctgtacaaaagatgaacagatagctcaaaaagctca

SEQ ID NO: 100547 - DNA, 731 bp, Oryza sativa
  unsure (1)..(731): unsure at all n locations
ccgtgcagtgattcctgatagcactncacnnnnnnnnnnngnnnnnnnnnnnnggggggggggnngggaangggggcccccgaagtttccatataagaacccaatacgatattaaccaaaattcgaaatagggaaaaataaaatccaaaattagaaaaggaaaggagagtccaagtagaagtccaatttaaaaatagctaaaattcggaattaaaaataaggaatatcaaaagaagagtccatataagaacccaatacgagattaattaaaatttaaaataaaaataaaaataaatccgaaattataaaaggatatatgtatggcacatgaatggacaagtgtgtacacatgttttgaaatgtacgtagatcaactagcacaataacacaaacagttcaatttttaatacatcctgtggatcttgtgagggaaactaaacttgtgcaaacagttgccaaaaaaaaggtgcaagcactaccacatttatgtgtgctaagcatatgaataggcagaattgtaacaacaggacaagactggagatatatatcgaggtcctacctcaaaagatcatcatagaaatctgggttgtccttcaagttgatggttggaacagaagcatacttaggtcccagcttctcagaaatagtattcggctgcagatctatcaagaaaaatgcatggtgcaccgttaaaaagaaatgatggaacatcagagaaacattnttttgta

SEQ ID NO: 100548 - DNA, 702 bp, Oryza sativa
  unsure (1)..(702): unsure at all n locations
cggcgcagtgagaactcctnnnnnnnnnnnnnnnnnnnnnnnnnnnnnnnnnnnnnnnnnnnnnnnnnnnnnnnnnnnnnnnnnntttcttcttacaagatggattaactgtggttgagtgctaccagtggtgtcagcattgtggcgagaagactcaggaggagtctattgatagatttgattgatttttagtaaatagaagtttacgggggtaatttacaaaactacaatgagagcagatggtggtgtcagccagacaaccaccaccgctacttcttttaaagtacttccttcatttcatattacaagtcgtttgacttttttcttagtcaagcttatttaggtttgactaactttatagaaaaatataggaacatttttaatacaaaacaaatatattatcaaaatatattcaatggtaactccccgtcaagatggcgacaatgacgtcgagcgcggcagcaacggcggagggacgatgagccatcttctggagacccgattagagcaccggccgccgccaccgtcggcggcaccaccaccgatttcccagtatggcatagtcacggtacagagtgcacaggatgttgacgcagccatacctttaacccttggtggtgagggtgttcggatttgggtgcccgtcgatatgcccagctttaaccctttgttgtgagggtgttcggattccggtgccgttca

SEQ ID NO: 100549 - DNA, 720 bp, Oryza sativa
  unsure (1)..(720): unsure at all n locations
ggggctttgaatgatatgcgccttnnnnnnnnnnnnnnnnnnnnnnnnnnnnnnnnnnnnnnnnatactttctcatttgtttttagataggtggggatgccatccaaatagccccttgaatgtgccaaggaaaaataaatactgggagacatttaatttccttttattatgcacacattaagtacaataggtttcctaaataatgaagcaacaaagtacaccgaatacatatacttttgtgaactgtgatgaagcattacaatgctggacacacaattaatattggctgtgtttcctcaatgtattacatttatacattggaagtttatgtaaagtttatagattgaaaacctctggattgaactcgaacatccatctattccatgcataaataaataccaggaaaggtgtttaggtgcgtcaaaaagagaggacaaccaattggcactccgagcacatgtgactgaacgttcactcattagggtttttgatagctccaagcttccactaacaagcgaaataggttttttgccacttatttgcaaggcggaagtaaatggcttcgctctataattaagtggggtattatccttatatatttttggattttttaaacggggggctatttatataaaaaagatgaaaaggattactacaatagaagacaaaaaaatactttagtagtaaacattctagaactaaatacataggaaaaaatgg

SEQ ID NO: 100550 - DNA, 541 bp, Oryza sativa
  unsure (1)..(541): unsure at all n locations
agagattgaanattgaatntttgatagaacnnnnnnnnnnnnnnnnnnnnnnnnnnnnnnnnnnnnnnnnnnnnnnnnnnnnnnnnnnnnnnnttgcgtgcatcttagttatgtagaggttgagaaacgctcaggggtcttccggctagctccacaaggtggtgggctagccggcctaggttcgaagccttacccccttctatttatttgatactagatccttccctaatacctgtgttttcttttttagttatgtagaggttaagagtgttcttagtacggttgtatcaccttgatgtaaattggctaagttcaataaagcttccttatcttaaaaaacaataaattaatgtgatctgttccaaaaactagtgacaaggaccaggtctccaacagttcctgcaggaacttgtcaaacaaggggttgttcttctggtcacagctctcctgccaaatctataagttgctctctctctttgcctaggtttggagctctcatcatcttttgctgtcaagccatgcattccattgcctcctgaga

SEQ ID NO: 100551 - DNA, 715 bp, Oryza sativa
  unsure (1)..(715): unsure at all n locations
cggatgggtttgaaaaccnnttttgtgatcctcatggtnnnnnnnnnnnnnnnnnnnnnnnnnnnnnnnnnnnnnnnnnnnnnnnnnnnnnnaaccattccaaaatatagtatcccatcaaaaaatactcaatgtgtacagttggaatactatattgcgactaattaaacactctatgcgattcaaaataaatttatttttggctcttacggcctggcctcaaataactttatttttagtagttattatctccgagtttgggaaatagcaaatgttgcactgggaggatgtcacgttgcaataactatagttagcatctgataaaagtgcggataatatagtgttgttattgtgtatagacatgtgtgggttggatgcaaaatgatctcctttttggatatagagagagagcgacatgctgtcatattttggccttggatagttgggaaaatgttataaatttgggcgtgacactggatatacggcattacatttgagatattaaaacgtgcctaataacaaaacagagtacacgattcaccagaaaactgtgagacaacatttattaagcctaataattcatcgttagcaaaatgcttacttgctcacacatatagtcaaagcatggggtaattagacttaaaagattcgactcataatttacacgtacnatgcgtaattattttatttacatttaagactctatacatatgtg

SEQ ID NO: 100552 - DNA, 1189 bp, Oryza sativa
ctgacaccaaaaatatttcatcgtctattagataaaaggtagattaagtgcaaacatacatcatctgagtcatgctccaaacatttgtggatggatgtgttcacttataccagcatgctgtctaattggtactcatgtttactttcttagtaactgtacacatgacatgcaagatacctacgatgttaaatttgtgcaaagtaagaaatatcggtgttattttgcgattacttataatagcgtcaatctatctattatattattaaaacagctttgaaaggagacatcacgttagctagaaattcccatattaatcggagaaaaagaaaaaaaatccaaaagtagaaatacaatctaaaaatagctgaaattcgaaattaaaaatatacaatattgaaagaggagtccatataagaacccaatacgagattaatcaaaattcagaataaaaataaaataaaatccaaaattagaaaataaaaggagagtccaagtaggaacataatttaaaaataactgaaactcagaattcaaaataaggaatattaagagaagagtccatataagaacctaatacgagattagttaatattcgaaataataataataataatatctgaaattagcaaaaagaaaaaaaaaagttcaagtaggaatacaatttaaaattaactaaaatttggaattaaaaataatcaatattgaaagaaaaatatataaaagaacccgtacaagattaattaaaattcagaataaaaaacaaaataatatccataattagaaaaattaaaagagagttaagtaggaataattttgaaaaaactgaaattggaaaataaaaaaaaatattaaaagaacactatacggtattaattaaaatttgaaaaaaaaataaattctgaaactaataaaaggaaaaaaaatatttcagttaggaatacaatttataaataactaaaattggtgataaaaaataaagactgttgaaagaaaaagaccatctaaaaagacataatgagataaattaagtaacatgcctataaaggagtagagtagttgcggttgatacgacatataaaaactgttaataaaacaccaaatagaatcctaatgacgattaaaaggaggacgacaggcatgccgtgaagcaaacgggcaaggcagttgccgggacttttagaaagtaaaa

SEQ ID NO: 100553 - DNA, 653 bp, Oryza sativa
tcataattatagcctaactctagaagataactaaggtagcgaaataagactagaaaaggcttatacggaataatctttttgtacgcataaaggcaatagagaagcttacatttacataggatcattcacgaatgggcctaaagagtgtctaataagaatataacgcacaggacgcttgcaaaaaaaaggaggaacaaacatctatctatagatgggcttgtgctgacatcatctatacgtgctttgctccagtgcaagtcctaaaatatcaggtttgtacgtgtcagtcagtttgatactataactgacaagatagataaattgatgataaaagaaccgatcagccaataagccgatttgatatggtcttgaacaattggctatatgtccgaggtaaattctaacgctcagataaataatgatataaagacaatagaagaacttgaacaatcaatccaatcgaccgatgataatataatagagtagatatccaatgatatgtgccgaagttgtatttatcgagagatattaatacatgggtagatactagtctgtttgaaattcctggctcttgaggcgccgaagtgacctcttccaccgcgccgccgcctccggtaacgacgatggccgagacggtggacttcgcgagcggc

SEQ ID NO: 100554 - DNA, 687 bp, Oryza sativa
taaatacatcggagtttgaaaaagtgaagaacattttagccttttgactttatattaatatgcgtgagataggaaaaataaaatattttagacagagatagtgttataagtatgaagaatatatttatttgttttttttaaacaaataaacttctgtctactaccttcttcaataaaaatcatttttatatttttcccgttccaaaatataagcatttatagctatgaatctgaacatctgcccgtctagattcatatataaaagttgttatattttcatatagaggtagtacatgaatatggataggtactcttgtatgaatctagataaatggttgtccagattcatttataaatgttaacattttgctaacatagttgaaaatatttgcatgaaacacaacatttaacagcttgagaaacatgctcatgaaaaattaaaaaagaagcataagttgataaaatgatgacataaaaatagagcctctttggatggagggagtaaaagtgtaagacaattaacatgacgattttggtgggattatatgtttctggcacacgagtaagagtatcgtttaacagtttgagaaacatgctcatgaaaacaaataaaaaaaagtagagtaagctgataagaacgatgactagaaataaagtctttttagatgaatagagtaagacaattga

SEQ ID NO: 100555 - DNA, 704 bp, Oryza sativa
attcctgcagccccagaagtagtgaaaacttcttctcctgagctcaattcctaccagagaaacaaaaaatatgaaataagtgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaac

SEQ ID NO: 100556 - DNA, 1494 bp, Oryza sativa
tttaggagaaaatttgtcgacaaatgtataggtggtccctaaaattaatcatctgtcttattttaaaaattatatttttttaaaaaaatgacacacataaaacactatttatattttattatctaataataataataatactaataaaaaagataagatgtacttacggtcaaatgttgggtaaggtaaaaaagggagcgagggagtatacaagtactcgatcgtacgatcgtagttatgcatcgacacttcttttgcaggacaaaaggttgcatgaacgtgtatcggtgtattttaatttcattcgtcacaagaaaaatgaggtgtatgctgctctgagtcccgtcggtgtatttttgatttacaaagttaactataagtcaagctatatacaaaacggaaatataaaattgtaataaatggattcatacatcaattaacatgctttcctgccaagttctttaattagtatgcacaatattattctcgagctatattacaaaaatcttttttttttaaaaaggagaatgctaaggggacgggacgatcttgtcccctgtccgcacggtatctcctccaattcttgtccgctgtttgccgttgcccataggccggccccatccgcccaccacatgtgtgccctccaacgtgtgcgacgccgctaggaacctcacatctccctcggttcgacaactaacttttagagcaagtttaatagtataggttgtgtctagatctaaagtttgaatccaaactttagttcttttccatcacatcaacctgtcatgcacaaaacttttcagtcacatcatctccaatttcaaccaaaatctaaactttgcgctgaactaaacacagtcatagtctactactagctccaaatcatctatagttaatgtaatagtcaattcatacaatagttgcttactatactattaatacatagtcccacctgtcatatacacattacgttggtcccacctgtcatacacacattacgtcttggagtccatgctacagctggctacagatttgtagcccgctgttcttctctctcttcctttatctctttaaaatatgtttatagctggcttatagcctgctattgtactactacacagatcattttcccgtgcggtcgaatcagattttcacgtgcggaggttcggcccgtctggggcaattcgtttgggaaaatcgctatttttgtgtgcgggtggcggaaccgcacgcgaaaatcggattttcgcgtgcgggtgcttatgttgcccgcacgcaaaaataaaaaatcgaaaaaaaacaaaattgaaaaaacgaaaccctaaccttagctgtcgccaccgtcgccgtggccggatccgctgcccgctgccgtcgctatcgccggattcatgcggcggagggccgtcgccgccgccagatccgcacagggaacggccgccgccgcagtcacgccgtcggatccgcgcggggcggggggggggggggggaggg

SEQ ID NO: 100557 - DNA, 564 bp, Oryza sativa
agtaaagtatatacactgaggtgagtttactctagtatgtcataaatattgtttgggtgttgtacttactgtggagttctttacataggctggtacaaagagaatgttaatgtaaacattagtgagcacactagcaaagttagcatgcatgcaaccttaatgtaggattcaaagggttgttagcttttgaagtgtcatgagtatcccaattggggagttaggtatgtatcctcttagaagaagtaaatgatgttagtagtatagacgatgtgcttattggcattcggctttctagcatcattagaagcacttaggaggtaaatttgtatctgctattagatggaaacaaccaggggtaatccatcaggctgtgtcagctatttcattaaactcaatttgggtttgcaggttcaataatttggaagaaaaagtgagcaaggcaatactttcaagtttggcatggactttatttattaccatgttcactgccttgcattagtagttcaaaattccctttgatggtaaggatgtcaaattgtgtttgctgggcttacagactttaaa

SEQ ID NO: 100558 - DNA, 609 bp, Oryza sativa
cgtgacaatggaattagggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctgtcctcgacgccatttgcgacgggagggctcgggggacgccgccagcatcgccaccttcgtcctcgacgccatccgcgagagagggctcgggaaccgccgccgcctccctcgacaccatccgcgcgggagggttcgggagccaccgccgccgaaccatccgacgcgggagggctcgggagcaacaccgtcctga

SEQ ID NO: 100559 - DNA, 665 bp, Oryza sativa
atttattgggatcaattgtttccagagtgtgcaaggggtatgtatggtgcttcagggtgctggtatattgcacaccccatgataatttgcctatacttccatgaacatcggaagtgtgtcatgttggtgatagtttgagggtgctatatgcttttcttttcttttctttttctttttttagaaatcatttgagaactgcttttaccacaatatatatgatgtactttcattaacaatgtaaagatattattcatcaaatataaagatattgatgtggtcctactcaatgaatttctgatgtttctctaactctttttttgtatggaaataataatgatgcttggtttcttctccgttgcaatgatttatttcttgccaacatagattctatgtgcattattgaaactggtgcttatttttcattttcaacatcaatgaaaatttacatgaagtttgatttctctctaaaatagaaatggactgtcatgtgtgcatatcgagtccgcactgtagaatgttagacttaatcaaggttttgtacctctatctgtgagattggccttatgctctggagataatttgtttcctgtgtttcaacagtaattcactaggtttatcccttgatgaacacaagttctatgtattatgaatatcaggaggggaaa

SEQ ID NO: 100560 - DNA, 1132 bp, Oryza sativa
caccaatgtaagtatactatagcagattgactctttgagatgacacctagactcatattgctagccagttgcctgtctggccatctgtgggccaaacatgttataagctaactacttgttttatagctcttgaatgtccagattaaaaaaataaaaataaaacatcaatgtatcttatggctggattttctggctcacttattttgcaattaatgttgttcacgaagtcactgtaatttatcagcttcttcgtgtgcacaggtgtgcatgtgaaccaaaagtggaactctgctagtgggtacctataatggtcaagtaaactggaaatgctgcatctggcatgctgaatctgaaaatagagcatagcctcaaatgaaaatcttcggagttagagattgttgcaaataccgaaagatattatgatggtatatgcttctttttacagccaattggaaaatccatgaagcggttgctcgacgttcaaatgcccataacaggtcttccagtgcatttacaaagttcaatgaagcagaatcttctagtgtcccaagtttttctagaaagctgtcaacctcagtaaacagagacgaagtcctctcagtaaggagcctgcagaaggtgtaagatttaatcactgatgaagaaaaaaaatacggaacattatgaacataatcaagtacaatatcaacctaatgggaaggtcaaatccacaatcctgcaaagactttagaagaagaatggcatcatcagtctgctcgcacaaactagcagccctgatgaaacttgtccagacttgatgatctggttctacaccatctcttttcatttctaaaagctttgtgattccaagactgtagtcacgatttctcaagtaagcatcgagaacagtactgtatggtaaagtgctaatttccaaattagaagatttcaagctgttcaggactttctcagcttcgtctgggtgcccagaagtcccataagaagtcatgaggatatgcatagtagcgatggttggttcaatcccatcctctttcattgctgatagtaagtgctcggctttggaatgcatgcgggcattcctatatattttcatcatcatgtggtagatagatctatttaaccgatatccctt

SEQ ID NO: 100561 - DNA, 831 bp, Oryza sativa
  unsure (1)..(831): unsure at all n locations
cagcgtggattgagatcttaggacgcnccaagngnnnnnnnnnnnnnnnnnnnnnnnnnnnnnnnnnnnnnnagctctctgttagtgtaaggaagggagagataggagagaccatgggaggaagaagaatcaaatcaagaaaaagggacggcaaaaggaagggagatatggatgaatggatggatggatggaggggggagagggcaaatgggcctattatgggagagatgacagggaaagagggactcacactgcctctccacatatgcccccactttggatgataccccgataccttccctttcctcttcccctcctacgtcgaggattatatagtcccgcgcggaccggggaaggccaggatagcgctcgccgtggcgactgtgtgtgtgtgagggggggggggggagacctaccctgtgtctggactgcactgcaatgaaaatgctgcatatgtttgactgcgcaccgcaaggtgccactatttcatttgtgtggtgtacggtgcaaagtcctactaagtcagcggagggtgccgctctaactggccccccttatggggaggtgtgtggctttgaaaacagaatgttggatcccgagaggcccaacatggtggagatatagattctgcattcaaaaaactcgcagaatggcatgcacaggtgataaaggtacactccttcagctgaaaattgattattcatttactcattgcacattatacaaaccttgaaacgttaattgataagccccggacgtcaatatgagccgtccacctgcaatttacattgtaatacaagactacgaggtgggcaccacttaaatccgtgg

SEQ ID NO: 100562 - DNA, 725 bp, Oryza sativa
agctgaaagaaacatggccctaatctcttgactataaaaataatttactataaagtgggtctaacctcctctctccttcctaccttttctctctcccctcctatcctgtgcgcaggctagcacggtttcaccaatcacgaagagctgagcatggaatgaggctcaccaggtgtggaggaatgtgttgtagttggcgcttattttgtggcctgcattccttctctctcttctctctttgaaagcaccaaacaatctaacatggtatttttgcatctaataaaacaattctattgtacctgctcctagagtaatcgggaaggtccaccgccgatgcaagaagaacaacgagtaatcgggaatgtatgggctcccaatctattgctaattatactagccgacaacccatgcgttgcacgggctattgctattaattttataagcattatgtttttctttgtattctgattttaattcacgctaaagccttactgttgttttttttggagtttttttattaatttagtttagaaattatgaattactaagtatcaagagagagtcttaattatatttttttcaccatttaataatttttaattcgacaacaaatcaatagcgagaatagtgagttgtgtttgatattggcatggagtcacaatccaataaaaaattcgacgataaaaatttcttattgatggctttgggcacatatttgcacgtgttat

SEQ ID NO: 100563 - DNA, 836 bp, Oryza sativa
  unsure (1)..(836): unsure at all n locations
gacgaggacgaggaataattcgaaggtgtgttgtggaanttcgagaattaaagaaagagaanagtgaacaatctaanagggnctcnanatatactaattaccatncnggnnccctnntnnnnnacaacccccccccagcggcggaannggggagcgactcngtaggnaancnaccanannnnnnnnnnnnnnnnnaaaananannnanannanaaannaaaaaaaanaaaaaannnnnnnaaataagaaagantaaaataattaannatttttatttttataaatanaaacacatcatataacaaaacgggggggggggggggaagaaaggagggggggggaggcacaaangcacggggggggaaaggggaaagagaagggggggaggagagggtgaagggggcggagtgatgggagaggggggggagggaaggagagggcaggggggagggggatgacgaagtagggggggggggggatggagggacaagggggggggggggggacggggaaaggcggacgggggaagaggagagaggggggagggtggcagggagcgacaagagagaaggagggggaagaggagagggggggagggggaggaggggggggaggggggggggggggggggggggggggaggggggggggggggggagaggggggggggggaggggagggggggggggggggaagagggggggggggaggggggggggggaggggggggggggagagggggggggggagggagggggggggggaaggaggggggggggggggggggggggggggggggggggggggggggggggagggggggggggggggggggga

SEQ ID NO: 100564 - DNA, 686 bp, Oryza sativa
agtagttcatcacaaagtggattgatccgaagcgcccaaaaccaggagagagacacacgaggaatttttatgggacattaggaggcaactcctgatacaaaagaagattaggtcttagtgcagagatcaacaagaacaagttggcagtttacagcagcaaacaggtagccaggtacggtgtccaggctccaacccacctcctcgtgacgctccatggtggggttgaggaggagacggccgcggagacctgagagggaggccaatattggaacgagaccgcgagagggaggcagcgcggggaggaggcggcggcggcggcggcccagctgtactgtggaggaggtcggcgaggagatcgaggcggcattggctttggggacgaggagcggaggaggggcacacgccggagaaggaggcggcgaggcgaggagacctccggcgagcggcgcgggctctcgcccaccgttgatgctacatccaatggtagaagtcgctcccggtccgacgaactgatggtagcaaattttgcagaacagcccttgatagaatgatagcggtaaaaacttttgcaagattgggatttggtttggtttgggccggctccaagcgcaggagtccaggagagtggaatttccggcccgtttcgtcatgtgagccgatgggccatatgtgcgatacagagctag

SEQ ID NO: 100565 - DNA, 580 bp, Oryza sativa
tgcaacagacagttctactacagcgactagatcacacccaagtgttagtagcataatttggcttttggttaggtcattttagacaggccaaattatatagaatagttggtgtaattgttttagtggtttgcttaagaattggttagcttgactagggcaggaatttgtgatgcaccgggaggtgtacgagttgctggggagctgcagaaactagagaagaaggttgggacttgggaggctgcaattctcagattttgtcagttcaagcagcttagcatgcagcgatggagcttttgccgattcaatggatgtgaggcttcactggttgattttatgtggctggggttggatgcatggctatgtttgatgatatgcctgttgaagtctagccacacaggatcacattgttgccagagcaaggggagacaaattctgaaagttgggctggagcagcgttgcaggatggaggcgactttcggctgaggcttgtatacgtctacatggaagctgtcgttaaaaaaggacggttttcattacatagaattaatcacggatttacctagagtttctatatatgcag

SEQ ID NO: 100566 - DNA, 523 bp, Oryza sativa
acatggcggttttacagatggctcgtgagaagaggtcgtgtccgagagcttcagagacgcagcagaacaattcagaaaagaagggaaaggtggatggtgagagtgcagctcgagacaagagggctatcactgtcactgtagatcctgaggttctggaatgtgatgtctgtttcggccctctcactcccccactttatcaggtaaataagcatatattgatccttcttcttgctgatcatgattccatttacaagtttgtttattagtatttactttgctcttcgtgttataagtttttcagtgtttcagaaaagaaactttaatcatgttcaggtcatatctgcattatctgcaaatgtctcaattcttaactctttgtagtagaacgtccagtgattactcattcagtttcaagtttcaacaaactgacacgaatatgtgctgaataatcatcgaactttgatcatactacaatattatttcagatttataggactgtctgaacattctgaaccagcattcc

SEQ ID NO: 100567 - DNA, 569 bp, Oryza sativa
ggcctgatgcacatcgcgcagcagtctggcgccattagtggtgccagtcggctattgttcgaagaaacgaccagttccgccgcgaggggctcgataagccgccgatccacatctacaacgactttgatactgaagagcagcgcggggacattgtaggggcgtatgtaacggtaaaaactgacgatggtgattaccttacccatacgatgcgcatcgatgccatctactccatccgtgaccggtctgaagcatggaagaagtacaaatctgacaacagcaagaagtgtccatgggtcaccgatgaagagcagatgatcctaaagacggtcgtgaagcaggcagcaaaatactggcctcgacgtgagcgcctggatgccgccatcgaccatgttaataccgagggtgaggaaggtatcaacttctcagcagaacgccagccagaacgcgatgtaaccccagcaggagacgaaattatcaaggagattaacgacgtccttatcgcaatggataagacatgggaagaaaacctgctcccagtctgttcgcaaattttccgtcgtgatattcgc

SEQ ID NO: 100568 - DNA, 894 bp, Oryza sativa
  unsure (1)..(894): unsure at all n locations
gtgtgnannaatcgagtgatcagatcgcactgtagacncatcaattacagggcggagttcaattattagaacgtacgctttanaatcactttatacatggntgtgtccccgtattatttctngatgtgcactacaatcannagaacttagacagcactctcgtgactctagatcacannngccgatatatcgatgagtgccaacaacatgtaagatattatagtactatatgattgactgaatggacatgccttggagataaagggatagtggacgctctgtttatcgtcgtgtttcacaaagctatagtgaaaactttaggcatctagctttttatttttctgaaataatttatgtgtcacaatacatcacgccatgtacattcactagatctatagaggggtggcaagtacatctgatatgagcttttgtacaaattacatcagatacaaaagtgaatgatagtcactataatccatcctgaaataaaatatcgcatgtttcttttttttggcaaaaggttaagttgttgtgccgattgattaaaaatgttactgaaacaatgaattgtacttattccaatataataattcagggcctatgtggcataaaagaacaattnctgcgttcatatagatttggaaaactaccttaaatctacttccccatagggaatgcatacaattacaatggttgtcttggttaaaaaaaaagcagaaacgatgctatgaaattcaatcattttttaattcccctacaaattgcaaaatacctacataacacacataaaatctattttttggctaacaaaacaaccctggtaattggtgtttaaaaacttaaaaaaagggattcggggcccaaagtcgatcccaacagggtaaccgattacat

SEQ ID NO: 100569 - DNA, 583 bp, Oryza sativa
aaacataagtcacgagtaaagtattattcatatttcatcatctcgtaacaacaaaaatctaagtattaaaaatttttaaataagacggacgatcaagttagacatagaaacttatggctgtactattttgggacggaggtagtacagtagtaatactgcaacaaaattttactgcacaccagcgttggctattgaagcctgtacacgatatttctactaggatgcaacttgaagcctgtagtacgtacatttctgccacgcttgaagcctctatacgactatacgcctcttttgcagatatcgacttgaaagttgaagcaagctttggactggtagtccccccttcccaaaataagtttatctgattttaaaataaataaacctttttataaaaaacatatttagatattagaaaactatccaaatttctagcactagccaacctaatatcgaggatatgagacattatatatatatatccagattagtaggaggttggttattttttggcaaattttgccataggacatcgtgactttgcgattttaactgtaggacaccgcgcgaagtgatttttagggaa

SEQ ID NO: 100570 - DNA, 752 bp, Oryza sativa
cggttagtaaaaaattaaaatgctactagctgcacagaaaactccaaactgtttgctacagcgaggttaaaaacgactctcaagtgagaatcagccaggttgtgccacctgacatccaactcaggagcttcagagatgctgctgatttcagatacacatctgctgaaaatgagagtgacccgtgactagtgcctaaactcaaagtgctactgtagtacagacagctcacggctgttagcaatcttcccatttttggatcgtccgagttattagcagaattgattgcaattcttataacgtgatttaaggagaggaccgacgagatttctgacattttggctttcagacagtggaagcttaattgcagttcgtcctggtcttcttggctggagtaactactatacttcagcttggtagtggtaagctagcttcagtaacaatttgtttgggtgatcaaatttgtttactccaagttggttaattagggaccagggagggtgaccaccatggagatcaaattgagatactacaagtaaacaatacccatcgagaccatgatagataggctttccaaacttcctagccagccaagcataatctgaactttttagtatctgtggaggcagagccaatctgtgggtgccacgtcacttttcacacagaggcagtacaaagtactacaaagcagagctggtagattgtagtacgtggtagatacttacttactcctaagtcacgaaatagtttaactt

SEQ ID NO: 100571 - DNA, 629 bp, Oryza sativa
gatcaaatgagatgagatccgccattgccggcagcatgggactctgcgcttcactttacttcctactgtgcacagcccttctatatctgagctgtgccacgtactaataagttgtgtgccgatttatggaggagaaaaacatgcaaaactttgggccatgcccggttaaatctaggctgcttatatactcccttcggttttattttaattgacgctttgaacaatgacacgctctacgagatatatctttgaccttatttttctattataatatatacaacaaataaatgcatgtttacttttattataatgttttgaaagacaaatctatatatgtttttctagtttctttaaactaaatatttttaatattattgatggtcaaagttataaaagtttaacctcaaacttatccaaaacgttaattaatttagaaccagagggagtactcccccgtttataaatatttgataccgttgactttttaagcacatgtttgaccgtttatcttattcaaaaacttttgtgaaatatgtaaaactatatgtatacatataagtatatttaacaatgaatcaaatgataggaaaagaattaataattcctcatttttttaatatttaaaaaag

SEQ ID NO: 100572 - DNA, 518 bp, Oryza sativa
ttctatctcattcgatttctatgtttttactatggtccaattaaacggccattcctattttttttctatgttttataattacctgttttacatttgcatatctatcagaatcccgtgttttttctatttcttcgttttttttcatttctgcgattcaaaaggacctatattttatattattatatcttattaattttttataactatttaaatgacatataagaaacaacctatatcctcatgagatgaactcatgaaaacacttccctactgccgcctctaacaagtacctctacttgggggcgcaatgttgttctagccttgcatattggctttggtggcgacagccgaatcgattgttgtgttgtgctccgacgaagtttgttgtgttgtgccgtttgaagatgcagtggccctgtagttatgctgcatgtgacaggtacaaacaaactggccgacacaaatatgtcaaacagattgcccgccgttggttcacgggcttatggagatgggattgg

SEQ ID NO: 100573 - DNA, 677 bp, Oryza sativa
cctatctctgaagtcgatatccggcttcttgtcttggcgcatgttggcttgtatgtggatcttgtgtcttgatctattgtttcgtgtcccctctcctcctagggggccttgtatttatacccatatgtccccttgtccaagtaggactagggaaaccaatatggatacaatccgagtagtccttgtcgtttccatgtaaaactctattcatccttccttatgcagaactccttctatatctgaaagttgtttccgtataggacatggtatgtggtgggtcctgccgagatttagtcaactattattaggtatgtggtatccataaccttgacagaaaccaataattatcaagttgtaactgaaacaaactcttctttttaaactaatatgctaaaattaacaaacaaatttagaaataaaatgtagatggactcacaatttagctattttaaatataattataaaattcaaagttaacaattagccagttgtaactgacacggtttcttttaatttaatatgctataattctaaaaacattcaacaacaattttagtgtatgatcaaaatttaaaatatatataaaaaatagcaatagccaatgtaacacatgggtgtgacatcccgacctaggggttaataggattaatagaatactcatatcaacaggttacact

SEQ ID NO: 100574 - DNA, 1041 bp, Oryza sativa
caccccctttctccacaaactacagcatggacgaacaatttgcctactgagggcccctttgatttggaaaaaaaaatatagcaattttagaggattttaatcctatagaaaaattttctatgaagtcctttgaaacaaatgattgaattctatccaatcctttgaaattcctatggaatggataatcctatagagattttagaggaaatttagcaagagttttaacctcttgctaactttcctttgagtctatctctctcatccaattcctgtgtttttcctgtggttcaatcaaacggtaattcctgtgtttgcaatcctctgttttatacttacattcctatcaaaatcatacgtttttcttattcctacgttttctcaatcctatgattaaaggggccctaagtgggtcaattaagaccaattgggctttacaattcggcaagagaacaagcctgagagttcgcctgcttgggcctttatttaggctgagtggtttacatggagttgggcctacttctagacccatggtaaactaatctacccctggaaagtagtactactactagtgaaaacctttccgtcttcctcccgttcgcctctcctttgcggtttggctctccactggggaaaccctcgaggccgcaagtccgacgccacgtcgcctcgtcggccgacgagatccgcggccggcggagtatattgttggagagcagagctgcggggctgcgcgtgccttcaggccaaaccctctctagtctttctccgtttcttccatctccgtcaacctaccggcgtattcggaaggtttcttttttctcctttttttttgttgaaaaaatccacggaacctatcgtcatggagagacactgccggctgccctctccccaccgtggtcaatcccgttgtgctgcactgctgcttgcccgcctctcgcggaggcttcaaagagacccagcgaggacgacgacctggtttgagaattcaacgctcgccgccttcatctgaccaaggaaaaccgcttgatttatgatttattg

SEQ ID NO: 100575 - DNA, 684 bp, Oryza sativa
atgacaccggcctgcaatcctgcgctcggcagagctgttgctacagctagctcagagtgattaggacagtaaacgcagctaacgctgcccatgcgaagattttctagccccatgctgctctgctccacacgtactcctacaatgcagacacgcagttgccaggccggcatcgtccaagcaccggtgatgcaactaccactattactactacggcagtttggatctaaactttagtcctttttcatcacatcaacctgtcatacacacataacttttcagtcacatcatctttaatttcaatcaaaatctaaactttgcacgaaactaaacacagcctacttctatctctcggttcaaggacatgcaagtcttgccttcatgagtacctggctgaacgttactcctgctcccttgtctcacatataaaagccaatcctaacattctaagataaaaatagtagaaaaaaaataaccaaaatacctctattattgagtaatggtgatagatagataaatagtattgaaggaataaaacttatcattttatgtgttgatagtagatacgatggtagagtgatcttttgtgggacaaaatcaaatttagaagtttgagtttttttagacggagggaataaaaacagtgagttagtcgccaaagcatctacgactacgtaaaactatccg

SEQ ID NO: 100576 - DNA, 764 bp, Oryza sativa
ttaagacaactcatctgccgccgcagtcgacttagagaccccaacaggcgcttcaattgcctacttaactataactgcgtcgatttaccaacactctttttgtctttttactcatatcatcacgagcgacgctggtattctcaagcatggcaccggattaatctactttgctttcagtttggtcacatttttcagcagttctgcatgcgagaaaactgtgagttagctcaatccatgtaatttgcttgctttggatggatctaccgagcacaacagttggccgcattctcctcctgcactaaagatggtagaccatacatctttggccactgccgtagaagtacttctgtgcagaaggtatctatctccacttcttttctggttggttaattcagttaatggaaattgtttacagactatattcaaggtgaaattgcactactgcaggttataaatctttccatttgcaacagcccatgttctatctcaatgatattcatacgttcctcttcaatgtcatgccctcatgcatgcaaaaacaaaaaagggtcttcgatctcagctttaaaagggtagcacaaaattttttattggaatattgaaagttcaggaatcaaagaatcatctccatgggcacaggtaactaaacaggtaaatattagctacatatatagaatatttgcttaatgtatatttttgtggaactctttattaaatatactattcccgacagctagctcattaaggattacaccttctttgaa

SEQ ID NO: 100577 - DNA, 787 bp, Oryza sativa
ggggaattgtgacacctggtccattcatcatgttgatgcattgttagaaagaaaataatactacctccgtattttaatgtatgatgctattgactgtttttttccaaattttgaccattcgtcttattcaaaaaatttatataattattatttattttattgggacttgatttcctgtaatcaacaagaaatagagacaaagaattcgtggttaaatctataaatgatagccgatcggctaggtgctgatgacatatcatttatctttgagccgatgtcatatatgaatcaatcggcggttataaatagatagtaaggaactaaatctgttcgatcggctgtagatattaacgatatatagttcttatattaatatatacttaaatcaagtgattgggatagatcggtcaccatgccgagacagtataaatcacttagatcgaaatatatatatattaataacagggttatatatgtttatagcatagccgatcagatagatctagcatgtatcggctaatactccgatactactttatataaagatatcaaaacaaatataatataccaaacaaaagcttaatatacttaaatgtaataagatcctgacataaagggcggatttaacatgtcattgaagcatatagatcgaatatggttaaatcagataagatcggctgaaactccgatactaccctaatcggcaaccagaggataggctagagattgatattctaagcatgacttaatagatcaaactcaagtgatgcagcattaagtatgaaag

SEQ ID NO: 100578 - DNA, 560 bp, Oryza sativa
cgcgttttgaatcttgctatccccgatcagccgtgatgtggtggtagttgcagtactgtgtgcgtgtatggcagttgagcatcaagggggagcaatgctggcttatatatattgttcttttaacttgtgttacagatacagactagcttgattgcagtagcagtaacatgcagatgcaatgtgcaggcgcgctgcttccactacttgggaacatgcagagaacatgccacacatttccctgtaaattttagcttctgtggaatattttgttaagaagaaaggagtcatgcatcaagtgggtctggaacatgccaccctgagacctcacttttgttttgcagacctcaaatagtagtgctgtttctctttgactgaaaaaactccttttccttgagattctcagataatctagtccataaaagtgcttcacattaagcatatgatccataattctttctagggatatatgcgtgagtgccgaccatgtgaaagatgcttctatttgactaatagcatctcttgccgtcaggccggcagtatacgaacaactaaatacaaca

SEQ ID NO: 100579 - DNA, 695 bp, Oryza sativa
  unsure (1)..(695): unsure at all n locations
gcgctgancctattgaatccattcggacccccgcatccctacagaaggggttcacgtatgcaagctttgatgggacccaaccctctctaaatgtgctggtctccaattagtgtctgaacggccccagcctgtgtaatgcgtactgtgcgtatgagcaaaattccgggttcagcgccaacaccctttaatgctgaacagcttttgaaacaggcgatcttcgctgtcacatattccttcacagacagctgccaacaggggatgatgcacactgctagttattatttggactcacttgaaaaggcagacacgagcttagatatcgacaagtcaagtggatgtattcgaatcacatgtcggctgtttcagagctatccacaagaatagatataatatttctttatagtactaacagattattcccaagtaacaaaacagcatgcagatcacatgagagcaatgcaatgacgaaaaaatcattagtagagataatcctatggatatatatacaatagagcactactaattgcacgttccattttcaccactgcgcactacttgatttttttttctttcaggatcttttaatgttacaaaaaattattcccaggttaaaaagaaaatagcatgcagatcacatgatatcagtcgatgaccaaaaaaatcacaattagtngatagaatcatatgaacatgtg

SEQ ID NO: 100580 - DNA, 628 bp, Oryza sativa
attttttgttatgtggaaaaaatagaatttgtaatgcccgaaacatactccctccgttcatattcaaacccagaattgggtttttttgagacgaagggagtatgttcgtatcattatcaccctctttaaggtggccataattagtagtactacttaccaaagctgaagaaacaaactcattctagttaaatctattatattattaaaagaatagaaaaaggagcttccacgttcgttctcatggcctagaaattctcacattaatcgaagaaaaagaaaaggcagagtccatatagaaatacaatttaaaaatagctgaaattcggaattaaaaataaggaatattagaagtagagaatagagtccatatagaaatacaattaggaaataactgaaattccgaattaaaaataaggaatattagaagtagagtatagaatccatatggaaatacaattagggaataaacataataaaattaaaagtagagtttagagtccgtataaaaatacaatttacaaataactaaaattcgaaattaagaaaaacatgggaagaagagttaaagtcaatatagaaatacaatttagaagtaactgaaatttgaaattaaaaattaaagaatatt

SEQ ID NO: 100581 - DNA, 639 bp, Oryza sativa
cccattatattttccttcatttcactattaagtttgattgcaaatgtcttttatgcccttgaagatttaggtttgaatataagctttgttcgagtgcacaatatgtgcattttatgaaactaatgaaacaaaaataattagtgcaagaaattttgacataaaatttgaaaataaaacaaatttaataaattaaattttttatttgaaatttcaataggacaatggattttttttcatcgggagcattcataaaaatctatcgtgagaatttgtagtcctatctttatatggatgctcctatttttttatgactttttaaaaaataaaataaatacatattttttgtttcattatctaaaaataatttttgtcataaataatgtatcgcacaacaaactcataactataatagtctcatatgacaaacttttacattttcaataatgtaattcataaatttctatgttcatcaaaagggcaaaattgtcattttatagaaattatacggtcaaggatcgaaatcaaattttgggtgcatacaagaaagtaagcaaaaattcagaggcataaaaaggattagcttaaattgcaggggtatacaagggattttctatagagattattgtgagacctatacat

SEQ ID NO: 100582 - DNA, 624 bp, Oryza sativa
gctgcatccttggctcccttcccgctctgaaactgaaagggccaaaaatttcccatggaaagagagcacattaggattccagaccgtcaagaacttgaaagaaaatacagctcaagatgggtgttcggatctcacatgaatcaatcatctcgttttgtgatcgttattcatcctccctccgaatcatcagagtaagtgactgatcataactgataagcaaacaagcaattaggactggatctgatcagggaaaaccaaagcctggactgaggctccaactccattccaccagcaaaagtatttaacaccaagaatcacactgaaatgaaaaggaagattaaaacactaatctaaaatacgaagaagcaaactaaactgaatcatgtctgtccctcagaatgcctattctcaacagtgcacatggaattatcgatcgatcggttccttcaacctcacagcatattgcagtggagggagcaccaactgaactgaatcaagtgctcagattactaaactgctcatcactgggacagaacacatgaaaatcttcgctaatcaatcaatcagacatatacagagacagaaatacaggggcaaactaaaatacaggtaggtagcaatgga

SEQ ID NO: 100583 - DNA, 813 bp, Oryza sativa
aggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatttcggctgggtgtgcgaagtgcattgcaattcaatgggcgcgt

SEQ ID NO: 100584 - DNA, 718 bp, Oryza sativa
  unsure (1)..(718): unsure at all n locations
ctgaatgcntccggcctgtacccnactaacgctctatttgttttcgcttaggattattataatctagattattagtaataataaaaaataaataggtaaattattatgatagattattgtaatctgtaagccagattagtataattggtaatctgttctaaacatatatttttcatattattgggtggctaaagagtcactgcctctattctactataatccattgaaacaaactcatagcttattataattcagtttataaatctggctaaataatctgtattataataatcttatacgatgagaaacaaacaggcccctaagccaaacccgaaaacgtcagatcgatccgcgcggtcagttaacagttaacccattcctttatcgggccacacggttttggccttctttttcattttaacaaaatttttttcatgggccagccccgggaggtacgaaggacatgatcacatgaggtccccgaaggggcatcagtgctactgctcggttagcctcgtcagttctggcagaatggtacgcgcgaattgaactggggctgaagctgggagcctgggacgacaggaattacgcgaatgaagagaaaaaaaaaacaggggaaacattcgggccgtgcttgcgctgattggataaactcggcctttccgntttnttcataaannnntgacctaagttggacctgacccangccctagtcaag

SEQ ID NO: 100585 - DNA, 736 bp, Oryza sativa
  unsure (1)..(736): unsure at all n locations
gcgccctttgaattgctattctagctcgtaccctgtcattctaggttgtttaggatagattaagatttaataaaaaactataataccccttattaaataatgtatggtggtaagtgaaatgattattgagggtaaaaagggaaaacttttgaatagaaagtgattgatgggacaacttagtactccatagtgaccagtattttgggacaaaatttaaatcctaaagagacaagtattctgggacggaggtagtattagccaaaaattgttgacgtgttttttttaacgatcgatttgtcagccatcagattcacgtcacgaatagcaaatgtgagttacatataaataactatattatagatacactacaattatactacaaccgcgtttgaaagtttagccctatatttgaaaggatattattctatcaacaatcgttgtagcagagtcttgcacttatgaaaatgaaaaacatcatattttccatcaacgtcttttttaaaaaaaattcatagtttttcatcaaattcatgaaattcagaaaaaaatatacgtattattaggtcatgaaggtatatacttatcatcgtgctaccgccgttttttaatagatgaccccggtgactttttctcacatgtttgaccattcggatgtttcnnnnantncnnnnttaaannncncttaaaatactannanngataaacatctcatgcactaaataattttattatgtaa

SEQ ID NO: 100586 - DNA, 744 bp, Oryza sativa
  unsure (1)..(744): unsure at all n locations
cgcggacttgaatgcagtgcgtaccaggaagatgtaaccatttaaggatgggcagagtaggttgatccatggtggccatcggtctctcgtggtccactcacatgttgcatcatggcactgctatgcaaagttcagttccatcttcccccgtgtacttggatggacaaatgctatttattcgccgaaagcttgcaagccatcaacagatcaactccctctagccccctggccggcaagaggcgtcttcgacgtctagctccgtacgtacgtctccgatctttcagccggtgagctactaaaatcatttatgatctgcgtggttggttggcagtattgttgagactgcaacatcgacagagcgatctatcataagctcagcttaggctgtgtnncttncnncccccttttttatcgtcaaaaccactttctccattggttcagtgtgtttccccctctaaaactcctaatatattggttcttttatcgctctttctcttttctccgttctttacttctctggtcttatttaattattacaattacacgccccccccgtagggtttattttttttaaattggcggccaaattttgtcttaaaatccggaataaggctggttaaacatttttattaaaagggccaaaatatttcataataccttaaaaagcccttatgttgggttataaattaagctcccccttactgccggtggtataaaaatatttttgtttcattaaaaggcgtg

SEQ ID NO: 100587 - DNA, 675 bp, Oryza sativa
acccaaggaattcagcattcaactatcaaccaatgaaatgaccattcaacaatatgtcaaccaactcagcattcatcaaaccataaattcagcatacaacaatagatttatccatacaaatgcaatttagcaaatggactacaacaagctgtccatacaaatgaaatacataaaaatgttcattgaatactaatgaaatatagtaaataaggtagaaatacaagtagcccagctacatattacattccatgatggctattacggtcagcccacatctgatcagctaagccgtgcctgaactgaaccatcaatgcatggtcattcgcttggtcggttgacgattcatcaatgtcctcacttgaccaatcaggcggagctataagctcatcaattccgtcatttacgacacaattatgaataatacaacaagctacaacaatatctacttgagttcgaaatgggaagaatagagtggcatcatcaagcactttgaacctcctctttagtgacccaaatgcacgttcaaccgtcacacggagggatgagtgtctaagttgaacaactccttctcattttgtactggattattcccccattcattcagatggtaccggacagcacgaaaaggaggcaagaatccttgtttggctccatatccagcatcaactagatagt

SEQ ID NO: 100588 - DNA, 892 bp, Oryza sativa
ccgcatgaattcacttcgacctgacctgattcaaatttgaatttgaattcaaatattagtttatagacccaaagtttataagtcaaaagtttacatacctgttttaaatttgaatttgaattcaaaatttttatatatagtatttctatacataatttttttaactttgtgttttttatttttttaaaatttatggtgtagtaggaaagagaaaggagaaggatgaaaggaaagagagaaagtgtattaggggaagataaggggggttcatacttctttggggcgggtatcctccccctcttgtgcgcgggcccctatattttaacgagatccttgtgtcgctaccggtccctctttaatttatatagtctgttcatcggtgggttgcttatatactggaaaggactggttgcccttattacctcgtgtccgtagtcctgcttatgggtgtattcgtgggacaccatacgtcaacaacggctttgtgggtatgggaatcggttcattccgtaaaatttacacgcgtttactatcctactatatatagcgggggcttttcaaagttacccctccctcgccgttctactacttgttggttttttcttagctgaactccttcaatagctcttgtcggaaatcactggtgcataagcttgtttactggggtgtagatttgttatttcgcttcaccatttcccacaaaatccattctctagctctggtatgcattaaaggggttaaagccctggtggtggcctaatgatgtggagcttaatctcaactccttatgttcgcttcttgtctgttccttactctctttatctatgctgtcaataatctttatcgtccgcatctctgcacttttacgactttggcgactctcgctctcctt

SEQ ID NO: 100589 - DNA, 568 bp, Oryza sativa
tttctagtaagattatatgaccctaatgcgagctattttgtgcatgatacatataaatagtatatttgatctactaatttataaaataagtaataaaaaatatatactattaggtttgataggagctcaccttaataaaaactcgcgagttttgatataggctcgagctaagttcgaattaagcctatgacgagttgagctcaagcagattgcaagtctcgagcttaattatttatatttttctttacagccctagacatcgtccaacacaaacatactcattccgttaaaaaaaacttaacttagaaaggtcgtaaaaaataaagaattatttagatttgttgtatttggagatatcatctcttattaggtttttttttgtccggagaaagtgcaacggtgaggtccgtgaggagattggccggttacacgtgctgggagtatgggcctactaggccgcatgttaggtgtgtggcatggtggtgggccccacgttcgattagagcaagtttaagagcaactataatagtgagctataagcttactataagcttatatggaggagaga

SEQ ID NO: 100590 - DNA, 521 bp, Oryza sativa
ataactagttagctagtagccagtctttagcatgcctgagaagttaaataatttagtgggctaattaattaagtaatcacgacgtacatgggaggctatgtagtagaaggcggacgcaacgtaaaggtcatcctgccctgctccgccaccaccgttccagacgccattgaagctgcagttcttggtttcgcagggcgcattcaccttcagtaacttcactacttcttctctgcacttggggtagtctgcaccttgtggtgcggccgctgcgtcctactgcttgccggtgtaggtgaaattaccttgtttttgccaaatcaacaaaacaaattaaatctcacttggttcattaaacactaaacgttaattgattatatgaatcttaaaggattaaaggggcgatgcgtatagtaaacagaacaaggaataaaccagtatctaagtaccactgaatccgcgcagaatgcaagtgctaaatgggccatcctttctctttaagatgtgcgccccagaagaaaaac

SEQ ID NO: 100591 - DNA, 539 bp, Oryza sativa
cagcaaatcatataaagaagtaaggcattgtatggagttgggagaggagtcaaggactaaaggccaaggtatctttggctagaaagcggttgtgtagagagtttgcccaagtgattctagtagcatgatgagcacacgggtaggaaacaaaagttggaggtgttggagcgaggtgagcccatgatggagcacgatgtattttagagagcatctcgagggcacggctttcttgtatccacgggttttggagggggggcttttaactatttgccactcttatgagtggtgcttaacgatttgccactaggttcacatgtcatagacacatgagggcccacatgttatagacatggtgtggcaaatcgttaattgccatgtcacaagagtgacaaatagttaaatttcccctttggacggaggtgaggtgttcaatgccttcaactccctccctcatattactacaaggagaaatgcacaatttaaccaggaaatggagatgtaccgtcatctcacgtgccactccacatactttcggtaga

SEQ ID NO: 100592 - DNA, 631 bp, Oryza sativa
gtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatt

SEQ ID NO: 100593 - DNA, 622 bp, Oryza sativa
tcgtttggcgccgatgatcagagccatctcaattttctcgaaaggaatcttgagcaggcaaaggtatattccgacctcaactgtgaagtttatctaatcctttcaaaatggataaggattgaaactttgaagatgcaaatgctagctagcccaccaactagtcctttgcatagtacaagaccaattatatatcagcacattcagacaagaacaaattgtttaatttgtaaggtccaatgaatcaacgacaaagtagcatgtttctttcgtgtgcttgataccagaataattaagaaacatgcataaagattatcatataaattggcttgagtactagcttgcacgatattaccatttataatttacattcttgtacatgaaaatgaaaacaaaaaaaaactcacaaattaatgccataggaagaaatctgaatctttccttgcatgggttacatcaagaattccgtctgtttgtctatctgtcatgcaactcctcaaaataaatccaaatggaacaatcagtatcttcctctctgaatctgtagtttcattcgttgaaattaattcacctctcttcagatcgatcggtaaacggatctagacgcctactagctactgcatct

SEQ ID NO: 100594 - DNA, 615 bp, Oryza sativa
gttaacgatttttagtgaactctgctgcttcacttagaaaaggttgcaatttggcatatcgagtattgacataacacataactcttcatgaggtgcatgcgatttactgctcttcttttcttgaacgaatagtgcatatgcagttcgttcctcatgaaacaggaggcttcatgatcggataattagtttcctttgtatctaaggccacacccttgactctagccctgtgtgccatagatgatagaatcttcttgggcattcccaggagtgatcctcgcgttgtctcatggggtccagatcaaccacattcctttgaaactgcatcctcaagaaacgcccaggggtcttccagctagctccacaaggtggtgggctagatgacctgggttcgaagcctcaccccttctaattatttgatattaggtccttccctaatattcgcgtctttttttttcgaaactgcatcctcatccatcattcagtacagacaatcaatatggaggttttaaatctagaacaaccatagattccatagttggaggatttcggagttctcaacttatactgatcaagcagttaccttgcacagatgcccattttctgctactacttcac

SEQ ID NO: 100595 - DNA, 1096 bp, Oryza sativa
ggtcatggcctgcaactctcagctgcaacctagaaagatactcctacttgatcgagttgcaaagttgcaatcaacgaactgttttagctttaatttcaaatggaactgaaggtttgtagcgagcacttgggagtaaagaaactccatcttgtgatgtgatgctgaaaagatcatgcatgcatgcatgcatgatatttagaataagaaaaaaatgatgcataatttatatgcatgcattgttctgtgttggatgcatggttcctgcaagtccaaaaactgcaatatggcaaaggagaaaccttgcttgcacccgattcttcggcaagaaagatgcccagatgcaggttgaaacgtatatctttaaatataatttgtatatagcttctaattttactttctttttgcaatattttgcagtgcatgcaagctggcattccaaatccatggctggcctgaaaacttattagttatcagttgctgctgctttattttggttacatctctcaactggcagatggtaactgcgtctcaatcttcaggtttatttattcatcgaggcattattactaagttatatatatacatgagttccataatgtaaacatattgtgcacaattttttcttactgaagagggaacaaaatgtcagagctgagtaagcagcgctagctgttttctaattcttcagagctgccattacagatccaagaattaaacataagtaacaataaactcagagcagatagatatatacaaattaaaatattaatgttgcgctatgctatacatgctggcatttgctactaacagctggtttgcatgtataattttttttcttagctaggtaacgtagatatatgctacgcgcatttttgtggttaatttcttttttttcttgaaactttttatttaatttgtggttaatttatccaacgccaactagcttattagtgtatatcacatgacaatatgacatccccccatggtttgcatgcgccggtccaactagcttggcatatataaaccggccgggctgcacgtgattatctgacagtgtcaacacaatttctgacagtagttagctagcttgcaacaa

SEQ ID NO: 100596 - DNA, 590 bp, Oryza sativa
tacttttgacctatttatgtatatatatcagattgatgtttaaacaatctaattctctttcttttcttttgtgtgatcttaaaactatcttgtgcattatagtcttaatcactaaagcatacattgtatatatttttagttgtttaattacgttattaaataccaccatagcgttagaacgggcagattaatagtaatacaggaaattaaagatcgatagaagagtagtggaactgcaatgaacacttgtgcattatattctccaggacagatgtgacgattactgtcgcatatatatcttgcaagcaatgcaacttcttcttcttcaatatctcgagtgcaaacggacacgcaagagcgcatcagatatatatatatatatatcgagaaatcataaatgagctgctagtattattatatatgcaacattcaaactcaagctagatatatctgtcgatcgatccatggatgaatcaatatgtttgtgttgcagtgcacgcatgcgcatgcatttcagtgatttctctcgatcagaatcaggtcagatcagtggtaaatgagtcacatcgctatcgcgcttgtatgatcga

SEQ ID NO: 100597 - DNA, 939 bp, Oryza sativa
tgaaggaaaatataatgggaagggcatggaagaaatcaaattaaaatttcaggggtatagaagggatcagataaatttcaaggatgtgaaagggattgagtgagtttttaagggtatacagggaatttactctaatctctatggagtgcgacatgccatcttctttcgtcaagcaaccaatcgtcctaccgaattggctcgtcatctatcacgccttccattcctcgtcaaatcctattacattaatgcttagattttttttaagaaaatcctattaaatcatcaattaattaattaatcaatgtgccattaactaagaacgtttaattgttaatatgtctatcgggatgggagatgatctcactcgattttttacattttaactctttttaaaaacttattttataagtagacccttaaacaaaagacaacttcgacgttgggcaaccgcgggcgcaactatgacctccaaatttgtattagtccactctatactctgagtaggcccacattcacatagcactctatttataccttcattctcatttctaaaagcattaacctggaggtactatgtatgcttgaaatgaactcggtatataagttgacccaaatctatctagactctccatgtggagctcttcccaccaaacgaacacttgggtctaaaccggaacaagaagagtcgcgcaacgaaacagactaaatgggctggattttacactctcactccttcatgggttgatgccctagctgcctagcagctcaccgctactcaacagccaaatgcccagggtatcccctcggtgctacggcgttgtgcctgtgcgtcgtgtccccctccatgggccaacacgcacgcacacttgtgtaacacgggttgaagttctaatatcacatgtaacacccgagacacaaaatcaacaatagtccactcta

SEQ ID NO: 100598 - DNA, 1483 bp, Oryza sativa
tcgcttattctgtaggttattactattcgagactttgtggtgctagcctagcaccctatcatttatcattgcttgttcatcaatcaaccccgtaatatttcaatcatatttcacgatccattactagcctgattgggacactgattaaggtactttacgccggagggcttttcttcctttagctggtgatgttactgtcagggaaaccttattgctcaagtgatcacattactgagatagatagcgattgctatattaggacaaaacaaaaaaaaaaggactacacgactatgcactccctttctccctctggggtctttgtatatatcttggcttagcactgaagtatacctggaaatttatggcacctacataatttgcaggaaagtgatcacgaaattgcatggcgatgtcttcttcatgttatcctggccaccctagaaggaaaagagtgaatcgcaagataaatattatccctattgttttacttatacttatttgtatcacatagcaaataaaaaataatttaaggataaagcttttaatatgtgtgttctaactatgataaaaaatcacaaaaacaatttcaaaattaagttttaagattcaatttttcgcttataagtataagcataagtgaaacaattaataaggtctctgcttgcggaattgggagctatataaataggcggaaaattaacttctaaagctgttcctttttaaccaaatcatctataaaatcatgccaatcattgtcaaattaacaagtcagtaagattgcaatatgctacggatcgtacgataggcattacgtcaatagtggagtaccacatatggagcactgatgagaatgagatgaaggcatgcaatccaaaagcaattctcctttagtttgcgtgctctgatgaaactgtttcctgttccttttctcttgaccaacatcttcaacatatgctgccacttgttcagatttttttttttagaaaatgggtaaaaaaagctggcctcttattcaaccagatgtacacagccaaaccacttgttcagatacattgtcgaactacaaaattctagaaacactcttcagtttgttaaatatacacacggcaatgagatctccttgctactactgtccattacagtctattactactctttagctagctgaaaccgaccttttgctgaaagtaatttgttttggtcaagctagcaacgcttgagatttccaattgtcggcaacgacatcatgttggcccatagataggttgccacatatatgagtgcttgtttggctcttgggggtcatggcctgcaactctcagctgcaacctagaaagatactcctacttgatcgagttgcaaagttgcaatcaacgaactgttttagctttaatttcaaatggaactgaaggtttgtagcgagcacttgggagtaaagaaactccatcttgtaatgtgatgctgaaaagatcatgcatgcatg

SEQ ID NO: 100599 - DNA, 602 bp, Oryza sativa
ttttatacttatattcaaaaagtttgccttttttactttttgggcctgttcagattatagctaaaataaatcttatcaagttttgttaatgctaaaattttagcaagatggtaatattatcaaaattttggcatgatttcttatgtattgactaaatttgacaacaaactaaacgtagatatttttttgataactttgtaaaaaaaagatatgattgaaaatgacatcaaagggaacaggctctttattgacatattttttgtaaaatgcaaaatggagattgcaaagtgccaacgttttttcagcgtgaagttatgagcaactgcacttatcgtgttcttaaaaaaaatgcactcatcgaatctttctttaaaacaagcattgaaaacggaattcacgttggatgagttcttaatataaactagatgaaaaccccgccgtgttgctgtggaaaatgaactaagttacataatatgcaaagatataatatgattattaaaataaaaataaattaatacttataaattttaagcctaaagataattgagattgcagagaagaaagaagagaaaatttaaaccatatctctcttctcttattaa

SEQ ID NO: 100600 - DNA, 769 bp, Oryza sativa
atatgtattgaccaccagccaaaattagctttttttcatgctttccattcagatggaaggtatatgtggtaaccaccaacaaaaattctttgtacgtcgggcctcccggaactccacgaaggcaccaacaagggatactgtacgtactacaagcttattagcagggtaccattgttttgccacaacggccacgggtaggtcgcacggttaatcttcttatctacgcattaatatgacgaccccccgggcccgcgcggccgtccaagagaacggccagaaccgcgcgaccgcgtgccttccccagcgtgcagcgccgcccggccggcgcatggggtggctgggtgacggcagaaacacaataattgcggcgcgttttgccgttttgctcctgtcgcgcggatatatatcggatggcccggttaaagtggtctttcgcgtcgcgggcgttgctttcgtccgcccccgcgcgtcgtcccgatcgatcggccccgcactgtatcgcgcattatcacggccggggcgggctcgctcgctcgcgtacggtcggtgttgcacttcttgcaggtagtgcctcgcgagatcggagatggtgagtgctcgcgagcgatcgagctccatgtatctgcccgtgtcgcttcgtttcctcttcgttggtcgttgctttcgctttccctttttgtcccgtaggtgatcggagttcatagcgcgttcgggcaactaaagagtcgacgtgcgggcgttcacaatgagtttgtatatcaaagccgcg

SEQ ID NO: 100601 - DNA, 600 bp, Oryza sativa
ataatgttggttttggagtatttaagatgtgctgctgcaaatggtgaatggtgtgtattactaagggcacccacaatagttatctataggctctatacaagagattcatgtcagcatatttttctacttggaataaattaaatgaagagagagagagcaaagctatctactaacctggagatagtctatagagaaaaacgaggcaatggattagagagctatagatacccatgtagatatactattgagttggtttactattaatctagtttattgctgagatatacatattttatatggagagcaccttattttattattgcgagtgctctaatagcttgattagcttagcttaagtagacaagccactttagaggaacaatgaagatcagtgagacaacgaaggagaggggagtcaggggacacgagatttcgatttcattggagagaaagagacatacaacgtccaaagcaaagcaaaaaggagaaacaaacaaaagcaaaaaagaagaaactagagagagagagagagagagagagagagttgtggaatccaaccaaccaatatgcgccgctcctcttcactctccaagcagagca

SEQ ID NO: 100602 - DNA, 1047 bp, Oryza sativa
gaaagattaaagactaaaataacccaggagccaaactttaggaccatattagctattctccctttttttttcccaattttctcttctcttccagcttctgcttgttgatcgagtcatcaactgaacccaagacagagcagactgttgtaagcatggcattggcactggcacgagagagacgtgcactgcagtgcttgtgcaacactgggcattgcaggcagagagcacagcacagtagtaactccctactgtacactgcaattaccagggccaatttacaaaccaaaatgaatgcattcacccactcctctgagtcctgctcatcctctcctgaccgtattactaatgctaccaacaaacaaacaatcaatcagacgacatgaagaagaagaagaaagcccacacagttccattccacaatttttttcaccgtctgatattatgatatcatatgacagacacttcatcaaggcaatgcagtcctcccaacaccccaggtccacaatgtgataagccaggagcaacgtgttgtaggtatgtttgcttggctgtttgctctctttcccagtctcacacacatcacaaacagtgtgcaatttgatttggtttggtgctccatgattggggaatattcaggaccatggcactgcatgttcctttgccccactcatgcaatcaccatcccccatttaattcattcattctaagtaactctatcagcaactagtttcagaagaaatgctcaactaataatcactgtactctcttctggcaagagtccttgcaaattaccctttataactaaaagcatcagggagtagagggaagttaaccatcacatcaggtggtgaagaacaccaaacacaaagaaagagcccttctctttcctgcgatggattgaagatgttcaacaaccacttcctgactatcatcatcattccccaaactatagctagcaaaccccttttctgcaactccaaggctgcattgcactgcactgcacaagccaaagggggtagagaggtcagtgtctttccaagctgacct

SEQ ID NO: 100603 - DNA, 617 bp, Oryza sativa
ctttcccacttctgggatcacaaaagaccatgaagaagtttgataccacagaaccactagaaagttgcaccctttttaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagggctccaaaacgcaaatctttttttactcctccttaatcatcctatggtgatctagggctagtactactaa

SEQ ID NO: 100604 - DNA, 1546 bp, Oryza sativa
ccgtggggctggaggacggcggcgggagcaaagcggaaagtgtggtaggagaaggtggccagtagtggcgccccgccgccggcgacggggaagacgacgaacagctcgccgccaccggcttgaggcaaagaagaggagagggagggggagggggccggccgggggggcctcgccggcgccgttgacacctttcggccagccggcgaggccgggcggcggcagcggtggcggaggctgggggaagcgctgaggagcggcggcgtaaggtatcgggagaggagagaggatttttagggtttggatgcctgcacgaatcttaaagtaatcgggtggtccaaaatttgcaggatttgtaagggggttttctgtcaaatgatctatagacagtacctttttttataatgaaaatcattctgacctttactttaaaaatataatcaattattacatagttcacgtggataaataaatgtgaattactacaaaattatactctacctccatcctaaaatgttgtaatttagaataggatgcaacgaatctggacatacctaaaatattttagcatggaggttgtaacaaattaggtacgcatatggatatagctagctaggcttatggacgtggcaaaattctttccgatggccatctacacttgtacagtgacgtgcatgcatgtgcctagcttcttgctgtcatcgatcagttatcgactagtacgtacgtgcatactgtagactggccgtcgtgcaatgaccaatgcataagtatgcatccaatcgatcaaccggccggtcatcagtacgtacgtgtgcccaagtccatccagagcaagagcaagagcatcagagcgtggcagtcgcgcgacactgctacgtactgtgaaagctgtgacacacgcatactccctcccagggccggtcctgagtttttgtggcccgggacaaaattaaaaacaggggcccctgatataaacatttaaataataatcaataaatgtaccaaatatataaatacttcattccaaaatcaatatccatattgaaaacttcatatatatcagcttaaaatttgtttgaacatttctaaatgcatagttactaaagatggtatgaatgtcaatcacatctaaatcatttactcaatgtataaaatgggcaaaccatttaaactttctagaaggtgtgataaaagaacaaactgatgattgagaaaattaatatactaatggctaaactcatataaattacaaagctagaaaagcaacatattaattgaaacaaatctagatcttactaattagtggccagtgctaacatcaatgtacatttgccataggagacagacaggagtagtgcagtacacatgagcagagcacccgagcagcggcggatggcggtatcaggcaatcaactgaatgtggccctagaggaatcaaatagacagaaacggggagagttcctgcgtgagagtattatggcataatacccccacaatcctaaagatgagatagtattgcattcgtatcatgaattcatggtatgct

SEQ ID NO: 100605 - DNA, 975 bp, Oryza sativa
caactagttgtactactgctccctccgttctagcagaaatcctgaaaagtgaaagtgagaggtgcacaacaagaaaatatttgtgcacctctcaccagaactactccctccgttcgaacggttttcattctagtcacatccggtggtcacgtgcatgtagcatgtgcaagtgcaacaagtccaagtgtacaggacagaatggcatatatgcaggcacgagagtatgcgaaattgtgatatcacagcaggcgatgcagatggctagagatatactgcatgcagcagtgcatgtgtgtaggcttatgcatatctggatggatcagcaaccagcgaaaaatacttacttgtccttgagcagttcacgtgacttgttgctgtgctcgatcgctgtatatatgggtcggagtaacagtgctgctgtaatgctgtactagtactataaagctagctagtgtagaaagaagggaacaatagtccatataaatggcagtggtccgccggcctctccttcgttatcctagttatatcttatccatatctaagttagtcttttcgaatgtagagagtatttggtctcggccattaattcacttgcttgctgcgtagtaatataattcattttcagataatcaatggaataattaagcattccaaacgttgtagtattggcatatatataaatatatgccgtttcgtattactacaaaatttccacatatcattcattctcgatcgatatctatctagctatctactgcttaggacaatggctaattaattgatcgattgatgatgcaaatatgtgtactgctacatactatactggattgaatatgtatatgatcgacagtgaaatttaattatagctgaatcgataagaggccgtggatcaacggacgttactggctagctctagctaggtcgtgagaaaatgacatgaatataggccgagtttagttacaaactttcaacttt

SEQ ID NO: 100606 - DNA, 954 bp, Oryza sativa
aatatatgccgtttcgtattactacaaaatttccacatatcattcattctcgatcgatatctatctagctatctactgcttaggacaatggctaattaattgatcgattgatgatgcaaatatgtgtactgctacatactatactggattgaatatgtatatgatcgacagtgaaatttaattatagctgaatcgataagaggccgtggatcaacggacgttactggctagctctagctaggtcgtgagaaaatgacatgaatataggccgagtttagttacaaactttcaacttttccatcacatcaaaacttttctacacacacaaacttctaacttttccgtcatatcgtttcaatttcaatcaaacttctaattttgacgtgaaataaacacacccataatgtcgatctgaatatgggcgcgcaggttgtcgacagaatgccgattatttcgggcgacaagcagtaaaagttcaaactatatatatgtatactacaacttaattatcacatgcgtgtagctatcatttcgatggatggatcgatcaaatgaaggaaattaacattatatcgggagtgcagagtgctgttgctatagtgtaacatctggcgtttcatgcatgtcccgtgatacaccagtaataccataacaacaccactctttggcacgaactgtaccttcacctagctagttttaattgctagcaattggcttgtgagtaatatattgaagctaattaacagctcagtcactctactgtgtagtgtatactgttccggcagacgtgcataaatcctgactgatcgaaactaatgcaggtactggtggataggcatgttggagttcatagtcataagcctttttttttacggatttgctaaagctccgtcgacagaaaatccaacctcaaatcttataaattttggatcactggatacatgtgcttcacga

SEQ ID NO: 100607 - DNA, 500 bp, Oryza sativa
ttgcagatgtaattggtgaaatactgatggttttctctgttttctgtttgttcaaatggagaatgaattaatcggatatttactcagtttcagatgtaactgatgaagttttggttacagataagtgtctgttattgtacaaaataagcgtaaatttgatcatatctttgatcttgctctaccaaaatggctcctcccctgcactaacattctaacaatgtactgtatagtaagtttcagttgctgttggtcggtgaccttgcctgtagttaatagtagtaagtcagtcaactcgtgtgcttgtgctgctagctttcgttttaacttttaactggtgtgctatcaactattcaacttgcctagtcgtccgtgtaccttcgctttcttcatttgtccattaattgacgctgtgcaatttgctgacgacaaaaacgaaatcgtccaacgaggttgctgagagttttctgcccccgtctcttttataatttattcaccaaacg

SEQ ID NO: 100608 - DNA, 671 bp, Oryza sativa
aattcctgcagcccatatatatatatatatatatatatatatatatagtaaatttgtttggtgctccatggtgcccgggcaccattgttgaaattgagtacatacccaattcaaatgagtatgaaactttttcaattcaaatgagtatatatatatatatatatatatatatatatatatatatatatatatatatatatatatatcgacatataaatacttctttttgacgaaaaaagataaagccagtctacgaaaaatacatggattgggtgggccaaaattttcaaaagccataaaagatatacaatgaaagagagaaaagtgagtgtgtgtatcttgtggatcatagttaaccttgaaaactctatggagcaatcaaataacatattggtaaagaatcattcgaagaacttacgaagcactctacaatatgcatcgacacaccgcgcagtatagctaaatccaatgtataaattgaactctaagaagctagcattcatagagaattatctgtaaggagtgtatacaaactatgatgatgttctctaaatccactgagatgagaaaccgaatgtatggacatgaatgaatgtgtgtcaagaaaaagagaagtccactatgctcaccagattcatcaatgcatacacaatcataattaggaaactatg

SEQ ID NO: 100609 - DNA, 551 bp, Oryza sativa
ctaaactcaaagttacaaatctgtattggaggctcagaccaagtaattgttacacttaaattccactatgaaggacagttagtagtaccagatggtaaagctataaactactagtgcaaatttgtcagtggaatagggaaaaaggacgttcatgtatgattaaagtgatcggtggggaacaaaaggttaaccaatcaccaggtagcatcaagtacagttggaaattttcaaacattgtagctggcatcagccaaaaaatagtagttactctaatcttgcgaacaacaaaaataatttggagctgaaagacctttgcaattttattacaaatgaaactaaacaacacagttcagaattcatgggtaaacttaagcttagacatagcagagctattcaattcatgcacagttcttctgggcttctggctacacggcactcgtacgaaaattaaaactgaagtaaaggcgcatgaattcaattcactatcgggacatgttttctagtaggttcgttggcaaatcattgctagtatatactcctgcgctaaccac

SEQ ID NO: 100610 - DNA, 564 bp, Oryza sativa
cgattcatcgcccttgaccatcccaatatagcaagctccatcgcaagggccttgtccaatgcgatcgtccagctacagagtatcccgttatctattatgagcaaaagggatcccatcttcaccagtgccttttaagaggatctcttccagttggtatatgtcatgctacacatgagctttgccttttatccccaatcccattggcagatgtacctttactgcgtcgctgatgatcggcccacagtgagttcactgaatgccctgtgctaagattcgttgcaactcatttctagacagctaagcattccactccatttcgggtcatctatggtaaggacctgctagtccttcatgtctatgaagctggttttgcttgggttgtggccatcttcaatagcatgataagtttctggtggagattgcagcagctgtggtaggctcaaaccaccatggtgtttcaacacgatggccagcactgcgatgtcgatttcattgtcgatgagtttgtttggttcaacacacaacactggccagcctgctcttggctaccaatacatgggtgca

SEQ ID NO: 100611 - DNA, 691 bp, Oryza sativa
gtattttataacactacctaagactatactactataaaccgataaaacttctaaaatttataactccctaatggaacaagataaaataaaaattctttcacctaaattcattttagaccagtacctaatcactgtgcataaatcatgcattttagagcattttagattttcagctctttcggtgtttaattgcataacgtgtcctttatctagataactagacgaaacccagcgtattgctgcggaaaactaaggataatccatagaaatagcaagcaaagatatatcccacaatcaatatagtattttgtcaattcatgcaaagaatgggccaatgtatgtacaatgaacaaatttgagcgggcactgactggatccatgggatagaggaatgagtggataaaatttcctccctaaaacaccatgggatcatccaagatttctaagggtgtatttgcactgacaataagtaaatgcatgtgcgtccggtttataaaagttaaagcctacgaaaaccttttaatatcttttttgatttatgacaggttctataacagaacttgggcaaaaagtatatcaaatagcaatcaaaagaatggaatgtatcaggacatatataatacccatattaacctgattataagcataagtgaaaatatatgcatgatgataacttttgtaacaacgtcgt

SEQ ID NO: 100612 - DNA, 867 bp, Oryza sativa
cccccccccccccccgaggccccaaccaccaacctcaaccacaacaagagtgaagagaggcttccgcttcctcttcctcttcttcttcctttgccggctccccgtcgaccctcgccgccctcgcgctcgtccgcacaagctgcaactgcaaccccagcatccaccctcatccggacctacccaatctcctagacgacatcaccgtttcagcttccccggcgagcatccaccattccaccacctgctgtactcctcagcttcgtccttgtgagaataagctgttcgataaaatgtctactaaggttcaccagcttgtcttgctgtgtttcactgcctgttaccattatgctgcgtgcaggataccacggattaaccttatataatcaattgtagcaaattgcgtacatgttctgatcaacttccttttcgcagtttctcgctacatttttacttcttttttttttacagctcggccttatactttactccacacttccacagtgagtggcatcgctacttttcaaaagctcttggaaggaaagaaaacaggctcctaggtctggttgcacacataatagtatgtatgattcacgcatgctgtttctgtagatagctgtcattggattaagtcaaactgttttgtgatccaacaatgagtctttcatgaattatgaaattggcaaagctcctgattttttttatcaaaataacctaacaatgagttcttttttttaatactattacaaataaaaatgcattgacttcctttccctttttttcgagaatacgcatcgtatctttgtattaaggagagggtaaggctacaacttgccaatttacaggaatgccagaacattaaaaaagcga

SEQ ID NO: 100613 - DNA, 690 bp, Oryza sativa
agaatctcagggcacaaatttgctgtttgagaaaaatgctcatttggtacttccactatcttttccaggactgcaatctttttttcttgccattcgaatttactgaacaaattaattaagcatgcttgcgcaagcaaacaccattctattttattctcatggatttccttgggaatattccattgaaaaaaaaactcttttccttggtccacaaaaaaaaacacacactgttttataggtttccttttcagacatgttcattgtgttcacagtttcacaccatttttttttgtgagacggtacaaaatgcaaattttcaggaagatgcctgcaggctggtcaggttacaatgtggcattgctgctttacggtcagcaggctagcatgtttcctgtattgtgtaaggagtattctgaaagatgttcctgagactatggtggctgtaaaatactgagagtgttccatcatactccctatataccaaaaagaatccaaccctagagataaatctggacatacactatatacagatttaacctcaggattaggttttttatgggacaaaggaagtaactttaagtagtgaaaaagtttggcaatcattcttggtttgataagaatcttaagcacatcagattttgcatttgggatgcaaaataatagatgaggacttactctagacattaatca

SEQ ID NO: 100614 - DNA, 543 bp, Oryza sativa
tctcccttatctttgaaaaccggtgcaaataaactccttcaatggttttgcaagcggttttatcctacgtggctcttatgggacccacatatcagtaagagcaaaatgaaaaaaaaaacatctcatcctttttttcctcacctctcccgttctctatttgccggcggagtagtggtcggcgagctcctttgtctacgcgcgccacggcaggcggctccttccctcacgcgcagccggttggtgttctcttctccgcacacgccgtagccgcccaggtcctctccacgtgcgtgatcggctgcagcgtgggcgcgataacgtcgtggaacaagtcggccctctcatgcttctacctcttcctcctccggttcttcttcttgaaatagactctatgcacaaatagactccaccctgtcgtccccacagcaccagcaacccatcacattggagctcctccccgcacggaatgacgccgtggagacgagccaaggagcaaagaaagacgttgcggtggctaacgcgtcctcccacccatcggtccct

SEQ ID NO: 100615 - DNA, 591 bp, Oryza sativa
atccacagcacggagtggcggtaaaattgcatttagctcctgcgagggaggagggatttggggattttggggggtttcggggtggtactgtggctgaaaggggctaactacaattttaccaccacgctgtcctgcaaaaggggggcggatgcaaaattgttgcctatgtggagcgccacgtcggcagtcagcccccagtcaaatgaggttcagacctactgtggttcgttatcatggacgtaaatgtgcaattttcaagtttacggacctaagtaataccaacgctctagtttaaagacccgccatgtattttactctttcagatcattagagctaggagcatttttaataggaaactttgcactacagtattttttactctgtaactcattaaaatatttagtcaaatttgaaggcagcaattgtcaataatcatggcctacaggcctagtgtgcactataaaggactcaaagaactaatccaatgtaaaaaaatttaaactcgctgatgtgctccacaaaataaggatatgtattcttaaccaccacctatgaaaaccaatgccacaaaaactgatttctttcctttat

SEQ ID NO: 100616 - DNA, 569 bp, Oryza sativa
tcgactctagaggatccccaccagcagaactttcatgcccaacgaatggtgctagcagatcaggtagaaataacaatcacagctaaaattaccaataaaaaaatgatcaaacagttgcattaacaacgcataagactaaacagtttgtctgcacaacattagagtactagagccatataaaccagttcatcagtcatcaatagaaagcccgaaatcaatcgatttataactaaaactgcaattgcgtagctaaagcagcgagttaggctatgccaataggaaattctccaattccacatttccatcgaacccgatacgataatgatgtcttcatgcgaaccattctaccaacccctagtttttgtagaggaaaaaactacctaccactaccactagtgaagcagtgacaagctatccaatttcgcaaaaaggaaaaaaaaacaaacacaagggaatctcctcttctcaccttcagttcttcttgggcttgcacccggagacgaggtaggccatgaggtccttcttggtgagcggctccgtcatctgcaccgctcctccgtcggggggct

SEQ ID NO: 100617 - DNA, 645 bp, Oryza sativa
cagagggtcttatattcaatacaaaaataatcaggaacaaaagagggtatggcacaaacagtggtttgctccatctctctgttgacgaaggaaatcggaagaagaaaaaggcaccaacaaacacagtacctacaaattgcttcgaacgtaaatgactgacgacgttaaaacaattgagtccatgaagatgcattgcttcaccaacaccattcgtccctcttcaagctgacaaaaaaacagacgcgggacattagatgtcaaggcatgcaatagaatggacatgacactaagctctgtacggggggagtacatctacagacagtccagtttcgatgtgtgaaacgtttctaactatacagataacacctgctggaagacaggatcgactctgtgtcgccactttgtctcgcacaaattgaacacactgtcacttggtgtcactcctagaacatagtaggctacagatataaagaatgaaaacacaggctaactgtctattaatatcacttagagaccatgagaaccatgaatatgtttatgtcatcatcaaagaaaagagatgctggaatgatgatatcataccgtgacgggtcactgcatcaacctctattaagaagaccaactccttgtaccctcttctttcta

SEQ ID NO: 100618 - DNA, 595 bp, Oryza sativa
ctgatatgttgcgtttatgaatatttgtgctataacataagtacattgtgttatgacatgttgcagttatgcatatgaatgtgtgctatgagccaaaaaaatatttttctaactaaaaaggatacctggtacaccctggtttcatctagctagtaccaggtaccagcaatatgctctgcctgataaaaaaaggcatgctggttcctggtacaaaatgggataccctggtaccagtatggtacctggtacctgataccaatatggtaccatgcaggtgcctggtgaaaaaaaggtaccaaggggataccctggtaccaggatggtacctggtacctgataccaaggtgataccctggtaccacgatgggacccggtacctggtactaagtagtatggtaccaggctgatacctagtacctggtacctgataccagggtacaccagtatggacctgataccaaggtggtacccctggaatagtatggtccctggtacctaatactagtatggcaccaggctgataccctggaccaggatggtagcatgctaaaagattagctaaaaaagaaaaccatgctgacaccaatgtgggaag

SEQ ID NO: 100619 - DNA, 570 bp, Oryza sativa
cggtgccggcgaggtatcgagggttcggggctctcgatacggggcggaggaagaagcactcctgctcggagtagttgtggcgtcgcggagcgtcgccggcaaggtatcgcgcgcagaggcgcgcgatactgagctgggttctggctggggccgctcagagtagttgcggcggccctctgcgccactggcgaggtatcgcgcgcagctgctttctggttggggttgctctgagtagttgcgtatcagccgggttctagatggggaatcgagcagagttgaccttggtcggaaaaacgacgaagtctggtattaaatctgtcggggtggttttgttaattatcccatgactactgcgttgcaacggaatcccgtacggtagctgccctcatccttcaaatgaagtacacgtatagtcatcttgctgccatgggacacttggcataccattgaaaaaataattaggtacgtagtacttcctccgttttatattataagactttctagcattgcccatattccaggggcgaagccaggataaatggtcaccggggtcagtattaaccagggttt

SEQ ID NO: 100620 - DNA, 3174 bp, Oryza sativa
ggtcagcctgggcatggcggcggtggtggggacggtggcgtgggcggcggacgcgccgtgcctgccgctgctggtggggctgttcgccacgatgggcgtgtccatgtgcagtgtcacgcgcttcttcttcctccgcgagtccgccgccgcgctccggggcggcaggccgaccttctcctcctccaacaccgtcccgctgctcagcctcaactggttcctcctcggcatcctcacctcccccatgcttcccggcgctgcccacgccattgtttccgccgctaatctcagctcccatcgccgccgccgcttcagttcccaccggccgccgagcggcggcggccggtcgaaggggagaaaaggggagagaaagagggtaggaaggaagatgggaggaagaagaaaaagagagagaggatgataggtgggcccacatgtcagtggggctcacatgtcagtgggccccacaactttttatgcgtgtgaatgataaataggttcacatatacgtttttaattcaattgctaactaaatgccatgtcaacccatagagtaggtcaaccctgccacgtcagcatcaccacgtcagcgaaatcgtcctccaaaaccaacaagttagtcaaatatattgtaccggtttcaatagttttacggtttaggatcatggaataaattcgggccacttttaagggagtcaaagtgaatttattcctacatcttccgaagtgggctgctagcccgttagtggcctgcaacagaaggcgtttcgtgcggactccagcacagcccatgctagaaaaattggagaaaaatatacagcatatcatattatttagggatttaggcgtgtattaagagtcattttcccgacatatacttatgcatacacaatatttacctgctcatctaatcattgatttttagctaataacactaattagttattttcattgtttatttcaattttaagggtgtattgatataatgatatgttataatcatttttcacacatctacttaagcatgcaaaatatttagctgcccatctacttattgatttttaaagctaaataaaattaatgaacaagtaaattgcatagtcagtacacctttacgaggtacgtacatttacctgtcagttgtttgttttggtgcataaacgtgtttgatttgtataaaccaaagcccatgtcataactaattgcactaagttgtgtataacttctatagaatatgaaactaaaatgaaatcaatatggagtaatggaaaaacaaaataaatgcaatgtgtatataaaaaggttaaagtaaacttcactttcgacaacattttattaccggtgtttagctttgaaccaccatttaaccaatgttttcactttggactgggttagtatacctttgtgacactttggatcatcctcaactctattatttgtgtacatccaatttgtcatatgttgaagaaacagtctacaacatagggagtttattgatgaataggagccagcgtacaggactgtcgttcatatgcttgagaagacagtcggggtggttcaaagtaccacaaaagtatatatcggatatcggtactcctacaacagggcagaaaggaccccccctcctccccccattggagatttagcaaggggccgaacagagttcgagtttgtttaccgcgaaaatgtaaaaatgaacacaagcgagtatatagcttcaggccgctcggaagcgtaacaccctactcccgtgtttgagactatgtggatgccaaagtgtacaatacaagcttgtgaagtgaactagggtttctgttctacctagggtttccttttttcccctgaaaatctctttttctagtggcatgacccctccttttataacccaagggatctacagcgtcgttatgtagagcacccaaaaaatatatagtctaatgtttaatgcgaccatcacattattttgggtgagtgggatccaaacatgcataatagtcactcaagcctcaatgtgccctatgatcacaattaaacaccattcaatataatctatgtagtgctaaatagtaagcaaaagagatatttctacttcctccgtcccaaaatatacctatttttaagattggcacgggtattaagaaagcatgtgagaatgattggaggaagtgtgtgattggttgaaaatagaaagtaggtgaagaagaatggttgtgattggttgagaggaggtaggtgaagaaatagtttcattttggaacaaggcactatgctagaaatagctacatttttgggacggaggtagtaaaacttagcgtgccggtcaacttcagtctgagacatgcccgttaaccattcgaaggtggcaaccagatgtgttacacatactaggagacttgacttaatttgctaagttctagaatatctatgttgttcaacaatccacactcatgtctagatattctataagcatagaacataccaaggcactttcatcaaaacaaatggcatccataaacaaggagttataaaaaattgataatttagagtctaagtttaagaaacatacggtcgaccggccttataattagtggttcacacggaagtttatctaccaaagacccataagcaagccaactaggggtagaccactaatgaaccgtcctgaagagatcaacggaacgcgctgcactcaactacctgcaacacaactaaaatataccacaaagaaacaagtgtcaatacattaacacgtttaatgtactggcaaggcaatacaatcctaaatacatacaagctctaaataccaaggaatggctatttatggtctcataattgcattaagctgaaataatttcacaaacattttgcaacagaattttaaataagcatttgcaagacttagtatagttatcatggtatagcatcatattagtgacatattaccatcatattcatcatcataatacaagtagcatgcttgctaccctcctcagcagcaagtcaatcatacacaagtatcatcatcaacatcattttaaatatcactttcaaaagcatttataaaacacaaaatctatgccaatgaccacactatgtcgcgcataaacatgagcacggctaatcgattagtttttgttgatgcgagaaacaaaaggcttgggagatttgtttaactcc

SEQ ID NO: 100621 - DNA, 1405 bp, Oryza sativa
tcgccaccgtgtgccgtcgacggcggcttcttgtcccacatgaacttgcccctttactcgttgagccgcatgttctccagcttgagaggcttcagctatggcgccgcaccacgcaacaagtagctcatcagttccccaccattgatgaacatctcaatgcttgacagttgacactactttacttacctgggtctcgaggagagtgatcctggcaaaggcgtcgtcgtgcttctcctccatctcgtcaagaatctcctccatggccttgctctccttgagcgccatgctcagtttctcctccagctccctattctcccacaccaacctctctatctacatctgcatctcccccaacagcccgtgcggtggcggctagccgaaggggagagaaagagagaagggaagaagaggggaggaagaagagagaggatgacaggtggggctcatatgttagtgggccccatattttttttttttgtgtgaatgacaaacgagtcccatcccacatatacgtttttaattcaaatgccaactaagcggcacgtcaactccacagtgtaggtcaatccgccacgtcagcgaaaccactctctaaaaccataaagggagtcaaattacacctgtttcaatagtttgggggtggagatatccggttttgcggtttaagatcatggattaggttcgggtcacatttaaggagtcaacgtggatttattccgaagatgtagcgcgtagcctcgataggccgaattcctgttccagcctaacaactatgggccccgcgcgggtcggccgcaatttcgtcctggcccatgtgaatttggccctgaaaatatctataatagaactgaggcccattgttgcgcgtgctgggctgaaaagaagaaatggagaaagttggaaaacatatcacgtatggaaaaagtccagtttgactcccttaattgtacaccgaatctaattcgtacccctcaaccagaaaaccggatagaacgactccccgaactattgaaaccggtacaatttgactccctcagcggtattggaggacggttttgctgacgtggcgctgacatgacggtgttgacccggttttcgtcccacgtggcgcttaagtggcattagaattaaaaaaaaattgtgggacccatctgtcattcatatcgtgggacccattgacatgtggggggcccacatgtcatcctttctctccaacccttcttcctcctccctctctctctaccttctctatcttttctctccttttttctcttccccatcggatggtagtgccggtgaaggacagggggcggcggtgccggcgtcggggacatggggacgcggtggggcgaggaggccgcggcggccaggaaggcacaagggaacgactggggggaggcggcag

SEQ ID NO: 100622 - DNA, 551 bp, Oryza sativa
  unsure (1)..(551): unsure at all n locations
cattgactttaaataaagtaatgagaccatgttacctggcctgacacagctcactatactagttttgtgggatcatagggagtagtatttaatagtagccatgcacttgtgattatctttttacaaattataattgatttgtgttgtttctttaatgaattgttaaattaattaacttggttatatggtcttccttgaaatcaacaattgggatatcccaaaaaagttctgaagtcaacatcaattgaaagcttgctttcttggtgtccttggctagccaaaccttcatgtagtgtacacctgtcatagtctacagccaaatgtcatcaaatctaattcccttcatcttcctgctctgacgatgctttgtgtgtccatcactacatatacttaatccagaactgcatatncatcatattctaggtgttccaatatgaacagatgttcaacacctatggtttaaagatatactgatatgcaactgtgcatcccgtcaacagtttttggtatgttcccttttccggggcttcttcatgttctaatctaatggg

SEQ ID NO: 100623 - DNA, 527 bp, Oryza sativa
tacctgattggtttcactgtatgaaacatggggacccatattctgtccatttgttggaacttggaagttggaagagaagagaagagatgcctatgtggagtacagtaaaatacagtgctggtacgtgcatggatgaggctgtccgtgcaatgtgttttggtcggccagattcgtttgtcgatcgatcatatgtgtccaatcaaacggccaatcaatcagtacaaaaaggagaatgcaaagtttgcaactgctgcctacctcctctcggaagcaagaactcatgcccaattagctattgtattagcttaatcagactcacagcctggtacagcaagaaagcagaagctaaaccaaaaacctgcggctaacactacactagctagaagctctgattatcagagagaaggcttctgggaagcgtaaagcagaacattcctatcctatggaaatgaaaatgaaaatgaaatgctgccatgttttgggatgggaccccttctttaccattgttcaaaagctaaagaagcttt

SEQ ID NO: 100624 - DNA, 715 bp, Oryza sativa
atttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatataggctctagtactttcaggctcagccttgcaacaatgaaatggtcctgtggtttcagcccatggactggttactggttagagatttcgtaattgtcatgctgttctgtggaaatttccagaagcttctagaatcaccatatgcacaaacagatatggcatatatgtatgcatacaaaaacagtttttgttcatgggtgattaaaacatgggtacaagtgattcccgaattccaaatttattgtgattgatcttttcacaaatcacaatatgttcaggagattaccgaaatttggtatattctcatttgggttactctggatcccaaaaaactttacaaggaagtgggattttgctgtgtcatcagcatatgcttaagctttgcatactgcagagaagtggaatttttgcattggctaccaaaccaagtaaactgtgatcatatttagcaagtgatcttcaagtgggatattaaatttttacataatcctaaatacttattcaggttccaactaccatctccacttcaccaaatgttacacatttattt

SEQ ID NO: 100625 - DNA, 648 bp, Oryza sativa
tgtgatgcttgtatgtaaggtatattggcttggcgtgtttgtacttgagggatttgaatatgtgggatttgcatttgtggtacgttggtttgggtttgggggatttggttttgaggaaaatgggtctggttgtaaaactgtggttgtatgagttgttgggtttgaatggaagataggttttgagtagtttgcaagggttgagtggattgtggaatttgggtggaaagtttgttttgaacagattgtgggatctgagtgggaagttgattttgaaccggattgtgggatctgagtaggaagttggttttgaccggattgtgggatctgagtgggaagttggttttgaacggattgtgggatctgagtgggaagttggttttgaacggattgtaagctttgagtgggaagttggttctgaggaacttcttgcgttggcttatcaaccggagcattccctacttggggattctctttttcctcatttccaacatttctttgggtctctttcccgacttgattcggttgacctttaccagtgtttagtgtctcttcctctctaccagatcctcctgctcccatggtttgatcatgcaaaacctttgcaattctctttgcagttcttcatattgttctttgttcaccataaca

SEQ ID NO: 100626 - DNA, 511 bp, Oryza sativa
tttcggcccattccttcctttccttcctctctcttccgccggcccaacctgagccggctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctattaataggaccccctagtcctcctctttcgtttgccccctcttccgtcctcttccgtgctccgtagcttcgtcgccaccgccggcaagcaaaccgccgccggccgccatttacggtgccg

SEQ ID NO: 100627 - DNA, 682 bp, Oryza sativa
tacagtacttcagttaattagtcgtatagctcgaaccacacaccttttctgacggtgacaaggtagggaagcaactggcatggctagctccatcatcgtgggatgcaccacacacgccggtcacactttccctagcggatccatccaaacgagaggcaacgcagccatgtcgggatgagaaaaaaataattccatgcgtgctgcaacaatccctctcactactacctttgttctaaaatattctaaaatataggtattttaatataaacataactattagaaatataggtcttaatggttagagtaagattgtgattgaatgattaagaaaagagagtgaatgaagaaatcaaatagaaaatgttatcattggtttagatgagagactgggctagaaaatttcttcttttttacttttttttttttttttaaccggacaaagtactatacttaaaaatagctttattttaaaacgaatctagtacgtaccatgctacgtgtggctaaaaaataagtctagtatggtgtaatcttttactattactgttaataatagtttacattgacggttattaagtaccgatttcaaccatcaatttcctcaaataataaaaggagaactaatatttcttacatgaatattagttgtaaataatgtagtttcacttgtctcggagaatta

SEQ ID NO: 100628 - DNA, 716 bp, Oryza sativa
tcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaacatgcggtacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatcttttgtttccccctccacattacaaatatcctacgtgttgatctcccagacgatgacatcgtatcattattcttggccctctgatgttattttcttattaacgatatccatggaacatatttttttccaactaacttaaaaatgttcatcattacgatagtccttaatttattcgaagataaacgtattagagtaaccggattacataatatgattatgaaccattgttccacaatccgtgcatagcattgtagtggctattatataaggcagtgtacatagcagaagatgtattcataacatatccctaattgttgtggccgtttattttgcctactaatagtcatacattacgacgagatcatgtgataccaacaata

SEQ ID NO: 100629 - DNA, 659 bp, Oryza sativa
atatgctcccagattgggcctcccaagtatgcaccctcacggatggactcccacacatcagataatgacatggtgatggactcccactgatcatcagataatgatgaggtcttagccttagaacagttcatgaaatgccataaagaaattgccatgtctttcggttgcctgcaattaataatataacaagaagaagaccataaccattaagactatgctttgggacgaaatggttggaaaccataaaaaaaatagtcccaatgattttaataaccatattttcttagaaaacaaagtaaaaaaaggcagaggcggatataaaaatggtattggaaatacggaaaattgaaaataaaaagatatggaaaaaaatgcatgtatcgatcggaaacatgactatgtaatatctgaaacaataatctgaaatcacatatttaacttgacatgattatataatatgaccacgtgaattcaaacttacactattctaaaaaaaagaaattcaaacttacactacgtaaatcacaaaccatctcttctttaggcatgtactcaaattaggaattgggttgaaaagttgatgggcctctagtaaaatagagacatggtatttagaaatatggtaattaattacagtattataaaaactataattttcg

SEQ ID NO: 100630 - DNA, 663 bp, Oryza sativa
caattgatccgccgttcccgtgtggccgcctccagatgtgccggttccatcgatagcatacacgtcgcgcggtgtacttgtcgatgatgaggcctggtctttgagcagatgtaggatagatggcttgtggggatcaatatcgattaccctaacgaatcaatctgatgtagtcgccgcaccttgttccttgtcagcatctcgagaagagatttgaaactgctggaccttatggggtgatatcttcatggcgttgagaaggaccttgcagcttgagaggtcgtgagtctttgcctggtggataggacaatagatgtcacgagttggggaagtacgctgaattccgcactcttcgcaggcacggatttcagctcgtacattgaggaaaacgaaacaagcttgcaaggtgtgcttgctagtcctatggacgggacaccaagctcttgtcgcccaggaagctgtcctcgtcagctcgcatttcttgtggggaggacaagatctggccgcattaggatccttctcaggctcgggtattgtcgatgttctgttctccgcttccgcgggaggatctttcgacatggggttgtcgaccggggtcgtaaccacaccgttctcgctcccgataattgctgaaccagtcgagatcggcattgtggtgtagaccgg

SEQ ID NO: 100631 - DNA, 511 bp, Oryza sativa
attcttcggtgtgaaaggaggaatgtttggagaccgtgattcacggcgcgtccgtcggagccggggacgacgagccggagatcgtggcgagagtcgtgatgcctcccgccgctgacgacgacatggccgccggagcaaacgccggcggtggcggcggcggcggcgaccgatcggagaagaaagagcgggaggaggaggaggatgaggaggtggagaggctgaaggagctctggctgtcgctcatggagcgggagcagcggctgcagctgggggaggcggagctcgacgagctccgggagcaggacgccacggggcgtgagctcgatcgccgcgccgccgtcgtaaacgtcgtggaagcgcggatgctggagctgaaggccgcctcgctgcgggaggagaaccgtcgcctggaggaggcgcgggcgtttgagctcgacgccgtccgcggcaagctggcgcgcgccatggagaagctggcagagctcagggcgcgcgtggagcgcgagcggga

SEQ ID NO: 100632 - DNA, 613 bp, Oryza sativa
acacacttcatttctttcatatataaaaaaaatgtacaaaatatcgtcgaacacatatacccagaaaacgctcgacatgatgatgatgtattattgttgttgcctccgttgatgacgttctctgtttctgcgttgccaatgctgtctcctcctccactgcctgtgattgggttggacgatatgttgatgcataggaagaagaccgcggtgtagaggatgcagtgccgagaggagtcgcgcaaagaaccgctctccaaaatcttgatcgcctacttacccatgcagcttcttagatggatggaggaacaaaagggtgggatgtgtaccgtgagaggagaggaatacgagaaggacgaataaagaaaagagttcttatctctgtatatcccggtgatggaaggttaacagagagacgtttcggcagtaattgagacgcttaattgctccatacattagagccgtaatgactgtccatcagttatttttttaggagtacttgagacgcttaattgctccatatgttacagtcgtaatggctccccatcagttatatcatctttactcacaataatgcaatgctcggaaggggaggagagcaagcagccaacccccg

SEQ ID NO: 100633 - DNA, 516 bp, Oryza sativa
accccctctctaggtcaccacgtacggtgggttaggtgtcagcttacaggtgcccacctacccgcatttatggcgacccaagcggtcgcgccacgccgcatttaatgtggcgtgcagtgtactcaaccggtctgtgaccggtcgaatcaccgatgggactgggtagtgcgcctgtgcgtactgctcgtgtgtcaggcggcgtgcagcctaacatgtcccatcaaataatgatgcactggtggagaaaccatctttggtcggtcgcccgaaatccacaatagtctcggttccactaaaaaccgggactaaagatgatctttagtcccggttggtggctacagcgggcatatttgatctttagtctcggttggtgttaccaaccgggactaaaaatgatctttagtcccggttctaaatctgtcaagccttgtcaggccccccgatatctttagtcccggttggtaacaccaaccgggactaaagataggatctttagtcccgggtgataatatcaac

SEQ ID NO: 100634 - DNA, 509 bp, Oryza sativa
atataatgtatgcctcatctttatagaaacaacgtaaatatagttaaactaaaaaggcagtatcgaaaccggttttagctgctctaatattggaagtattgaaaccgtattgctacaggacacacttgcatgctaatattgaaagtcgatgcttacttgagggacgtaactacaaacacaacggtgtaatcggattataaattggatgagtaatttaagagaaaattttatttcaagcatagatgataggaatatttcccctacttgctcaatggattaatagcaactaaaacttctaaagtactagcacgtggatgtctctgatcaagactaattggagaggtaccgtttctgtttacctttccaccggcccacttaatattacaggctgtggaaacttaatgatgggccagttctggtgggcccgtggatttcaggcattcatccataccaaatttaccaatccaaacttgtccattgccctctccaatcctaaatccctacgattt

SEQ ID NO: 100635 - DNA, 628 bp, Oryza sativa
aattcgagctcggtacccttttagtttttaaatttttttatcatatgaaatagaaatttgaactgcattacttttactcaaagcaatttgcttacagtaattctgaaattctctaagaattatccagttgttgaacttcttacattgtctgtaggttttaaactaatttaacgtatccatttataagaaattctctctccattagaaaatgttaaatattgtcagttatttttttcttgactcttctctacagctggtaatttcctctgatcatagaccattacagatagagcttaaggactaattgagtataggcaactcaggtgatgcatcgttttttaatcaagagtaatgttacagttatattttgttttttctttgtatacttaaaaccatatctgttgttattctctaactcactagaaaacaaaacaaaattctacccttcaaacatatgcccttgtcccatcaaaatacatgaatgaagtgctcaagagaacacttaaccaaattacatatcattcatcaagcttagcccaatatattctatttttaatgtaacatattcctcacagtgtctttaataaaaaacaaatagtgggggatcctctagagtcgacctgcaggc

SEQ ID NO: 100636 - DNA, 511 bp, Oryza sativa
accaacatcatgcctgatggatcaaatactctaatccgataaaccagtgaatcaaattgatgtttatacttagccacagttctagtttgagttaaagcatctaatgcaaccattttctcatgctcaacaatcccctcaaattcagaagcaactgcatgaagaaattatttttttatttggaattatttagaattatttgtaacctttgtaaattctcccttttattatatatatatatatatatatatatattaatatatattacagtaggagcctctcctgctgtttcatgtcaaaaaactgcatgaagaaattggccccatgaactgaggtcagccactaacttgtaagagtgataccacttagcagcatttcttgacatatgtaacgcaaccacagatactttgaaatttggggtgatttggtacatatcaaaatacgtctcacacatattcaaccatatgcgcacatccgagccatcagtactccctctgtcgacaattatagggga

SEQ ID NO: 100637 - DNA, 785 bp, Oryza sativa
aaccattcataagtcaagagctatattttcaatcataaaaaaatatccagataactaaattattgcatttacttgttcttcaaataatatatcttttagttggtttattattattttcatcacttgtcaaaagctgtaaacactcatcatcattaacattccaagacataattctacacaagaaaaatatatcaatcctaaatgcaaaaaaaaaaaaattgagagagattgcatcagagtaaaaaaaaatgtaaaaataaaaacaagaggagttcagttacctcgataacgagattaaccgtggaggctgtctgctctgcctcctgcagcctcagcgcgagctccatgttctcctcctccagcccggcgttcgccgcccgcagcgccgccgcctccgccgccatcgccgcctccctctcctagacgttcttctccagctccgccatcctccgccgcgccgcctccgcctccgctgccagggcgccctccctctcggcgccgtccttctccatcccggccaccctgtcccggagcgccgcggcctccgccgccgcggcgacctccctctccgcgccgctcctctccagcgcgctcgccctggcacggagcgccgccgcctcgcgcgcggcctcctcccgctcgcgctccacgcgcgccctgagctctgccagcttctccctggcgcgcgccagcttgccgcggacggcgtcgagctcagacgcccgcgcctcctccaggcgacggttctcctcccgcagcgaggcggccttcagctccagcatccg

SEQ ID NO: 100638 - DNA, 565 bp, Oryza sativa
tggtcggcctcatttctgctcagcttaggtatcaattctgcaaggaaaactttcctgactcctgtctgggttatgtgcccattctatgtgattccacagcctctctcttatcccagtgcttttcccaacacccaggcattgattgtggctacagagccagcacctagctcataggaagtattcactaaaaatgcactggtatggatggatggcaccaaattctcacccccacgcaggaagctgtagagccctgcactttatatgtacaaccctcttagatcgtctaagaaggaatgttttttgaataaaattttctgatctttactaatgctcaaaaattaatgtataatcttaaatcaaaaagccaataaggctacagggctataatttttctgacacagaaaattttccatattcattaactcaacagccactgttaagtacttattatgttcagggctcagggtaacaggaactttgcagatacagttgtgaaactgcataccgtcctagctgacagtctaaggaaaagataagtcacatacacatataaccctaatcatgg

SEQ ID NO: 100639 - DNA, 522 bp, Oryza sativa
gtaggtagttcattttctctgtcataacagcgactggtagaaacagaaggtaactcattgatgaaattatcattcttcacatactgaagggagagcatctcttctaaggtgcatgtgctccttggcaattctacttgctcttgactgatctcatcacaagttacagttgcccatcgctctgaaagccgttgcttggcttccttagtaactgatgactcagcaaagtgggagatcttgctaaaagacgatcccagatagggatttccatgttttttggtataatgccatgttcgctttgacacaggactacatccccctgagtcactgaagctgtcaccttcatcttcaatatagtcaatatcagaatcactgttctgatcaatttctgaatcacctaatgaactttcatctcctccatatccatttgagtatgaggaagataaaaaagattcatctccttgatgacagccatcttgctggttatgaatgataccaggctctacttttgtagatcgtagggtt

SEQ ID NO: 100640 - DNA, 555 bp, Oryza sativa
caatcattgtagtaggacacaacatatctgtaggatcatcctttgagccattgcctcttagcaaaataccaggactgatcttatcacccatctccataatctgcttgccatccctttgaccagatttctgaccacttttcaggaaactttcagaccctacctgaacttcctcaaagatactctcattgaaccatccttgctcaacaacttcttccagctcaaagtgggcttgatacagcagacctttaggtgtagtaaggattaacttcaagggcagcgactcaagctccatcatcccaactttaaatcttatcacattgctagccctaaaggtggccatgtcaacttccataactgttcccaagttagatcccacttcatatagggcctggtaacctctcatagcatcaggaatgccagacaccttcacccaagcagtatgcatcttccccactgcatcagactcttgtgtccattctttcacattgacttgaacatcagtccccttaacattgaagtagtcaaagttggatagctcttcaaattttatcttgt

SEQ ID NO: 100641 - DNA, 504 bp, Oryza sativa
ggcgaattcgagctcggtaccccatatatcatatcatatcatatcatatcatatcatatcatatcatatatcatcatcctggctggcttgcctgtctctcccactggactgggaactccttgatgtctttgcagtgccctgaagaccttactctggagtcagaccaactggctaacatcctggctctcctactcttagctgtatacttaggcaactttcttttttttttaattttattttaagttctggggtacatgcgcaggatgtgcaggtttgttacataggtaaacatgtgctatggtggtttgctgcacctgtcaacccattacctaggcattaagtccagcgtgccttagctatttttcttgatgctctccctccccaacccccacagatcaccaggcaactcctccacaagccgtctaggaggcggcaacctccaagagtaacaagcaatgacccggcgtggagatgatcaatcaagtgccacactagctctacaaa

SEQ ID NO: 100642 - DNA, 655 bp, Oryza sativa
gagcacgtctttattttcttgagacacccatttatttattcgttccaatgcagagttcagaaataaactaaaaaaaatcctgattgggctgacaaaaatgtttcaaaagttcagtacaagttattcgcattcctagcagtctagaaactttgaacaatttccaggatgtccatgtgtcaagaataaatggcatgatttcggggaactgtgcttgtgtttagcctagcacttcacttgttgcttgaatcacatcaagtcaaaggtgtgatgttggactgcaaatgcgacgcacgtacacttcatcaaattcaacatctctgagaaatttgcaagcagacaataattaatgcaacagtacgttccaagttgcatccgaaggtgtaattagtcagcagttgagttgagaacagtatgagatactcttaacttatcccctaattaacaccttttgtacaggcgacgacgtgagctcccattacaggagacatggagaatagtccaagctccacagagatatggcaggcagcagcaagcatgggcaaccagaggctgctctttttttttttttggtcaagatatggagtgaattcgtgatagcatcacgtgaatcaacattccacacccgtcgtcgtagcacgcgcgtgatcagggcgat

SEQ ID NO: 100643 - DNA, 542 bp, Oryza sativa
gatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatatt

SEQ ID NO: 100644 - DNA, 591 bp, Oryza sativa
taaaattagcttaaattcggaattagaaatagcaatattgaaagaagaatccatataagaatccaatacgagattaattaaaatttagaataaaaatataataatatccaaaattagaaaaactaaaacagagttcaagtaggaatacaattttgaaacaactgaaattcagaataaaaaataaaaacattaaaagaacacaatatggtattaactaatttttttagaaaaaaataaattctgaaattagaaaaaaggatttcaattaggaataaaatttataaataactaaaatttatgataaaaataaagactattgaaagaaaagaccatctaaaacacatgacgagataaattaagtaacatacctataaagtagtagagttggtggcagttaatacagcatataaaaattgttaataaaacaacaaatagaatcctaatgacgattaaaaggagggatatcaggcaggccgtaaagtaaacaagtaaagcggttgccgggacttctagaaagtataaagaaaaaaaaccacattgataatcattttcgatttttaaaatctcaatgacaataaaaaggagaagcag

SEQ ID NO: 100645 - DNA, 597 bp, Oryza sativa
ctataaaaggccccctagggccatgtaataagggatccaaaaaaaatttcactaagtaatacaattattctttatttctaaccttatttctaaccactgttgagagaaccaagactttcgatgtgacgcagttgtctattcgacaacataaggcgtaactgctttttcaccaaattccctaatacaaggcggcaacatctcggctaccgtttgtgcatgcaagcattgatgagtcatgtactggtgcatgcagaataaaccaactcttgatgatgtgcatgctggtcattcgcttggaaagggcaggtgtcgggtggatgctgcatggtggttattgctggcgaaactaccgaaacatcacacatgggaagaagagaaattatcggtgcaactgctgttaagggcacccacaatagttatctataggctctctacaagatatacatgtcagcatattttcctacttagaagatattaaataaagagatagagcaaagctatctactaacttagagatagtctatagagaaaaacaaggcaatgcatacgagagctatagatatccatgtagatatactattgacgtggtttactatt

SEQ ID NO: 100646 - DNA, 630 bp, Oryza sativa
agtccaaatggttgatattctgacgttttgaataaattgtaaataataatccacattttatttgcaaaaagatctggatcgatgtcatgatcatatacgtgtccatatgtttgccgttctttccactaaattaatttaattttgcaagtcaactctcgctccggtttttataaatacgtacaaacattttgtatttacgtactgtttcgtttatatcaatataaatagaatttgtatttttagtaaacaaatcgatcaacctagctatggtcattttagaccccacaccatgataaagatgcaaatatatattcttctacgtggcatttttcagtcctccatgtaaagatatatttatgacctctattagtaacacgatacaattaattagtgcagacttttgcactacgttccgatgactttgtatacgtgtgacgtgtagtctgcagaggacttccagatagctgggaaaattatactgtatatgcgtactgtactctgttagctgtcgctgtactctgatgtgttttataaaaagaaatacgttaattcatgttactccatccatttcgtattatatataaggtattttggtttttaatcaaatttgtttaaatttgatccagtttg

SEQ ID NO: 100647 - DNA, 572 bp, Oryza sativa
atggatggaaaacgtgatggcagtggcacggttttaattttggaaaatttcaatggcacgattaagaatagacgaattgtaatgacatttttcggaataggcaaatttgcaatggtatggatccaattaacccttgaaatattttggattttattgatcttaagttatcagtttaattctaaattaaattaccatttaactcgccatgcttagttaaatttctagctataaaatagggtgtagagagaaaaggaggacacatatatgggctgcacgtacatatataaccttctttgtacatggtacgtgactacgtacaaagggaagagatgttacgtgtgggaggagggaggtggaggtggaaagattttttagataaatctgttggcttgaaataatgggaccaactattttaatgaaaacggatggacagatgttttggtttttttttagaatttcttaggaatttttgttatttattagaatgcgatgtagcgagttaggaacgttggtaggatgccacctggcggtttgagaacgttcgtagaaagtttaattgacttttagtatat

SEQ ID NO: 100648 - DNA, 516 bp, Oryza sativa
gctaaagtcatcttacccaaactgatctaccttattttaaactgttagatctatatattaaaaaaacctactgatcgatcaggccatcagagtgcgtatgtacaacacatgtatccagttccctcctcacggatgaaacgaacccactggctctcgcctctttgttttccttaccacaattaagttaaccactgaataaaagaagatactaaaaattaccccgaaaaaatatctaccttattttttaataaaactggtagactaattacttcataccattagacatctaacgactttctaccaacttaattatatttctcaacttgtataccaggtctatttacctatacaaatatgtaaagctaaatccatctacaaaggtacgaaaaaatctgtctctgaatgaagctcttttttgttactatatatctccgtcttataatggatcctaaaattttatacccactccgtcccaaaatataacaacttttagcacttacgatttgtcccaaatat

SEQ ID NO: 100649 - DNA, 660 bp, Oryza sativa
tgcaagtagttcatcacttaagacgggatcagctagaactcgtatacaattaacctacgcagctgttgaactaggcgtgccaatgtgttgtacatacgtaagtacattacatacatattcgttttgtttctgactataaagtctgatgattcttattatagtcccatatatatattttttctcttctataaatatagtcgacgagatgcatgcgtccaggggtccagcagcatactctattttctctagttgacgtttagaactaaaaaaaaattaaaatccttcatgcatataaagcgatcatagcaggcaaaaaaatgaggagcagttgaagaagttggtgcaaaaaggtgtccaaatttctaccgccgtgtttcgcacaacgtttacaaacgctgcatatcaattttactgaagtatatatttgtcaaaagctgcatctgtatctgaatatatataagcacgcaggtctcgatcgatcgagtgagctcaacctgtccccaagtttaagccccccaaaaaattaaaatgcatgtcactagtcactactgatcactgatccatcctggaccatgcatctcgatcaggcatcatcatcatccacgacgtcagcgggctccctccatggaatcatatcaaaccaatcaacaataacagcgt

SEQ ID NO: 100650 - DNA, 1179 bp, Oryza sativa
gtgcttcaatcatcttcgccatgatctcccgagtactttttccaaatcagaagactgtggagggctgaaaaaataaagtcaggtgcatcgactagatgcaccgagtggtttcgataattgtagtcaaccaagcgacttaatattaatatgtagcatatgcggtgtgaatccctgaataatatgatccaagtgatataccgattgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccaagatatctaatcagcctaagtcataatattggtcaataaaaatgcacacttacgtggcaaaaagcaacgatattgtacccaatcaattgcttaaaaacccaaacaacaccttgacttatataaaaaagtcagcagggcagctatataaagctttattgtttgacaccttttaagatgcattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatttggaacgggtgatatagaccaagtgtagctcatatcaatcgcttatgatctgagtgattatcccttataggatattccaaaataaatataataattaaatcccgactggcgcaagtattcggttgtaacccttatggggaataataaatagtccagtctttaaacatagaaaatagacccatgatcatgaatccatattgcatgtatccagagcaagtccaaattgaaggtatgatacttgtgtttgagctagtaagcccctgagcatatagcttgtccttctgtcgtagtcacaattg

SEQ ID NO: 100651 - DNA, 892 bp, Oryza sativa
atttttaaaagagaaaattatatatataccactaaaatttagtggtatcgattaacaccataaacaaattatgtatactctatataataaatcaactcaagacataaaaaaaactattttcatcacctccattttctctcactcataccctgaagggtgccaagcatggatctcaactggctacattatagtaactatggcaagagtatgcattattgagctaaagtcatcttacccaaactgatctaccttattttaaactgttagatctatatattaaaaaaacctactgatcgatcaggccatcagagtgcgtatgtacaacacatgtatccagttccctcctcacggatgaaacgaacccactggctctcgcctctttgttttccttaccacaattaagttaaccactgaataaaagaagatactaaaaattaccccgaaaaaatatctaccttattttttaataaaactggtagactaattacttcataccattagacatctaacgactttctaccaacttaattatatttctcaacttgtataccaggtctatttacctatacaaatatgtaaagctaaatccatctacaaaggtacgaaaaaatctgtctctgaatgaagctcttttttgttactatatatctccgtcttataatggatcctaaaattttatacccactccgtcccaaaatataacaacttttagcacttacgatttgtcccaaatataacaacattaccaccaacattcccttcccaactaatcacaatcctccacctttcacttttctcacctacctctacttctcaacccaacataacatctccctatttaattctacctactttcttaataactgtgtccaactctaaaacttcttatatt

SEQ ID NO: 100652 - DNA, 557 bp, Oryza sativa
ctgttccagcacgaatcatagtgcaatccaacgaacagaaaaacgtcaaataccaaacaaaaaatcacccgacaaagatattacagaatcgttccggaacaattcatctatgtgtcggaccgttcggtggatggacccgagatcgctaattagcaatcaatcgagccagacgatagttcttttttcaccacttaccttttctttttggcaccatatagtttttctttttagttaagtttatatacctaaagttatacatctgaagtttatacacctaaaatttattggtcaaagtttatatacgcgactcaaattcgaatttgggttcaaatatttttatatagagtatttctatacataatttgtttacatacgaagtttactgtgtatatatttataagtataaagtcacatgaatatatttttaaggattctagatttttatattatattttattcttttctaacttgttcttttttaatggtttgaaattcatggtgcagtaggaagggagcaacggggaggcacgtgcgtgttaggggagggaggggggggg

SEQ ID NO: 100653 - DNA, 643 bp, Oryza sativa
  unsure (1)..(643): unsure at all n locations
tctagggttggtggccaccgccaccatcctcggcgccgcatttgccgtcgctgacgcacctccgactccaccaccacaagcgcacaccacgagtgcaccggcgccccgccgcgtccaggtccaggctccatggatggactgtggtggtgacgcccgccggcgagtagtgctccctcccaccggagatgcagtcgccgccggcaccgttccccgttcgccgctcggcctccccactactttccgcgccattcctcatggctccccgagctacacgcttccgaacggtgtgggggaggggggggacggcgtncgaacccgatcggcctcttactccgatgaggagagggagccgtcggcttagtctcgccggcggacgatggggacttcggctgctatggcggtggggacggcagaaatggaggcgctggcggtggtgtaatagggggagatggtggcggcgaaaatggaatccgcggtggatgagggaggcggcggccaaagtggtgaaagaagaggcgccgaaatggacggcggcggcagacgaggtgaaggaggcggcgccgtctcggcagcgtcatgtgcggcggcggcggctcaaaccgtggggcggttagggtggaccctaaccccccctcgcccccct

SEQ ID NO: 100654 - DNA, 547 bp, Oryza sativa
acggatagttaaagcgggacacggaaacccaaggtttatcttttttcaggacggagggagtatatacgtgcacgcgcatgctgacaatgtgcggattgcagcttttgcacgtggatgtctggatgaaatgagggggaagctgaacgaccggcaaacgctagagcgcggcagctgcgacggcgccatctatgattcgagggggacgacaagagcaatgtcatgatcgggataccatgcagtatagttttgataaaaggaatatcatatcgtctgctatgagatttttttttaaggttaattaatatttatattaattatatatagacattctatataaaaatatagtaatgatatatgtcatgcaaatagagacatttatcaagagaaaccacgttggttttgatatatttaactgtatttatataaatttgagtgtatttatttacattattttcaaaccatgatattttaaaataatattttatagtataatagggattgtagaatcgggataccatctaaaatttcgtaggatcgtgtagtaatg

SEQ ID NO: 100655 - DNA, 670 bp, Oryza sativa
  unsure (1)..(670): unsure at all n locations
aaacaaaatatgatctcatggtttaataatgctgatgcccacgcatggcgtgggccacccttctagggatcctaaaagtcaaataatttcctccggaggaagtactatgttactgtgccaaagtatatgcaactctttgtggtgaactaatgcacactaccaattggcatgctgggtctgaactccaaaactcttttatcccggcttctgcttctacactaatacattatcaaacttggacgacttttattttgttacatgaaggcatgcttttaattggcgaaggacccctcccactcccctgactgtttattgtcaaaagatcttaaaatcttaactcactaacatatgaaactattaattaatatcaacatgcaaaaattttaatatatagatatgagaatgactttntagcagatttgccactactttcgggcaaatttatatttgtaaaggttctcatggaaaaacaatgataaaatgtatgcgctggaaactatgtgaagtaatatcctacacacgtccaaaaataacgaatttaattgatctaacctggcctcaatatcagcattagatcccatatatatgtaacagggccaccttcgcatagcattctacttatactttcacattattctaacgtgggtcatttgatgcactgggattaggg

SEQ ID NO: 100656 - DNA, 687 bp, Oryza sativa
aattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaagatcctccgggaagcatcaagcatcttcgcgtacgagtcgtgagacgatctgtccatgcctctgaagaaaaggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggatt

SEQ ID NO: 100657 - DNA, 694 bp, Oryza sativa
aaggtaagcttattttggatgaactggtagttgctgacatgaacagttgaacatttccgccgggcatgctttattgaattattgacggtcaaaatagctgttgctagtccgtttgtctttcccttggtcaaaatttgattgtccagatttgctgtattttttaaattgctggcaaagatgcttatattgataagtgtccatcttgtgggtggaattaaacatggtggtattacttagtataaacacgagttagcaaatactccctccatctcgatttgtatgatgccacaagccaatggagtgaacaatctaaaatgagtcaaaatgtatgatgccacatggagtgaacaatgttccaccatctttcccttctccttaaaccatggcctgatggcgtgatgcggagccgtttgcatttgcatgtcgctgccgtgattcctgaggccacctcgaaccgccttatgctcatggctcctcgccaccgtggtggcagtggttgacggcctcattggtatcatgtgatgtagccgccgtcctcgttgtacacgatagagttaagctggtgctatgtttgagagaggccatgctactgttgcacttgcatcgcttgtgccgccgtcgagaaaaaatcgtgcgcgttggcggcggctccccaatgttgtgttgggacttgggacagtgggcttttgaaggg

SEQ ID NO: 100658 - DNA, 1531 bp, Oryza sativa
aattttggttttgatccctttcatacccataccgttagttgaatgtttaattctaatgaaaaggacctttttgcccttagacatgaaggaaatctaaaaattgtagactagctatattgttggaagtgtataattttgttatataagactatcatattcatgactttattgtacaaggtattattcatggcaaagtttatttttacctaatgacataaaaactaatatttatttacctactaaaagagtatatgtagcatttgtttatggtagttcaacatattttctcctgttgtatatattatataggaatgctttccaaaactatgtttatcatttaaaaaaatgctacatgtactttttaaatatatattaaattttttatgtacataaaacttatgaatatgataatcacacaacaaattttatacttccaacaatatagtttacaaatttctacatattcctcacatattgaagggtaaaactgacttttatatacctattaaacgggcaattaacggccagggtatggaagagatccaaatcaaaattcagaggtatacaagggagtgaaggaaattcatgggcatagaagggatcggctaaaatttcacgggtatggaaaggaattttctctcttttaaatgtgatgtatgtcaaatgtcagtatgcataccccccaacacacaccctcaccctcttgtgatcttgcacttatacttcaagttgcctatagtattgttgtccatgttgtgttatagtttggtgacagtctttctaaacaaaaacaatgatggttcatctatgagctaaactctgtttcgcttatttgatcctgcctttttcaaaagaaggtagttatcatttcagtgtcttaattgatgcccatatgtgataatgtgaacttgtgggcttcttaattgtccatgtatacatttcgtgatttcctgggaaagtggacagctggacacacatgggggcatgcacacttaattgctgcactgttcatctagtgacaagaatgggcaaatgttatatagggttgcaagtcattctatgtgtgcttaacaattgattttgaacacaaatttcaacagaactcatccatgaatattgcttgtttgaagaagttatataaggacactgctatatctactgtcacataaattacaagtagtttcttgtttgacttaatacaataaggacagcacatccctcctcaaaggctcaaactgactacagttatatcatcattttgaacttcatgttcatgttctctcattttttattcagggatttaaatcgccacttactgctgcttgtttctttaggagttagttcaaagggtgacataactcaccttttactgcagcttgaaattctttttcctctctctttgattcattcttgcaccctcttgctccctgtggacgttgatgcttcttttgtttgatttgcttcttgtttcaatcgtttacataatctcaattatacctcatacttgttattttcctgttgtttttcgaca

SEQ ID NO: 100659 - DNA, 703 bp, Oryza sativa
cccctagcactgctgatcgtatgatgcgacagcttgtgtagtttcctttaggaggatcaattttgcaacaagtgaatggcatttattctttcgccacgtatatgcgcatgacatgtggtccctggacctgattgtcatgtactcgggccgtggccacaaataagcaaatgcgactcaactatataaagggtacaagagcacatttccttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgcccccaatacatatattactaatcaaatgtgctaatttaatatcacatctcttacatcatgttttcgatactccaggtctcatgccaaacataatttcatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgc

SEQ ID NO: 100660 - DNA, 654 bp, Oryza sativa
agagaggacgagtgggcgactaaattgtcgctggctacacacacaacccaacgcaagtgcagcagcaccaggctagctttgattgggacaagcgattgtgggcccacgtgagctgactcgatgcaggatgaaacaacagcaacaagattaaaaaattggatggggaagctagctaaagagggctctttgtttaggctcaggcttattggtctagacttttaagtcagcttattggcttatatgatttataagccagtggatttaatgtcccaagtttagtggtggagtcatacatctatttcatataagccaaaaaaaacttctctaacctagcttttggcttaatagtgttagagtgacttatggcttcaaaaaagccaaatgaaaaagctgcttgtttgttttggcttggacttttcaacttataagttggcttataagcctaaacaaagagggcctaaacaaatagataatagtcgatgtgaacatgcttattgtatacattagctcttagcaatatctctaagaggctgatgtggtcatttttgcagcccttagcgggcggcactattgaccttgttctaatggttcaaaatcatccaatccaacacctagaggtgggcaaacgggcgggccgggccggcacggcacggg

SEQ ID NO: 100661 - DNA, 598 bp, Oryza sativa
aaagagttgagaagcgtgctgggcatgtgtcccgatcgagaggagatatagttgtacaggggctaatagcttacagtaggtaggtagattcgtgtacgtgtggtgcagctagctaggggaagttagatgacggcaatgcgtcgcagcctctcatatgatatcgatcagctggagagctggcctggtactcttgcgcagtagggaaaggaaacggacggagtagctcacgcaatcgctgaccgcatatatgcaccccgggtcactagctacctttacctttttcgatctcttctcttcatctgcagtgtaaagcttttttgactgcttttttttttgtgtgtggggggagtgcttgtaaacaagtccatcgatctcgttaataaaattcgtgaagaaatcaattaatttaattattgtcccacagggccgggctgcatgcacagcaaataaattaaattaagaaatggacaagagcatggtagccagacaaagacggacggacggacggactgaggacctttatttaagaaagaaaagggggcccctgctgacctggctcatgcatttgctagctagctcatcgtcgatccaatggcga

SEQ ID NO: 100662 - DNA, 543 bp, Oryza sativa
tcctttactattaagaaacataataaactaatggagtagattgttggagtgtagaaatttatttgatgaaactattatatttatgagtttgttatgcacaatattatttatgacaaatttacttttagatatcatataaaaaattaatactccctccgtttcacaatgtaagttttatgacttacattgtgaaacggagtagtacttatttattagttattaaaacttttttttatgtagcatatgtgttttgacagtaatacaacaaatttgtcgtataagaaaaatatactaatgtgctacatagaaaacttttaataactaataagtaagtactattttttatgttatatctaaaagtatatttatcgcaaataatatggtgcataactaactcataaatataatagtcccatctaacaaatttctactctattattttatatgttttttcatagcagagggtaaaatgggtttttttcattaaaaatttaacggttaactaatagtcaactagcggaaaaaggcatggaagagatccaa

SEQ ID NO: 100663 - DNA, 669 bp, Oryza sativa
tagcacattcaaataagaaatgttggacagtttcaggatgattacagttaaagtatttgggatcacccagccatttcttttcaatattttacctttgtttaacagcatacctttttgtaacaaccacaaaaatgtttgaactttgacaggtatttagctttccatacgtgtgtaaaagaactatcaccataatttctcatcatctatatgaatttcactaaaaaacctgccttcgttcccccaagatcctgtggtaacatgaggagcaacagacagactaacatgttgcgcttgtgacagtacatatctcatttatcttttgggaaacctgttaaccatctcctaaaactttgctgcccattggtatagcactgactcactaatttatccttgtcacagatatcataaatagcagatattattgagcaaggtttatcaccaatctatttagcctctcattatctgctattatcaccattacaatttacaaatgatgactttcctgcctttcaaatgaatgttttgatgaaccttaagtaggtcagcgcaacaagatgagtcatctaccttcctctttttctagtttccaccaacatttattaaggacacttacattcattgcctcagatttttaataccaagaccccctttctttttttgagtgacaaa

SEQ ID NO: 100664 - DNA, 551 bp, Oryza sativa
gccattatctgtattgccgtacttccgcagggaaagttaccctctcatctgatctaccattgcatacatctcaaaaggaagtgagtaaaaaagaaacaaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaaca

SEQ ID NO: 100665 - DNA, 611 bp, Oryza sativa
aaattgggtgcggtgcggttcgggtcaagattcattcagaggggaagcagagcgacagcggcgcaggaggctgcccgacaccgggcgccgcgctgcgctttgcccgggtggtgctctgatgggtccggcctgccgtggctgctgccatgtccgccgccgtggccgtggccggctccggcatggccgctgccgtgaccaccacctcctccttccctaacggtgaccgaccacagagccacagctgctgcgtgcgtcgtcatctggccgacgagatcgacgcgacgatgaacacggaggatggcgccgggaaatgttatccactgacatgtgagcccagcttgtcaatcagttaaaattggtgataatactacctaggatctcggttgatccggttttgtaaattgaaagacctgctatacctgtcattttagtttagggatgaatttcagactgagagataaattgaggtacctaaagtgaacttgctcaatttcacgtcctcgtactcaatttcacatggtacgtactatgctaccacgttaccaggctaccagcacatgaagttgtgccctcaaatatgtacataaaagccgtgagtttattttagatgt

SEQ ID NO: 100666 - DNA, 677 bp, Oryza sativa
agtatttgtaattttgtaaaatttactcctttttctaggattttgcccctttgctttaaaataggaaaaccgggttttgacccgttgttcgccaaacaggttttacgtttgcgtagacgaagccgcagtaatcgacgaagagctgttcaaacttcaaagtctctacgctcccctcatttagcatgttgatcatatttttataaactagtatgttgacctgcgcagattgtgcagctaaaatcattatattttctctcatataataacatacatgttttctcaatgtattattcaaatatattaaaatgacaacataattttaaattttgtattaactttatgaaactactaatgtgtaatttttatattgtattttatatacgtgttagttattaattatttttaatattaaattttagttatttgtaaattatattcgactctagactcgtctttcaatatttcttttttgaattccaaattttcgttatttgtcaattgtatttctatatagactctaggctcttcttcctatattatttatttttaattctgaatttttattatttctaatcgtatttctatgtgaactctaaactcatctttcaatattctttaatttttaatttcgaatttcaagtatttctagtattgtattcctatattgactttagact

SEQ ID NO: 100667 - DNA, 631 bp, Oryza sativa
cgattccatataggaattaaagaccatatcctttctttttaaaacttgctaacgtacattgtaaattctttgatgtggaacaatctagaaatgtatatttgttataagacaatccagtttagtgataattagctaaaaacacaatgaccattacttcaatatttcatgagagaaaagttagaacgtattgcaaatatcaaagcatttatggatgatcatagaatagaaatcttcaaaaagaattaaaaaatggacttgaaataaattgaaaattgaacaaatgttgatgtatttaaaacccattcaaaatagaaaaaatcaaacaatttacaggacttttagaatgaatatatatatatatatatatatatatatatataaataatagaatagaataaaattttaatattattggatttgttttggggttgaaaatatcttatggggagtaaaatactctaaattttttcagaggaatttcatttcgatacaatattttggtttaagaattatatattgcaaaggtaattatcagaaaataactagctttcaaaggacacaaataagtttaattttaggttagaatattgtaaaaaatattttaatgaaaaatcacctgtgcataaatatt

SEQ ID NO: 100668 - DNA, 542 bp, Oryza sativa
aaagcatgcagatgcagttaatatattactatatcgctgtttacctgtattacaaatgtttagtagtactccagtaattatattccctccgtttcaaaatatttaacaccgttgactttttagtacgtgtttgaccattcgtcttattcaaaaaaaaattaaagtaattagttattcttttcgtatcatgtgattcattgctaaatatacttttatgtatacatatagttaaacatatattaaaaagtcaacggtgtcaaatatgttgaaacggagggagtatttgagaaagcgttaatattgattgtgattagccgccgtgggcaacaggaaaggcacatggattacgcgcgcgattgaagaagaaattccagtccacagtcaaggcaatgaatattcaatttacatgatgggcaaattggctacagtgttgttgactagactcgaggtgaggagagtcgtcggttcgatcccaaatccaaaagcaagaaatccaattcccttccccaatcagcaagcacaaccatggcgggcgctgtcct

SEQ ID NO: 100669 - DNA, 755 bp, Oryza sativa
aatttgaaaatatgattaagttatataattttcctgatattgaattatcattcccggcaaagttatttatagtttcatgttgttatttatacgtttatatttccttcgtcatttatgcccaactaagcttttaggggtaaataggggattttctcctaagcttgactggagccaccaccacaatgaatcttggagattgtggtagaggaggacactagcggacgcgaagatctcatagaggtggagatcttggtcgaggctgcagaggtatatatcccctaggaggttgagctcgcagtgacaacagagggtaagtaatgagagagagtagggcaagggagagcgggaggatgacgacatacagggccactattttattaatcttttcaccgactagattgtcatgtaggtgcacataagtgaaaactctcccagcttggatattagggaggataaagtggataattataatagttgaggagtgtttcctatcccgaatttatagttgaggggtaaattttagacaaacctgatagttgagaagtgaataattttaagtatatgtacttttctctttccaccaccaaagagattgaattgtcgccatcaaacattaattcgatcaagttctgtatgatcggtgatgagttgatgggtaacctctggatccggattccaattttacatgcttttcttaggaaggattctaatttggcatcttctctaaagagattattcctttgcactaaacttct

SEQ ID NO: 100670 - DNA, 658 bp, Oryza sativa
gcaccgcgcagcggctggccgtttttcggttaatctatagtagctgagctgggtggtagtacaaaattatatattttttaatataattttacttaaaattaaaatttattaaatagttaccttgttgtcttaagattttgaaagaccaaacatatatattaaccatttcattattattcttacaattattattctgttttataatccgatcacactattgtattcgttataattaaatcttttcgacaagatgtcatatgactatattctacttaaagaaaaatatatctttcaacagttaaaatttaatgttgcatgcgtgataatgtggctactccctctctctcatattacatgcatgtagtaatttttaaaataaattttcttctaaactatttatccaatctacggtatgatcgcaccattatgtttgttgtaattaaatctttacaacaatatataacatgattatattttgatgaaagtaatacatatgttttaacatatgttttcatttcataaactttttaaataattcatttgctatttttttcagcatgtataacttaatgtttcacccatgatccattaaaaatttaatcaaccatttatttcaaggacaactgtgttattgcccctattttatgttgcaattatg

SEQ ID NO: 100671 - DNA, 658 bp, Oryza sativa
aatggagtatgaatagaacatgaaaaattctattttatatcaatgaaagaagcacccgttcagaattaatgaatcagattttcatacgtgggctaaaataagttttttttcaatttctaactaatttaagttgtttttttcatttatattattagatttagcactatttgatccactaaaaattattgtaacatatagttttctctatattaaattatttatagctaaatttgaaaatatgattaagttatataattttcctgatattgaattatcattcccggcaaagttatttatagtttcatgttgttatttatacgtttatatttccttcgtcatttatgcccaactaagcttttaggggtaaataggggattttctcctaagcttgactggagccaccaccacaatgaatcttggagattgtggtagaggaggacactagcggacgcgaagatctcatagaggtggagatcttggtcgaggctgcagaggtatatatcccctaggaggttgagctcgcagtgacaacagagggtaagtaatgagagagagtagggcaagggagagcgggaggatgacgacatacagggccactattttattaatcttttcaccgactagattgtcatgtaggtgcacataagtgaaaactctc

SEQ ID NO: 100672 - DNA, 958 bp, Oryza sativa
  unsure (1)..(958): unsure at all n locations
catgctccaaaagagcagggttttgggataaatgtttttatcacatggatctgtgatagatgtgttctaaaatatgggatttcgtgatatctactcttatttgtttggtatggttagatcagttagagcaaagtttaatacttactggctccaaatcattaatagtcaatctaataactcactcatacaataattacttataaacatacactacatcatnaacatatggtccacctcttatacacatataacattttggaattcgtattgcagctgaatataaattcatagcccgattttcttctctcttctctcctctctcttttacatgtgcttatagctgacttgtagcctgctattgtactcgctcttaggccctatttagttcccaaataaaaacttttcaccccgtcacatcgaacgtttggacatatgcatggaatattaataaaaaaaactaattaaacagattgcgtgcaaattgcgagacgaatcttttaagcctaattgcgccatgatttgacaatgtggtgctacagtaaatgtttgctaatgatgaattaattaggcttaatgaattcctctagtagtttacaaacggaatctgtaacttgttttattattagattacgtttaatacttcaaatgtatgtccgtatattcgatcgtgacatgcaaaaacttctaaacatggccttaggtcttgttcgtttctccaacaagtcggagatgaaattttggatactcgtggcacgcttttcaaactactaaatggtgtatttcgtgcgaaaactttatatatgaaagttgctctaaaatatcatattaaatccattttcaagtttaataataattaaaactcaattaatttttatattcatcttaatcttcaggagaatcaaacaccacctccgtgattcagtaaatcaaacgagtccgttgtgttggttaataaaaa

SEQ ID NO: 100673 - DNA, 682 bp, Oryza sativa
ccttcattttttttcttgctacctctctcatccacgtaagtttataattaatttatagctcactattatctatgctataaggcagagtgtgagcaagttgggttgcagtttcctagtaactgtaaggtaaaatttggaggcagctcatccaagactgatccatctattggtatactccctccgtactcgtaaaataagttgtttaggacaatgtttaagtcaaactttaggaatataaatcatgaataactctcaagttattgagtttgaaaatgtaaaaattatatgaatagatttgtcttgaaaaatactttcataaaagtgtacatatatcacttttcaataaatatttttatagaaataacaagtcaaagttgtgttttgaagaccgtatcattgttcaaaacgacttcctttacgagtacagagggagtattcttttgttttaatatcaataacatctcaaaagtattttctatattttgtcacttttcatgtacaaaacatgttgatattgtggttggttgtgggcatgttacattttcggatttgaggtagaaaatggatgatgccatggatgtaagaaaatgcgcagttgtaatttagtcttaattatatttgataatcaactttatccttggtttgtcttcatttaaacagtcttctcccccatgtccggcgg

SEQ ID NO: 100674 - DNA, 685 bp, Oryza sativa
agattggaccgttgaagctaatgtcctatgtgaacatatatctggtgctaaaattttctaaaacgagaaatatattcttcggaggtatattatgaacgatatcacaaacttagtttcatcagaaagaaatatagaaaaagagtcgagtgcatgaatgtatgaatgtatccagcttcaaaactagtaactgcgtattctgatagaggatcctagaaacaattgtcaactggaaaagaaactaagaaaggctataacacagtttattaatggttaatgggtagttgtgtacttgtgttcataagcaaggatagaagacattatgaaaagctatgctggtaacaggtaaactgaccagttactgtaatgtttcaagtctattccagtttaccttttaaaaaaaaaatcttacaatatatttttcctcaaatgtaaccttttacaatcaccagcttcaagattacatacaacacatcaaacttcgtataattttacccttgtactggctttatcatatctattggtcacagacgatataccagtaaccagcatcaatagagctgattttttttcctcctctgatcataagtcgataatagggccttttactttgaccacatttctacgtacgttgacagtcaaaaagtgcagcacaacactgggaaaatgcaggggaaaaaaataccaa

SEQ ID NO: 100675 - DNA, 640 bp, Oryza sativa
cgattaatatgagaatttctagatcgtgagagcgaacgtggaggctcctttttctattcctttaataagttaatagatgtattgattgcaaataaagttgcatgctacttcatctgtttcatattataagactttctaggatttcccacatcatatatatgctaatgaatctagacatatatgtgtgtctagattcattagcatatatatgaatataggcaatgctagaaagtcttataacatgcaacggagggagtagttataaagttcgtacctaaacttgattctgagccaccttaaaattattattcatattccttgctgtcttagtctatttattattacatggtcaattattaacataacttagtattgcttgtttagacaattttacactccatgtttggtatatggatgtgaatgtgttggtcagtcgatgtgagtgattgttgaaagacgggtggagacatgagcatcacccgcaacataagacttttgcaaataccaaaaacttaataaaacaaaataatttcgactgggacgacatggatacaatatgtgtggttctatgaaacaacaagccatcgattgctgtaagtaaaagacccagtcaagaagcttcgcacgaaacaatcagagt

SEQ ID NO: 100676 - DNA, 513 bp, Oryza sativa
atttatttgtattttagattaacacgcaaatcatcgccctcattcgggccctaggtccacgcagcatcgggagaatgactggcaaataagggtttgggtaaatttccagtggcatagaagaaaatttacccttcatttcagtgtgcagagcagatttgctatgaactgcgtaccaagatcttgactagttgtgcttgcattgcatgttcatatcagcaatttaatactacctccgttttataatatttcatattataagactttttagcattgtccatgttcatatggatgctaatgaatctagacaagccactagcctattattgcaatgtagttgtccttaactacgattgcaagcattagaaaacttatatttccttccaaattgatccaaggtactcttcgtttcaaaatatagcgaacttggactgaatgcgacacatcctagggcctgttcactttgatgcccaaaagttgccaaaattttggcatatatagttatcaaaatttggc

SEQ ID NO: 100677 - DNA, 710 bp, Oryza sativa
atccattagcgcgtgattaattaagtattagctaattttttttttcaaaaatgaaacaatatgattttttttaaacaactttcgtataaaaacttttttacaaaaaacacatcaaaatagtagtttgaaaaacgtgcgcgcggaaatcgagaatgagaggttgggaaccatcacaaacgaactgagccttagagtagcttatgactatagatatatatgacaagttcattttcaatgcagctgtttttttttaatttcggcttatgactgttgaaaaacacaaaaatagattgcattgttttgtagactgatacttaggctgcttcaacttctgataaaatattagactatatcaattactatgaaatttacactcactatattacagtttctagataatcagaatcaatcaattgataatactgccgggccaacgccaagcagttctatgattttctataatttatatagaaatatagagtgcaatacatttttttttacattcaaactttaattctactgtgcataaaattgaaacctatggtgctaaagttatgctttatcaatcagtactattttctatatatctttggtttctgacaacatatagcagctttggtgaggtcacaatctgattgctcttatacatgtttatgctttatacttctaagttgccaaatagtgaacaatttcagtttgtcaagtactat

SEQ ID NO: 100678 - DNA, 530 bp, Oryza sativa
taattggaaaattttaaaagtctctatcgaccatgaagaaaaataattggaagacaaaatgttgatatgctaaatgtgtggaataattagcagtacatcagacgagatgcatatgttgtactacgcttagaaaaaacagagtgggtagtaaatttgatttcaaatgattagttaacctcatcaatttctagttgtatctatttttttcttgtgttcacatatcattattttctttccatagcatcattcatcaacaagctgaacgaatagcgcacatatattgttagcctaggaagcacaaaaaatgaatgaacaaagtactagctccctaaaaggattgaagaataagaactaagaaatatagttacctgggagggagaagccaacaataaagctctaatcttcagaagaacaatatttgcatcctgaacaagctcttcaactttggaaatagcattttgaacagctaagagctgctccatcgtgttcattggaggtggagatgtcactttgacctccatcattggatt

SEQ ID NO: 100679 - DNA, 580 bp, Oryza sativa
attcaatgtaattatgtgccttgtttggccgatgggttggggtggatcaccaacgctcgtcttgtacagtagcagttagtatttttaataaaaatgcgagttctcacctagaaattaattgcttacctcgtattttgattatttcatatgtagtatcatcgggtgatcagggatgttttttttatcaaaacacagtgagggaggctcccacgatatatattaaagaataaaagagtatatacaatggcaagcaaaaacaaaaaaaaagaaatattacaattgatcaatccatgattgcactaaaggtttatgcacatccttgagtctagataaatgtagactcgatctgacttcaagtttttcttccaagaagaaactgaaagcagaatgccctgaaaaaatagaccattcctttcctttcaaatattctaggccacaagcagaaagagttccatgaaacaaggaaaaggaattgaagccttttgagtttgaataattttgatgaaagtccaaagagggcgaccaaatccagcccaaactacttcaacaggcaaaaactgaaactgctgaggaaaaaaaa

SEQ ID NO: 100680 - DNA, 610 bp, Oryza sativa
agacgaggacggggctgcagcggctcgcttgacgaacgcggacgacggacgagaacggctcgacggagggacgaacgccacgacgaccgggaacgacgagaggacgacgacgacgacgacgaccgggaccggcgagggggcgacgagggccagccagcagcagctgcacggggacgaggacgacgtggaacacgccgctacgatgacgatgacggaggcggcgccgcgagacgacgagccgggcaaccgatgggacgtcgatcggcgaggacgaacggagacgacgatgaaacgatgatggcaggcagcagcggctgagcggaggaggggacgcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagatggcggcgtcgatcggcgcaccggcgatgaacagcagccggctggagggagtacagtggcaccaatgtcactggttgccggcgggggcaccgttccggcgagtttccgg

SEQ ID NO: 100681 - DNA, 2117 bp, Oryza sativa
ttgtttatccaaatcgaattcgaattcgagtttatctctccacctaaccctatagttttacggctttgattcctctcggtgtgggatcgatctcgagcttccgtgcctatgtaaatgatccccttgtcgtcctctaccattgccctgaagccacgtcctccgccgtggtccatagcacagccgccgcgtccgtcctagtggtcgccgcaagcctagccgccccacgccaccgttgtggtcgccgccgccgctcactattgtcgccatcgggttcgccgagtggagccgcaccccgtccgctcctccgttgccgtcgagacccgccggaatcccgccgtcgacgccgcccagagccgcgccgccgttggagctcaccgccggccgccgttcgtcgtcgtccgtcgttgttctgagcaccggtgagttcacctcgtcgtcctctccacgatggtgcccttggatagcccggccgagccctgtagcaccggtgatctcgtggtcccgtgcagtgccgacgatgacgtcatgctgacgtaagaaaagcccttttccttcttcaaaataaatctttattgcgtcgtaaatcataatagttttctgtattaggttaaaagcatattaatcttacaaaattcataactaaatcatcgtaacttggaatgttttcttttactgggaaaactaccagagcattgtctagtagtatattttcattacatagagcaaatatgtacaaaagttacagggaaacacaaaagattacaaagtttgtaaccagtcaaaaactaattgctttaaaggatccttcattctgcagatatactgaagaattttgttcttgaaatggtttctccatgattgaaaaggaggggaaatattctgaaaaataaacccatttctctgcttccagatgtgccaagaggcaataaagaaaatttccaagaaaccctttctggcaaaattcagccttactaagacattcatttgaaagaactcatgtgttgattccatgtgattcccagatgttaccaacatcttacactgaacgggcaggtgaagaagagatgtagcctggtttctctgtgtcccccacaaccaacgcaacataaatcttagagtacgttttaagtttcctactttcatcatcttttaatgttgtgaagttaaagtgatccagaggccatacgaattttatatgattgatctaagcaataaatccagggtttacgcacaacaattactaacctgtcccaaatctacccgttctataccatatcggtacaattttgaaatatcatgatagaggagttcaaaacgccaccaatattatttatggtacagaaatataatgatgaagtgttcaacctctcatatctatcaaattttaaattttatcaacccattttcaaaacatacatgttagcgggttctaacccggaatttcacaaattcgtactagtacgtaggaggagttcgcaaatggattttaaaacctttcgcaaatggattttaaaacctttcaaaacacgttagtactggtttgtaatgattaataaatgttttggtactagtttgtactacaacttttagaaattaaataaaaatctgaaaaaagtatgggagagacagctcttcatgaaattaacaatgggacagaattttacctctgcattgcactggccattacagattgagggttatctattaacatttattgagtattgaatacaccacggttattcaccatttacaaattattaggagcaaacttttattaccaggaccgagttaaggataagtaattccattatttgctgtaatttagtcaacacataattattttttagaaaaagacatacaatattgtcgcaaaccaatcttgatgacccatgcattttctactttaaattcacttaacctggagacaaacttctgcttagctgctagtggtgttgctgctgttcccaccacccctaagctgccactcagtgatgtagctcggcttggtgaccaccttagccacatcgacatctccagtcagcattgccacaaccttcgacattggcggtcgctggtgcggtgagccctgagtgggggatcctctagagtcgacctgc

SEQ ID NO: 100682 - DNA, 623 bp, Oryza sativa
gtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgct

SEQ ID NO: 100683 - DNA, 552 bp, Oryza sativa
cagatttttttggaaccaagatgataaaagaatggtttaaaggatccaggtccagtgtaccatagtagaactcagctgcaagtctataataatcctgacaaatgattggccaacatttttaaacaaacatcccattaaacccatcaggcccaggggctctgtctataggcagattctgtataattttgtctaactcagaaataccaaagggttgatccaaagaagcaagagattgatttgcatggaaaagttcttgcagctgaaaaggcataaactcaaactgagaacaacccattgttgaagagaaagcactccacgctatgtgagccttttcctcatgtcttgtacaaactaaaccaaaagaatctactaaagagggtattgcatttcttctaaaagactcagtagccatagcatggaaaaattttgtattctcacccccaaacttggcccatatgatagtacacctcttttgccaataaatttgtttatacttcaggtatagtagtagcttgtttctgataagaattctaaagttccattcaagaacag

SEQ ID NO: 100684 - DNA, 667 bp, Oryza sativa
cgtatagtgtgcttcaggagtttttgcaagaacattacaatgaatcggatatgggttggttttcttgttttttatatctgcatcaatcccgaggcacatttgaaattatgatgttgcatgtatatatgtacatgtggaaaaaaacgaaatttgaaaaacataagttcttgacattgttctattttattgccaaaacattgtaagttttcaaagcaaagcaacaccaaataattaatcaggttgttgaatttagtgatttttattcattacctcttaccaagttgtaagactcagataccttttatacagttgaatattaaactcatatagatcatgcatatcataacttgcacgagtattttgtatgcttatcaacacgagcacacataaatatttactgatagatgctatattgctatctatgtgctgggcaagaaaatgcagaaattcatatttgttggtaaatatacaccctttttcctctagtaaatgcatagaatgcaccacatgcttaaatggagttaagaagaaacatgctggtcatatcaaacaaaatactgaccctttcaaagaattatatgctagatgccatcatagtttgatgcatgttactcatcctcaggtttctgaacaagggtgcaattgtaatgggtgatgatataaatgt

SEQ ID NO: 100685 - DNA, 779 bp, Oryza sativa
  unsure (1)..(779): unsure at all n locations
ccgcgtgaagcgtatccgtgcacgtgtagggctcaaagcgaaacccccaacccaaagtgcgggaggcccactggccgctgcactacggatggtgcgcacagcccacaggcccacaggaaagggagccacttcgcgctcacggttaggatccccgggatggggtcgctttccgcccccatatttttccgttcgtggcgtgcggcacgcgcacgacatcctttggttttcctttgctttgcttcacccgtatcgcatcgcgctcgcccactcgtgctctcgcttgccgaccattatataccgtgcgaaagcaagcaacaccatggagtgaaaaaataaaataaatgggagaagcgttgcgttgggtgtgctactttctcttggttttaaagctgattgattaattacgtgcacctctcgttgcgcgttttgcggtgtgcaagagccaagaggctctaaaaacctaataatataacataactaattttaaaggttactataaaaatcaaagtttgtatgtgatttctttatagaaattatagaaaagtaatcttaatgaaacataacctccctaaaaggaattggagaggacacaagcaatatagtttctacaatgtgcaagaaacaattcaacacctattttgattgccatgttgctcataaagcacgacaatgtgttcttctccttacaatatgcctcctcttgatgtgccaaaaaaatttagtnactcacctcggtttgntggntnttaaccaggggtcatcaatngtcatgggggcgg

SEQ ID NO: 100686 - DNA, 881 bp, Oryza sativa
cacattttgggatggactcttgtgcctcctcttcgctgacatcgatccatggctccatgccccggccgagctgcaaaccgtcagatctcacgccaggactaaccatcagatcatcgtatatacgaccccctccattattttcctgctgtgatgtcgtcacgtactgcggtttctcagtaattactctgtaactgatcacaatgaaatcttgggagtaaatggatggcgaccaacttcagcttgccgacaggctgcgtatgcgtacattaccgcaggcatgtttggaagattctgacaagtagctggttggaagccagcttctaagaatctggaaaagctgggtttcctagcttttgacttctaattctttttctaaattctacatctacagattctcagaatagactgtttggagaagcttctgattctggaagaagctgcagcagccagaagctctcccaaacagaccctacattacgtggcccttggtttatgaaacgatgtgcccccgaggatatgtcgcgtgagattgagttagctaggcctgtttgtttcaagattatcgtaatctaaattattaatgagattattataaagtgaattataatacgttaaactgaattataatacgtttaagtagaataagttgcaagatatgtgttattactggagacatatattaatgggtttaaatggctaaagtctgtaataccctcaactattggtatgggtggatggcaaaagtgagttaatttttttaagtcattaggggcaggtgtttatttagccacccaataataatgaaaaagccccgttgagggagataccagatcataccaatatgggttctattttataataattcttcacaataatctatt

SEQ ID NO: 100687 - DNA, 652 bp, Oryza sativa
aaataaaactatgaggtgggccccccaccaccaaaaaaaaaaaaaaaaaaaaaaaaactgaagaaagaagagaggagaggaaagagagggaaaaggaaagaagaagagaacctcgcggggtggcatcagcccacgcaggccctcagcattcagtgtcattgagcatgtaggctgtgcaccacctgtgctacccatgagacgatcccaggtgcctgtggaacgcagagcaagaacaccactccctccctctccacctgcatttccatcttgatcatatggaggagaaagtcttagtttaaagctagcctgtctttgacactttcctactccctgtcaatctccattttaaacaatgaaaggcccggtctcaggccataactttggcaggtaacagtgtaaggttagaatttaatgatgccatgtaagtttcatatatatgtatgtttagggttgccatctatgtaagacaactgaagattgttttttacttacactggtcataacaacttttaagaatccagttcaagtgagttgataaaaaggtcaagtccataatagtgcaggtggttctcagacaggaaggtggtgcacatatgaccaagtgaggtcactgtgatgttgttaagccttcccaacttttttttccaggacg

SEQ ID NO: 100688 - DNA, 649 bp, Oryza sativa
aatacacatcattatacatttgtccacacctacagaatgtataacaccaagagcagaccctaatgtataccatggatcctgggtgatagtgatgtgccaccgtaggttcatcaaaggtaaaaattataccactgtggtgggggaagtgctgcatgggtgggggcagcaagtgcatgggaaatctcctcttaattttgctgtgaacttttacatctgtttttcttttttttttttaaattataccttaagttctagggtacacgtgcacaacgtgcaagtttgttacataggtatacatgtgccatgttggtttgctgcactcattggctaatcatttacattaggtatttctcctaacgctattcctaccccagccccccaccccctgacaggccccagtgtgtgatgttccctgccctgtgttcatgttacaccagtttttcttaaagtcttcttagaaaaaaaaaaaaaagatggcagttatcatcctcatggagagacatctttcttctagttgtgtgtagggggagaaaggggcattgaaaataaacaagataattaaaatgtatattgtgttcccaggtgaaagtgttcccacacatgaagtgggttagggacagcccaggtagggagcagcttacaattttaa

SEQ ID NO: 100689 - DNA, 969 bp, Oryza sativa
  unsure (1)..(969): unsure at all n locations
tgtaatatatttaaataaatactttatcaaattttattnttttacaccactcacaatttatatatncctcatattttttcaataaaanccattttttaangttcaannttatctattttctaaaaaaaatcccattcttcatnatanatnnnnnntnagacataaaatctatacatatgtgnngcngatgncaccaacaataatttcatnttnnnntntctatnaatcactttttcaccttnatgatttttcannaaannacacttctttttcacatcaccncaannaccatncatcataaactnctaaccaattatatcttttaaaaaaaaancccccccccnntnttttccnnntntcaataatcanntatttcaacacanataaacccatctattataaaatctnanacatcnncantancancaacaaaccaaactaancaatntatatttnaannccacncttctanaattcaacactctacaacactttaatcattaacaacaaaagttgatcaatgccacaccaataaccttaatactctattaactaacaaaattgttaccataccttcaaaaactttaccaaaagttcttacttccctaatatcacctataaattcattaactttcattttaaacacacccacaataatatacaactctatcacataattgttatccaaactcaaaatcaatcccatcttcaatttctcgccattttgaaatacatgtgtatttgacaaaaaggttacgaagcccataaacactacatattttccattctcatttttataattcaatacccatatatctttttctccagtaaaactatcaaaaagtctgacaccctttgccaactgaatcttcaataattacaccctttttaattgcattaaccaattccatttacaaacattaaacccaactttttttgataaaccaataaatactataacctttttgt

SEQ ID NO: 100690 - DNA, 567 bp, Oryza sativa
aaaatcaggaaattgataactgggttatcagtagaaatggccatgttttagatattacagagctgcccgtcgaatcatttgttgagagataggcgggctttacaggtgatatagtcatgttactttctattcacctgatttgtcctaagttgcactgctgagggttggtttaagaagtaactaaagctatctcacctggcgctgtcagctctgattctactctaccagaatgaagagctaaatgacaaaatgatgtttccaaaatatctttttatttctacaactccaacatacacaggtgctcatctactttgccatgggaagatgcccaggcagcactagacagtgagacactgggcagtgtgagtagcacagctgtcctggcgaagacaccctagactatctgacaaccagccaactcccagataagtgagcgagcccagccacgctcagcagggctggcctgcaaggcagtgggggcctgaaagcttgccggagtggctgctaagtagtattaccgacaaggaggtggagagaacaagggagggatggagggagagaagaaaa

SEQ ID NO: 100691 - DNA, 649 bp, Oryza sativa
ggcgaattcgagctcggtacccatctttagtcccagctaaggttaataaccgggactaatatttgaacatttgtacattttagtgcttacaaacttaaacgggccaaattaatttcattaaatatagatttaaaacaataataagtaatccattaaacatgtaataaaaccacaaattttatgagaaaacaatttaaatagtttaaaattcctaatacatttcaataatcacatataattaacatatgtcgtattttaaatagtttaaaattcctaatacatttcaataatcacatattaacatatgacctatttaaatagtttaaaattcctattacatttaataatcatatataattaacatatgacctaattaaatagtttaatcttccatgggtgaagttaatatgaaggtcttattatcagtcaaaaactcctcatcagatctttaataagggctctttttggtggagggatataattgctctctctgacttcttcagaggaattgctaaatgtgatctagtttctggaacatctgttctatattgggatgatctttggaatggccgagtgagaagtgtttcccatactcatatttgtgctcatgtttttgataggaatgaatcagttgcagttatctttgcca

SEQ ID NO: 100692 - DNA, 601 bp, Oryza sativa
agagtcattacacttgttagagggcaatgccagctgctggtattgacgtggcttaaaaagtcagcctcgatatatggtcgcatgatcacatgttagcaaagaaagtaatgctgcaaatatgagagacactcctcccccaatttttatatcgtgacgttcaccctcttgaacgaacagccagtcgttgtaagttgtaagtaccaagggcccttttgcctttgtagaatgcgtgctagaggcaccaaagccagtcagaaaaaggtctttgagtacgagctgcgcgcgatacctagaagattacacacgcaaatacgccttgccacatcggacgccatggcccttagatacagctacacgcgcatcaccatggtattattaacttaattgtaaagatgaattgaatattttgaaaataaaattagaatcaatggtctaaataatatacagtagaataaagttttttttaaaaaaaaaagaacataaagtgtgaagcttgtaagcagccaatttgtttcaattaaagctagtgaatttcgatgcctgcaatataggagtaaatggtgtgatcatctgtcacgctcgtacgaaagaaaggtgatga

SEQ ID NO: 100693 - DNA, 619 bp, Oryza sativa
gtgcagtagttcatcaatctgcataaagcaggcatctcttcggattacataatggaaggttcactccttgacctgtatgtgaaatgtggagatgttgaaactgcccttgagatcttcaattcgagtgattggactaacgtagcactttggaacctgatgcttgtggcatttgcgcacatcaacgatctaacacaggcttttgagctattctgtcaaatgccagctgcaagtatactccctaaccaatttacgtacccatgcattttaaggacttgcacttgcactagataaattgaccttggcgagcagatccattgattgagcgtcaacactggcttctagtacgctttgtctggtcgtgcaggaacggtgaatttctattgctaatatatggggctcgaaaaggcaagacatgttattgaaatgcttcaacataaagacgtggcttcatgacttccatgaatgctggatatgagcgacatgattgctctaacgaccctcttgcagcttttaaagagatgcagaaatgtcttatttgggcagattacatacgactagccagtgctataagtggctgagatggaatccatgctatgaagcaaggcttgcataatcatgc

SEQ ID NO: 100694 - DNA, 959 bp, Oryza sativa
cggcatattgtcctattttatggatcccaaatggcacacgatgaagcagaaacacaaatcttagtcaaatccaacagagattaatatccaacgacaaattcacggcctcctaccgcagcagcggccactgacgccgcgcgacagtcgccgctgccgtcgtgcaccggttctgccaccgctccctccgcagactgccgccaccgccacccctctctctgtgcaccagtgccgctgctgtgcccttcctccgctcgtcggcgccgtcgttcccttcctctgttggaattaatgaagggtccttagcccactcagattaattctttaaaaaatcacaaaagaccaccttatgggatggtatgcatggagagtttagtaccatcttacttattctagagaggggtacctccttaaaaggggatggcctcctagccactcgaagcatgtgtggtggagagaagagggggaacacacgcgctcgcctcgccttgcctagcaggacaagacaggtgccgcgcgtgcatgatgtacgcgtcgaatggtccgctaaaattagttcctcaccttcgcagatgcagcctcattttttagttttgttttgctgtgggaaattcggatttgttttgttttggaaatgttccaaaaatccggtgtgcacgatgtacgcgtcgaatggtccgctgaaattgattcctcaccttgcgcagatgcagcctccttttttagttttgttttgctgcgggaaattcggatttgttttgttttggaaatgttccgaaaaatccggtgcgtgaaaacgacatggagtccggataagttacacgcgacttatccacctaggttacgtggagtggagatcatgcgggcgccccgataaagaccacatcctctctataaaccgagccgccgtcttcacgcaacacacacgaaatcaatgggtaccgagctcgaattggcctata

SEQ ID NO: 100695 - DNA, 531 bp, Oryza sativa
tgaggtggtagatttggcggagaagtggcggcatgccgcggcggaggaggaggagaaggaggccgcgcgccgcggcgatggatttggcggagaagtggcggcgcgccgcggtggaggagaaggaggcgtgcggtggaaagcgaagaagtggcggcgcgcggaggaaaggggacgaagtggaacagcgcctagggttttttttggcgtggattttcttttcagagtgattttttttggcggttctttttttatttttccgcccgagccggccgagcgatcacctcgctttatccgaaccgtgggatcaagatccgacggacgaaacattgctgacagatggattattgataagttttccccacatataattggtttctactcttaatattgctgacagttattttgacccaataaatatttggaattgctgacatataatatgtcttattatgtagtattgccgacatataatttgccaaaagcctttaccaacaaatagtctatcaattattgtttatctttaccgacaga

SEQ ID NO: 100696 - DNA, 739 bp, Oryza sativa
atttcttccccccccccccccccgcgcgccgcctctctccggcgaacccctcaccggcggcggcggcggggcgagtgggacgccgcatggagcagtaggggacggagcggaggctgcgtgaggtgaagggcgggcgcggtggcgatggcgaactacctcgcgcagttccagaccatcaagtcctcctgcgaccgcatcgtcgtcgccggtacgggtctcctcctcctcctccctgaaccctagaaatggccccgggatctgatccgtcaagccgcgcggctggctcggcccgcgtgatctcggggccgcggcgattcgagctggaatagtgggtctagtttagttagattcgcagtgcaggtagtttgcatgtttgcgtttgtgtaaaatttcatagtgattgagctcacgagcagcaatggaagatgcggggggtttggtggttccatgatctgattctggaagcgtgatgcagtgcatcacatcggcatgaaacaacccgtgtaggattctcccaagtataactaccctcattcactcactgcagctcaacttgctagcacatttctagctatgttggaagattttccttttagggcgtacagtttggagaattacattgaaaatgggtttgaacattaattgttttacttctttgctgcacatgctggtggaaatgaatttcaagtttgtttatctgtgtggacttcttcttatacatggtaatttgcgttttgta

SEQ ID NO: 100697 - DNA, 504 bp, Oryza sativa
gattagcactcccaaaaataataccaccgctctaaaatatcgatatgctgaaatattattatttctcacaaaacaaaataatcgaacttaaatcttttatgaaaaacattttgatatcatcatacctttaatatttaagatccaatgtacttgactcatgcatggctaaatttttttcctctgcaagcaacatgatcttcagatgaacctacagtaagttcgcaaaacgcaacagagttcctctctgatcacttgaaattctgagctgtgtatggaaaatcgacagagttgaattgtacaagacgggaaaaaggcctactagtatgagttctactagttcatttcctagcctgaatgccaggtgtacgatgaaatagcaaggcctggtaccaagagacaaaagaagataggaggttcagattaagagtttttcttttaagtgggagactgctagtctttcttttctgtagggtatgccactacttcagtgctgaagaacatcac

SEQ ID NO: 100698 - DNA, 1293 bp, Oryza sativa
aacataagcataagcaaaaagatggggctgaaagctatctgcttctctaatttgagtactaattgcttctttaattttaattttgttttcgactaggttgaatgcgatggactagtttgatgtcatgacttgctatataaacctctcgttatttaatcacattaatacagtttctagggtacgctatttattcgtgaaaggtgtggagatagaattgtactacgataaatgacaagtctggtcatgtaatttttgagtgagtttagattagaatatgcttcatcacgctactctaaaattgcttcgtattaaaatggagagggagtcgttgacacaagagatcacattttaggtgttttcagtgataaaagcctccaatctcgcgctagacatgtgctagggtgcaccaatgtgagtatgtgtgagtatgagaatggtgtgtacttgtacatgtatgcacgtttataacttgtaattgaaaaggggaaaagagaaagtaaaagaaaaaccactctactgttatataaatcctactcatgttccatcaattttatttctgccaaaaaatgttgcaaaatccattgcgatttttgttttccccgatggtttcagctttgtttgatacatgttgtaacttctgtatatccggctgaacaaccttttctgtaatctgaatttctcatataccaaatataataacagtttttgttttgtttttttttcattcaaaccgctaaaaacatcaaaaatgatcacgtcctataatcatcgtgaggggatcaacaaaccgacggtcaaccatgtgcttcagagatcaaaacaaagtctaatcacgccgggcagaaaatcaaccgagagtgcaaagcagtggtcatcgtacctacattagacagcgacacactgacactaaacactacttaatactacagtaatactaattcgtttggctgaaatttggcacggctgctttgactcaattttttacatattagcacttttaacaacatattgtataaatagacccctaaaagtttagcgtatccacaatatacatataaagtagataatactactacgaagtaattaaggaataaaatactactactacgaagttatatatactgtgtaattaagttgtaagtaacaaatactaggaataaacaaatgatttctctcatccctctcttatgggtagtagttgtaggcctagcttactacccactttcattgatgcagagcctaatcttattcataacgtaggtagtaaatatttttaatacccttatagcatat

SEQ ID NO: 100699 - DNA, 1874 bp, Oryza sativa
atgatggggatacacggcaggataatggtgttctgattgattgtgaattcttagaggtagggatgcaagcggcccgatccatgaatctacttatatattaaataaagagtaatctgtgggtttttatgtcatggatcggcttgccatgtcgcaaatatgtaagtggatcaatctataaacctatttatagatcaaattaattagtaggtaatttacgagtcaatttacgggttcctcactaattttacctgtttaggttcgtgggttagaccgcttgcaactctacttcaaggcaagttcatgtatacgtcaaggcacacatatcacacctatctcttagaaaatcaattataaggatgaaatatagtgcatatctatatttatctttagaattaaacattttaggaagatttaccttgaatactttttttcaagaacacagagatggagtacgtccaaatacatcaaagtatcaaaccttaaccggatgagtaatgctcggtccgtgtgtacgttgttttaagataaaaccaatctacaaatttctctcttgaaacacaaaaaaatacaagattttgtcaaaattattttcatttctaaataatcctataaagttatcacgacgagagaagaaaacatcagcattgtttagattacttgttttaaattaagttttagtttataattgatattatttaattcatccctagaattatccataatctatccaatcatccataaagaaaaatccagtcaacaaaattcatccacaaagaacaaagctagcagatataagcccacacctaccatttgttctgatgcgcctgtgtatctcgggggctcctgccccgcgcgtgcacatggggggagattaacaagggggctgtttgattcccagccacactttgacattacttgccaataacaattgtcacactttgtctaaggtgaggtgattaaattgttaaacacaacttactaagcctaagggaatcttgccatacttttttgagccattgacacgtgggatccaatttgttgaaggggaatcttgccacaactgtggctacaaccaaacacctgtcaaatttgcctaaccttagacgtggcaaactgtggcaaagtgtggcttgcaaccaaacacacccttaaatcgcgcgcggggtatcggtagcatgggttcacttgtgcgtttctctttttgcgccacgataaaaaaaaattccttcccgcatgttttttttttcctttttctgttttcttttcgctttttctaggaaaaatagcctcccttttattcctttttatggacacgggaaattaggattggaatggagagttaattgcagcaaacttttaaatccaagatttaaaacttttaacttagatttgaaaacttttaaggcaagatttgaatctttcaattaagatttaaaaactttcgattcggatttgaaaacttccaattcagatttaaaaacttgcaattcagattttaaaactttcaagtaaagatttgaaacttttaactcatgtttgaaaactttcatcttaaaattaaaatcatgcagcttaaattataaaaacttccaaactttgaattaaaattcttaaaaaaattgactcaaaatttgcgttaaaacgtgggcatgtggtttaaaaaattcaaaaaaaaacatgtgaaaaaataaaaaaaaatcgtgcacatatgatttaaaatatcacgaaaaatattcacggtgattcgcctctccacaacgcagaaagaaaaaaaaggaaaaaggaattgatggatgggccatgtgcaaggcaggacagaaacgcgcacgacgcgtatgcactaattagcaagtgtatatgtgttggtcatgcat

SEQ ID NO: 100700 - DNA, 598 bp, Oryza sativa
ccctagggccttaatccgagctaatctaatcttgtttgggcctaacgacatcatcggatacgagtgtggcgacatcgctgtgtcggagctgatgcttgccgggccgctgctgcacgtgtgccggctgagccgcttagctgcagctggttgccgctttgccacagacaaagccgtgccgggtgggctattgctcatagacctgctgtatctagccgtgcatggatgctaccggctgtgccgacaccctaaccctagctttgtgtatgcgatgagctgccgcctagccaaaccaaggagccctaatgccgccgtgtggcaaatgagtgccgcttaaacctagccggtgcttttaatcgagttgtgcaggcgtgggggcaaccctaggatctaccggctatagtagtgaccggggtgtaccatgaaagattataggcaccggttagccggagccgttgcagagtcgatcgctcgttcgttagaatgaggtgttccccgtgcttcgctcgttcggccggggtgagtcggcccttagtttagagccggcggttccgttcgacggtatttggagatcatttaggtgatcccgcgccacatagaa

SEQ ID NO: 100701 - DNA, 563 bp, Oryza sativa
caaatttgtgcggattttgggctgaaataacgtgcaggttccggcattgcgggctggatttgtactcgtatttgggccaaatttaaagcctattttgggggcaaaatttactaaggcctaattacgggcaaatttgggccgaaactgcactcatgggcctaccttacacgcagtttttgccgaatttatttgcacttgagggccaaatttacccgtatttgtggaccgaatttacgagatgttatgatgcaaacttattacttgtagtcctatattcaatatgccaaaaattttgccccaacagacgaagttatattaacagctctgtgccatttaacactttattccccaaaagtggtcaaatcaataaccaaagatgtgtagtgcatttacgaataatcaaatgcagcgacatgaactaaatgtctcatggggcatcacaaagctcagatatgaaaagatcaagaagacagtctgaatgaccgaaactgtgtaactcgcatgacataagaaaggtatgatctaatgcagaattgcagatgacagtttaaaaagaagaagaa

SEQ ID NO: 100702 - DNA, 756 bp, Oryza sativa
tcacattagtgacttagcttctgtcaaggcacgaaagggatggcgccaatatatgttagaccacggcgccaatgatgctggggccgtgaaaaggaaaaaaattaccatcccaaagaacctattcatcctggatgaagccataaattaacacaatgcccgcataagatcaaacataggccgtgtttagttcgtgtactaaattttttttaaagtacacggacgtacatttgaagtattaaatatagactaataacacaatacattatagattccgcctgtaaattgtgacacaaatttattaaccctaattaatccgtcattagcaaacatttactgtagcatcacattatcgaatcatggcgtaattaggctcaaaagattcgtataacaatttacatgtaaactgtgcaattattttttttcacatttaatactttatacatgtatcaaatatttgatgcgatgaaatttttaaaagtttgaagggtactaaatactgccataactgtgtgaaacaaaagctgtcggacggtccagccccccagcattgtgctcagaaggcatcagccagttgaatagttgcctgtgtcactgaaacctgggcccacacccggttttcagtgggccccgtttggtcaacgcacgcaggcaaactatgacgtgcagtgcagtgcagcgcaacgcacactggtagtgattttgtacgggtagcagtagctagcaacagctaacggcatggatttttcacattttggg

SEQ ID NO: 100703 - DNA, 959 bp, Oryza sativa
catttataaaaaaaaatttgaccaaattacctcctcaatcgtccactgcggcacattggacgagctacgtgacacgctggccgtcatgcggcggaatctcaccacttgcgtcactggaggtcgagaggccagcgggcttgatagggattggaccggtggaagagatggcatattggagagagggagaaggaaaaaagggatgtgggaagcaggggtaatttgatctattttttttaaaaaaaatacattgaagaggtaagtagtgacatatctccaatttctatcaaattgtaatagcatgtctctaaatgcacaatttttttttcaaaagagatgacattgtaatggcattgatctaattaaaaaaaaagaatgtataactaggagtaagaagttgattgcatgctgatatgctaacgtttgtaaatatttttttttattgaagataatgaataacgcggcagctgcatcaaagacgcacaaagcccatcattcattactgtacaccaagccaagatagaaaacatacatatagtaactaaagttctgaacaaattaatgttcataaagatacatcatattaattaaaaacgttgagtgggaggcttggaggacctagcattacataacggctacatgaaagaaggtgttgattaggggaagaaataactaagtacctgagtgaagcttttagttcagtataattcgagagctgcttgattaggacagtccttaagtgcctctttaacaacagccttggtttcgtcattacaggaatgaatggttacatgacgaagggagtggaggttctccaaacctaaatcattcaagtcacccctcactataaaagtcataatcagaagacaaagcctttcaaggtgaggcatagctcctggttgaaacgatggcatcatgtagctataaaggtgaaaatattttaaactccggaatgcacatgc

SEQ ID NO: 100704 - DNA, 516 bp, Oryza sativa
cttgttttaagaacctatttagtaagatttgtaaattaccccttcaacttatcagtattaaaagtaatcaaatcgaaatgtatatagccacgtataaaatcaaactaagataaatattcttatagcaaactgatgggtattgtacattccgtagaaaatataattttaatttattttggataatattataatatattctctttcatctgtaaaaaagcacaaacttaactagtttaagaaaagtctgttttacctctaaaatcactgccttctctgattaccccattagataacgttggaccgttttcaacacttcatttaatttttcatattggacgaatactactctctatcgtttttacctgctgttgtccacgatttaaatcaaaatgcatgcacatgtttttctattatcttttctgcttagatgttagcaaaaaatacggtgataccaaggtaaactttatttagttcgacgactgctttgcttatataccatttgcattaatcactact

SEQ ID NO: 100705 - DNA, 1011 bp, Oryza sativa
acacatagtagtgttcagattcatagccaaaagttgttatattttgggacggagggagtagctttcagcaacagaggggaggcaaagggtcggagataagccacgccataggggacatcgatgacggcgcaaccataacgggaaagatatgacatgtgtctgaattagggttactagagtgtggtgtgggagagggaggagtttattgtggctgttgtttagaggttgtgtagtggtcgcgcaaactgaatgataggtatttttaattgatttagatatagaggatatatgcacatccatataagtacgtgtatggtcgatatctatgaactatattgctccctgattgtatagctagcgaggttacacagaaaattaaagaatgtaagcattatttcacattacggatacaaagtaatgaataaccaaaacaccccataattttgcaacgtgcatacatctagttgtgtggatagtgcgattacatatacagtacatccgattcacattctaccactttgtttcaggagttcgtgatcaattaattagatcctaggttggccaatatatttgtccatgtcttagcgaagaagggttgttctaacgaatattgtacgaccttcactagagtttttatgatgtcatataggtatttactaaaacaaaccattattgttgaataaaatgccaatagatagaaaaagaccgattcacctaactttatcgatcctcgacgcactggatagattccgattgtaacccactcataatccaaccaccataatttccccacatcacaccttttaccatttgtcattctatgaatatatataaaatccaaaaggacaaattcacacccatgcatcacaaaaccatgcctatactacatacctaactgaatgatgcccaacacaaatatggaccccctttgcaatgagaaaaaatcaagaagatgatagtaggggccaagggaggggggacatgatcacatgagatgagagggtgatctct

SEQ ID NO: 100706 - DNA, 1474 bp, Oryza sativa
taataaagaatgataaaaagattgtgtaattaaaggttaagattgtttctctatacataaattattcaaaaatatctattatatctataaagtaatagaaaaaggagtctccacgttcactctcacggcctataaaatcccacgttaatcgaaagaaaaaaaatagaaggagaagtgctttgcaaaaaaaaacttagaaacggacaaaaaaaattctaatcggactaaaaaaacttggaaacggacaaaaaagaaaaacctaagagctgaaacggacaaaaaaaacttggaaacggacaaaaaaacaaagagtaaacggacaaaaaaaaacatggaaacggacaaaaaaaattccaatcggacaagaaagaaaaaattgaaaacggacaagaaaaattagaaattccaatgttaatcaagaaaaagagaaaaaaataaccattgggtcatagtagatccagattataacagtttagatttcatatagggtgtgtttagattccaaattttttttttccaaaaatgtcacatcaaatgtttggatatatgtatggagcattaaatgtggatgaaaaaaaccaattacacagtttgcatgtaaattgcgagacgaattttttgagcctaattacgccatgatttgagaatgtgatgctacagtaaacatttgctaatgacagattaattaggcttaatagatttgtctcgcaatttacaggcagaatatgtaatttgttttgttattagtctacatttaatacttcaaatgagtgtccgcatacttcaaaatttttacacctaaacaactaaacatggccataatagttatatagttatataaatttttttacgaaaggttaaagtaactataggaatcggagtaaaaaaagcttgggatggaaatgaccaaacaaaccacatatacaaagtttatttctaatttaaccaattggattaagaactaatgcattaacttatttaagtaataagggcatgtttagatccgctgacacgttttttcatcttgtcatatcgaacgttttaacatctgtatgaagtattaaatataggcgaaaaataactaattgcacagattgcgactaatttgtgagacgaatcttttaagcctaattgctacatgatttgataatgtagtgttagagtaaacatttgctaatgacggattatttaggcttaataaattcgtctcacattttacaggcggattctgtaatttgttttgttattagactacgtttaatacttcaaatgtgcgtcagtatatccgatgtgacaggccaaattttcacccctggatctaaacacatcctaagaaaattagactctgcgtttgctgtcatggcatagaaattctcatattaatcgaagtccatatagaaaaacaatttacatagataattaaaaaataatgaatattggaagagaaggctagagttcatactagtgtacaatt

SEQ ID NO: 100707 - DNA, 951 bp, Oryza sativa
gtcacacagctgcacttaatcgatcaggaatgtccaagcaccacaaaaacatgggagaaaacatctggataagagaaaaagaactccatccatatctagcatgtcaaatcgaaactagaatactagattgagcaggcaacaaagtaacaaccgagtggctatctcacctaatcggtcgaagcaagctttgctactaattgttatcaaggcccacgctatcaccaatttcaccatgagtagcgtaagcgctggctgcagcgacctctcaacgctgcagtcctactcacgaacacaacaggaacccaacaccgaagaagtgaagatggtggtcattcgcatattagtgtgagcacaagatagtagcattttgtcacaccgtccatttggaaactaattaactgtgcatatgctatgttatgaacccctgggttcatttcttaaatgccaatggattaaactagctagtctagagacctagagatctactcctatatggattgatttgagtttggaatctggaggagcgtcacatggtgccacatgcttgtttctcggatgaacaaaaagattcgctgtggctcgagcggaacgaggaggataaccacgggtttagtttgaaatataactactgtcaattaatgttagtattgtattatagcatattgtactgtaatatcaaataatatgaattagtatattgcgaatatgtttgcttgtagtttgttttatttgataaccatatatctttataaatatagctatatggcggtggttgttttaatcacaacacttagatatatacatgtatacttatacacaaaagaaatctataaatatagtgatagttggaaaatgttataaaaatatatatagaggagtgtgatatgaaaaacgtggtaaaggtctgatgactgatggagggggagaggccatccaaatggaatatagtgg

SEQ ID NO: 100708 - DNA, 1203 bp, Oryza sativa
gccctccccccccccccccccgaaccgccgccgccgccggaccttctcctcctcacccagccgagccgacctcgcgcgctggctctccttgcaggctccgaggagagggagggggagagagagagaggggaggggaggataaggtttgagtggtggcctggtggggggagtcggggagacgggatatgtggtgctcttatgaatgacatatttattgtagttgaacatgccctcagtgaccgtttgtcgtttggaagggaaagacgaagtgctaattgggaaaattataaaaaccatccattatatcacctcgagtttgggattacccctataaaatgcttttcacaaatatctccctcctaatttaccttggtttgatattctggaaatgaatcaataatctaagattagccgattattctacagtttctgtgtttgctgccaaaacagctaacaactgatgaacaagaaaagttattatggttcaaatactcaacagcacctgctgatcgtcaattaattgttactggactcatttttcccacctatttgatactgactggatgtcaattaattgttactggacgtcagtgttgtggaatctttattactagtattttcttccatcgtgctagactttgatgaagtgtttttactggatgtcaattcttgacagccaaatgttatcctaagtcccaactaatcttaactctcccaagtaaatgcaagaaaacatcaaagcacttacaaatttaactacaatcttccagcctttgttgtgaattgtgatagattctcacaaaaataatttgaacagacgggatcttatagaaaaacatatagctcacgacaggaataataacaatggtgtgaaatagacgacaaaagctttaaaacatagggaatgttgatctctttgtgggttgtgacttgataatttgcttttgcaaatctcttgccttttactggacgaaagcttgtgatcttttacaatgtcaaacccaatcaaaggtgtaaaataataagagccaacaaatgtaataattcttcatgttcccaatatagataggaaaaaaaaacatttataaccaagtcactggcatcataatatatatgcctttttttttgtgaaacaattcattgaggtacatacaccaaaacaataatgaatatgaaacactgctagagcattacagatgtgct

SEQ ID NO: 100709 - DNA, 1291 bp, Oryza sativa
gtttcccccatccttctcttttcttcttttctcattctctgtccatcccccgcaagggtgcagcatcgctccgtatagcggacggtgggtggcctccccatggtggcacacagtggccagggaggcctcccctccaaggcaggtggtttcccttccacagtgggcggcttcccaatggcggggcatggcaggcgccctccatggcgacacagcagacggcttcctctcaagactacccagtcgcctaggtccgcgcatcagtcgtccccaccgattgaccagatccacacaccccccatcaaataaaatatttacaaattgttaacaaaatgtttacgagagaaatccaccatttgtaagacctgagctagatatcatcgaaatgtgacttacttctttcatttcacaatgtatgactttttagcattgtccacatacatatctaaacacacacacacacacacacacacacatatatatatatatatatatatatatatatatatatatatatatatatatatatatattcattaacatctaaatgaatgtgggtaatgtcagaaagttttacattgtgaaacggaggaagtatcaattaaagctcaaagcctatcttatatacctcggcgatgacatgaacacgacatgatcgattgcaggttaggtcacctctagctcatgttattgttgagctacagcatgagggtaacaatggccttttcttatatatatagctgcacttatatcgcataaattaagtacgatgtggatgaggtggggtacaagttcaacagttagagacaagatatacttttctaaacttaattactatcatcaaggcctgtgacactcaacttgtgtatatataggctatcggatgttgtgatattaatgtaaggatttgaatctcctagctagctaattcttaatttattgcctacaagaaaggcttttgaactaatttccaatgggattatgggacattttatatccattatctcatagaataaatagcagtactataaatttctagaaatggagatagacaaatgccccgaaggcatgaacaaaacaattagacaatcattgggtatagtttttagtttcttaaaggataagcacatgtatatgctccattaatgtttctcagaactagatcaatgaggatcctctatcataataccactatcattacagtcacaagtatatgggtcctatgcttctattgctacacacgtcaataaatgtctgtaatggtagtgacattatggtagaggatatgaacccc

SEQ ID NO: 100710 - DNA, 1790 bp, Oryza sativa
aatatatacaataaataaatgcatttttaatttattatagtgttttgaaagacaaatctatatatgtttttctagtttctttaaactaaatatttttaaagttattgatggtcaaatttataaaaatttaacctcaaccttgtctaaaacgtcaattaatatagaatcagaggtagtatcaaacattgtagtactacaccacttgatccaaatttggatgacacttgatccgaatttggatgattgtattggttctgatttagttcgattaaggtaaaagccgtgcgcgccgggtagaaggggaacatggctgcctttttgtgaccggtcaggggtaggtacacaaaaggacatatgccgtttggatcagaactgcagctagatcttgtccattgattggcgatgagggcaccacctagctagcatgtctgattggttcgagcctagctagggatcgacatgacgagctagctaatggaaagtactatacagaaattgagtactccctccgtcccaatactacaaatctggataggcacctatcactggataggatactaggaaatgttccatccggtcctaagttcttatatattgggacggaaggagtagttagcattgcctgcaatcctgcatgcagtatcaagtgttgttatttcatgcatgttaatgtaggagtaaattccatgagtactccctccctcccataataagtcacatcccgtactaggagtaatttttaatgtaagcgcctatctaaatccatggtactaggatatgtcacacatcacgtactatagactactacctccgtcccaaaatatagctatttctagcacagtactttgtcccaaaatgaagctatttttctacctaccttctcctctcaaccaatcacaaccattctttttcacctactttctcttttcaaccaatcacacacattcttcaatcattctcacatactttcttaatacccgtgccaacctcaaaaatgattacattttgggacggaggaagtaacttattctcgaacggatgtagtattatataggctacaactagatgaaaccggccctcgcgttgttgcgggagtttactatgataacagtagaaatagcgtgtaatatagctagacaacgtaagcttatagaatttgtatttttgattgatcattggaaaatgctataaaccacttaagttgatgtgatttatcataatttaaatagtatttagattgataatccaaaagtaaaagtaaggtgatgtggcttcatgagagaagaaaatgggggaaataatttggactgtaaattaatcatctaaagttagaaacaattaaagtgacgtggtttaatgagagagaagatagaaaacactaagtgggggcgaagtatataggatattgcagaaaatgatggagagatatatgttgaaatattatgtaaattgtgtggaatgatgatctaacatacttatattttatagctttaaaatataataaaatataaattatatagcacctttgcatgaggattaattaagttgtaataattgctaatggatgattatgtgacatctttacatgttaagctctaggatatagtgttgtaactttgtagggagtatagacacattcacatacatgaggaagagaatcaccacaaagagcaaagataactacatgaataattaattactccctatgtcccaaactataaatgcgtatatttttttacacgatctcgaacattatacattgaatactaatttctttgacaataatataa

SEQ ID NO: 100711 - DNA, 2323 bp, Oryza sativa
caggatcattttggttgtttcaagcaactgataaaattaatagaaataaaagatgtggagaggatcaccccggcgttgtatgtcatactcccaatcacaatctcgtgcttttgatgatcaatgaagatatgtattatagattgataggttcagatgaccaaaccttggttaattatgcactcacttctgaatcaggccacacagtggtatatttgccacccatctacatttctacatcagttttatcatattgtcaaaactggggttcatatgattttcggtatatgattctgcacccaacatttcataaatcaatcaagcatctgatccattgttaaatcctccttccaaagcataaacccatgattaactgtccaattaatattcttctctttctcaccaaccaatcagcttgtaccaaatcccagctgctagctgagccaccaattccagccacacaagaatcataccatcaaccaaaccaaaactctgctttggaataacatctctgaatttttttctgcacctgcagatatgtaacatcatctagatcaatctgcagttttctacttagatctgaacagctgcttattattattcccatatataatccatcacaattcacaggtgttcaactgagggaggctgataccctatgcaagtttgcatgtgtcacatatgctgatgttaacttgtctgatgtctcactcatcatcaccaccttatcaccataatattatgcattatatatgctacatgacctttcatagttcgaatggacagtagccagcatataataaatgagaaaaaaaagtgattatcttgcagggaattaattggttataaattataattaaatttcttgattggaatccagaaccatccaaaggaacttggtccatctgagaaagaaaaaagaaaaaggaatttggtttcctctgcctagtcggtgcttacgtggagattcctccatcttaactttggttagtacgatgatcagggggcacgaatagaaaaataaaacactggataaatattgatgtcatgaggttcttcaagaggcattagtactgatcccctggtttcaaatgaaatttgtccaaaataattgtcttaagattatgggaggtagtataacacagggtgcttgctcctttcgccacgataagtcatgatttttcagtcaacgcctacttgaacaatttccaagcctactctctcacgaagacaaaaaaaaacacctttttactgaataggacacaatttcaaggtagagttttctttatattaattcaaattaaagaaccaaatctactccaggttcactacttcgaaataaaaattttgttttcgagggatgagcgggctgaaattaactgccgcagttgtacacacaacctactggaaacaagtttcagccgaacaaggccattattcttcattagatattgtgattttttaacagatttacgctgaatctaaacaatttatatattgctaaattcaaacaaaataaatttcaggacaaaacaccctgaattttctgctctctccatttcatattataaatcgtttgacttttttttaaacttctttatatttgattaagtaacatttccaatacaaaacatattcaatgttaagttcaaatgaaactaatttggttgcttaattgtcgctaattttatctataaatttggttaaatctaaataactttgattaagaaaaaaaatcaaatgacttataatataaaatagagggagtacgtattttggaaggtgacaagcaacagaacagattgattggtccactctaaaaaaaaggaaaaaaaagattggtccaaaagtagaacaagagaataaccccagcatatactcactcctattaccaactatttccaccatatggagaagaagagaggaaattcaggtttcttccaagacaggcactgggggaggctaggattggtgcttggacgcctgcagcacacagatgccgccggctggctttctttcaccgatcagaatgcggccggcgccggcaaaactgaaggtgtacccaaaatgcccatctctctctgaatgctgtgcctgctaaaaggaatcaggtgaggtcaggattggatgggattttgttaggcttatcagcatcagctagtaggtagggtttggcattttcacatgaaaaagttcactactacctctcccaaatgcaacctatccggcaaagaaccttcctggaatggctccggaattcttggccgcattttctttggtctagaagtgggggtttgcttgatggcttaatgacatcttagatcat

SEQ ID NO: 100712 - DNA, 656 bp, Oryza sativa
tcaattattattattattattattattattatgctaccaattaaaattattcttgagctaagtgctatatcttgttcaataatccaatttaaccggagaaatcatccgcttctatgcccaaaataatcatattattggatcttatttctaagatcaaattgatattattaagttccaattacaattattgtaatgagcttgcttttttaagcaagtctttaattatatcccataaaccaaaccgaacttacataaaactcatttgtagttaagatatcacatataggcaaacaccttaaatacacaacaactagtaaaatccaaacccacaagaagatcaagctaccatggtgcaataacaaccattaattaaactaaactaaactaaaatactttaattagtacatctagaaaagatagacagtgccattttggtcatcttcctccctccgctactctcaggtcagttgctaccttctcctctttccaaggtgcttataaagataatatatgtgtgttcgtttatagggtgagtttgtgaatgttacaagcggatatgtttatgctgttttcataagaaaaaaccataagagccttatcggttgcccatatatgtgttccatagtgacataaaagtaaatttgtaggtaaaactt

SEQ ID NO: 100713 - DNA, 812 bp, Oryza sativa
attcgcgcttggtttattactgctgtacccgatggcgcgggagctgacttgctctgcgtggtttggactttggacctctgccgtttcatttggtttcggggacacggtcaaatgacgttcagctcgttaggtatgtgagaaccatggtcaagatccacggccaaatacttgcgctgtgtggctgctaaactcgattgcttttctttgctgactagttctaactcagttttgctgttccctgtccattagtagtagtcgtgcacatctgtcgtctctcggcaacgcgagtatctgatgaggtgttttgaactgttggcgtgtagccacgcaaggaggcttgaaagttttccaggctatgctgatgaaactgaacacgtcagagcccgacaggaagaaatttgattgtgcttactcagtcctttttaggaagggctgccggaaaccgatttgattcaatcagtatgtacagttgcagcactgatcggtctggtattgcttaaatacacacatatatatttatttccccctagtaaattacatttagaggatatgaatctttgatgatgtaaaaaattaaaattgtatacaacatttttctatgtgaaaaaaattacagagcaaaatttgctgtgtatcctacaggagtacatcctttcctcccatctccagtgttaagggacggtacccttttctgcagccatctgcattcctgggccctccaaacaaataaccaaatgtatcaaagactacagtttatcctaggtacgtacaagtacaaaacccccctaaactacaatttccgtcgtgtcatg

SEQ ID NO: 100714 - DNA, 524 bp, Oryza sativa
ggcgaattcgagctcggtaccctacattcttccactagcatgaatcgtaaaccacataacatggcttaaggaatgctatggcttgctctgcagtcgttgtcattattcatccacgcattccgtggacacacactccccattccttcacttatgcaagtacttttgcacatgacaataaaaaaaactcatggtatagtatttttttttgcttgaatctatagaatctatctatctatctatacctatactaattgggcactctaaagaagctaccacgttaatcagaaagatccgactattgattaagtgtgtcatatcacaatcaccgtagattttcattattgagaacctgcgttaaaatagattgtgccgcttctcagcccaaccaatgaaccatacgagcccatccaatgtatacgtacatgtatcgatcttttctcaggttacaattaactctgttaatttcagcaatccaatagatgggcacgcaaacatgtttgaggtcttcgctcgagagagacaca

SEQ ID NO: 100715 - DNA, 518 bp, Oryza sativa
tgctacaggatataggaatttcatggttttagcggtaagacaccgcacggagtcacttttggggaaacacactctgaaaatatggttatttgctagaggacaccaaacccattaaattattgttttcgtgctgaccaggcgagaagtgtcccacttttttacatggcttgaccaaattgccccttttttctctttgtcttcctatcttatttccttatctcttcctctctctccctcatctctctcccttgacgcgctgaatgtggctcgggagcccagcgacgacgcggctcacggtggctgtgtggtgtgatgcgagcggccggcaacgcggtgcgcggcacggtggcacacacatgcaggagcggcggccgacgtgaagtcggagcagtggccacgtgaaaacagagtagaggccgtcgtggtggtggcgcagcacgcgacagcaacagaagacgatcgccgccgctgtagacgacaccaccataaacaaccgccgccgccgcctcctcgtggcg

SEQ ID NO: 100716 - DNA, 617 bp, Oryza sativa
aattaaacagcatggcgcttactaacccgcgtcaatgttacctgtctcctggcacattttgatttataaaatcgatttgaatttttggtcgattttgtggtactggggttgattttgtttgatgttcagtttctataatgaaaaacatctggacggacgcgtagtctaatgtgatggagaatattgcaagcccgaatcttaaatcgataatcccttatctaatgtaagggacgatctattgaaactgctaaggtactctatatatacttgaacatacgtgacaacaaacagtagtaattgtaattgacataccaacagaaataattcccagtgaaaaaaaaggttaacagaagaacggtaatctccatttgacctacatagtactccagctcgcaatgacagatctgcacgtacaggaatgaattatcgagaacgaagtaactcttgtgccggaattctggtagacttcaaaatccagtctatcacttgatttgatatacacggagaattatgttacttatcttatggtacatgaaacaatggaacacgttctgaatgttactgacgaaaaagaactcatctgcacaaaagaatgtctcggcaaaaacagcatacat

SEQ ID NO: 100717 - DNA, 719 bp, Oryza sativa
aaagatcttcaatattcacaggaaaccactgccattagaaccttctttgcttcttcgtgaggctaataggcgtagggcttttctttctgttggaaatatatctgaattatatgattcaggtgatgggtaaggactgtcgatttcctccattttcatgatgtaatctttcaagtgaaatttttcagcatatctgtgttaatgtattcttattaacacatatctatgttcttttttgtgtgggcagttcaggtctggatgcaaattcaaaaccttcgcccaacaaatctgcttcgaactacatggccaggacaatgtcagggccagcgacatctgagacgtctctgccagttgatcgccccatgaggttgtcagaaattcatgttgcagctgagcatgcactgaagcagacagtatctgaccctaattttatgacatcactttcatcactagaagaatttgaggtattgtaattattcaacatgctcatcatgatggattccttctaaagtaatatgctttttttaactaattactttagagacaatcgtgaacatacagaggtttgcacaagcaatagataattcattgcaacagttttttttttctgttaccagaaaagatatatggagcttactaaaggcgcagctgacaattatcatcactcttggtggaaaagacatggagttgtgctagatggagaaattgcagctctattcttt

SEQ ID NO: 100718 - DNA, 658 bp, Oryza sativa
tcaaggatactaggaaatgttccatccggtcctaagttcttatatatagggacggaaggagtagttagcattgcctgcaatcctgcatgcagtatcaagtgttgctatttcatgcatgttaatgtaggagtaaattccatgagtactccctccctcccataataaggcacatcccgtactaggagtaatttttaatgtaagcgcctatctaaatccatggtactaggatatgtcacacatcacgtactatagactactacctccgtcccaaaatatagctatttctagcacaggactttgtcccaaaaagaatctatttttctacctaccttctgctctcaaccaatcacaaccattctttttcacctactttctctttgtaaccaatcacacacattcttcaatcattctcacatactttcttaatacccgtgccaacctcaaaaatgattacatttcgggacggaggaagtaacttattctcgaacggatgtaggattatataggctacaactagatgaaaccggccctcgcgttgctgcgggagtttactatgataacagcagaaatagcgtgtaatatagctagacaacgtaagcttatagaatttgcatttttgattgatcattggaaaatgctatataccacttaagttgat

SEQ ID NO: 100719 - DNA, 638 bp, Oryza sativa
gactcgacgcgaccgcgactccggcgaactactactcctcctcctcctcctcgctcttcctcgcgaatgctggtcgcggcttgctgctactagcctctccaccacccagtttggtcgatgagagagaagggcccctgccgcggcggcaacatgggggagagggatttgggcgacatcgtgctctcctggtcgctcggtgaggtcatggacgacgacctctacagaggaaaggtgattgatcgatcctcatggctgctaatgattttgcgcgaggcagtgttgctgacctgagcaatttgtttcgttatttttttattaaaaaattcggggtgtgaactgcgagatggatgcatggggttttcggtgtacgatttttttttctaaaaaaacgcaaatattagggagtgacttaacatcaaataattaaataattaaaaggggtgaggcttcgaaatctaggtcgtttaggccaccgccttgtttagctaaccagaagacccctaagcgtttctcgtacaatttgttcttctatgtttacctgggagcaagctgttgtatattgtagatgttttgtgagtcgcttgtagtgtcctgttgcttaatgccttgttctgttatagaagctcactagtcagtag

SEQ ID NO: 100720 - DNA, 593 bp, Oryza sativa
cgaacggagtgataaattctgattaaaaaagagctgcgaacaagtacttcctctatcccataaaaaaccaagagcggggcggccggtgcagtccacgggggaggtggagcgccacctctcctcctcctcttcctcctcatcgtcctcgtcgcaccacccacacatcagcctctagatctcgagagttggagtgaggcggaggcagagaaggccggaagggccggctcccacctatgagccatcaacgacgccgtctggcctatgcttcgtctccggggccccccactctagcacacgccctcccaaagtttgccactcccatcttcgcgtctagtgctgccacccaccgcgctcccgtatctagcactcggtggagaccgccgacagtgcactccaggacagcgaccaccgcggcggctgtcagtgccacaacggcgagcattgtcctcgccgtggcgacaaagaagggagaaggatgggaggagatgggggcggggggccaccacttcggcggtcgccgtggggaggaaggggaataggcgaggtccgtgatgaggctgccacgcgaatgggaccgtgccagcacctggtcg

SEQ ID NO: 100721 - DNA, 582 bp, Oryza sativa
ttttagagaaggatatttgccatactagcactagcaccatgtgctccacaaaagtatactagtcactcaaagttttttttagatttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctccttttctccgaattaaatggagaagccaggatctattatgtcgttctaccctacaattttgctagatacaaaacaataaaataaataatatatatacaaaaattcagatgttgatgaaattccatttttttggtacttttagtagattttacgttgtttatcctttactttaattcatttttttctagagaaggatatttaccatactagcactagcatgatgtgctccacaaaagtatactagtcactcaatttgtagagaaggatatttgccatactagcaccagcaccatgtgctccacgaaagtatactagtcactcaaagtttttt

SEQ ID NO: 100722 - DNA, 740 bp, Oryza sativa
ggccagagactgacttgtcaggactacaagactacaaagagatacccaaaagaggaaagcatggattgggttcaacaacaggatacaatgttaggcttgcatgagttttcccctcgggagtgctagaactcctatcactactagaaacttatgacgtctagagtgcatgaggactcaagttcatggagcgggtactgtcaatgtgaggttgttgaaaggctttgccgtggcaagtctcattcgttgggacgtaggctcatgtgttgggcaagtcgcggagtacgggtaaagtgtacatccactgcagtgtgagtaaaccaaatctattcgaatagccgtgctcgcggttattgagcactgggacatgtattacacttggctagagtctaaattcttaaattgattgggtgggatgatgcatgatgattttgtactggttgatcaacttctcgagaggcgggaagaggtagaccccagaaaaccatgacgaccaatggcgggaagctatccttgggaacacaatggatggtggacagaaccgtcgctgtttaatgaacaatggagttaaaacttgatcagtttatgctaggtcttaagtttatgaaatggtatttgaaaactcagctttacgcaaagtaagcatagccatgtcttgtattatcctgtacattattgcattttgtggggtggcttgttgagtacttttgtactcattggtgctctatatatatatatatctt

SEQ ID NO: 100723 - DNA, 742 bp, Oryza sativa
tacataaagatcatatcggctgaacctctagtgtatacttgtatgaacccctttgcctcacgatatcgattaagctcaaggctagaaatgtgccatcctctaatagctcaatcattcactcgaacctgttttgatagattatataacttgtgattgactcctcaatcacctttggcatagccatacactttcataatctacaacatcgagaggcccagagatatctctccataggaggggcaaatcccattttgattattcatatcccactacatgtttcatagcatacccgaaaactatttttataactacccaattacggagtagtgtttagcagtccctaagtaagctactacacatgttgggaaccatgataatctcaggtctaaggattcaacaccaacactaaatgagatcactgatgacacaacacatatgactcttgcaatggctcatgttgggtctatccaacaacatgttcactaacatgtgtctatattattaatttggtatctctataccatgatccatgagacatgatcattaattaatacatgtgctgatcatataatcatatttgttccacatatgatatttgatcagggatcctttagaaatagtaacacacaatataaagagtctcatgaaagaatcacatattcattaaccaataagttatcatttcaaggaacaacatcggataaatatgtaaacattgtatgtgatacaatcatctctataa

SEQ ID NO: 100724 - DNA, 521 bp, Oryza sativa
gattttgcttaatttcgtttacgagtgaatctagggtttcctttccgtttcggccgttatcgcgcctcttttaaatagtaaccactgctttgaaattttcacggcgtcacttccgttttcaccgccccaaccgaaactttccccaatcttctccggcgatttcctcgagttctccggcgacttcgcaggcgaacccccttgcggcgacaactccaccttcgacaatgtcgacctccgccgaaccctcgagtgcgccaatcatcgagtatgctaaggtaagtaccgtcggctaaatcgttctttttagcacgttttctctctcgtagttcaatcgtttcccctttttcctatagcatcttactcatcaagttgcaatccccaatttgcaacatccgaatcacttttttctgggaccaatcggcaattcagaccctaccgatttcattaatgctaagactaataggattcccttcagattataccctcctaactttagtcactagcataatatcttcaaatct

SEQ ID NO: 100725 - DNA, 617 bp, Oryza sativa
taccaggtacttatgtcgaacgaacgggtacgaccgcagcttctacaatggggacagacctactaattatgttaattaccaatatggcacctctgtacagtggttcttatttttaagtcctcgcgcaggaggcaactatagccgccaagggcaactttaaccattaccatgtacaatggtttgtgatactcgagtataaattatatggtatatttgtaaaccctgatcgagatgacgtggtgtcatacgattagttccccttaaatacctccggaacaccaaaactcctcttgctgctgttaacattacgttcagagcatatgaggatataagttcatggaacaggtgccacaattgttaataacttaatactgggccatgactaaagccgatgattatcagcaagtcgtggactgcgggtaaagcgtacatctgctgcagtagaatatctttgaaactattcgaatagccgtactcatggaattgagtaccgggactcatatggtaccctggttagaaatttaaagtctacatttttataaattcttgctataacacttccagattgtttattactgcttttatacctccctagtcagaatgtatagaaacttccg

SEQ ID NO: 100726 - DNA, 962 bp, Oryza sativa
cgggtggtcggatggataaggttgaagagctatctcgacaccacgggataccggagagtagattttctctagtaaattttggtgttaacaagagcacactaagtcaagcaaaacaccgggcaatgtactcttggtggcaatgtttcaagtaaacaccgagtaacaatataaattgactgagactattcttggtagctactccctccgtcccaaaaaagacaaaccctggttttcgtgtccaacgtttgaccgtccatcttatttgaaaaaaattaaaaagataagtcacgcataaagtattaatcatgttttatcatataacaacaatgaaaatactaattacaaaaaaaatttcatataagacagacagtcaaacattggcacgaaaacccagggtttgtctttttttgagacggagcgagtaacttctggcaagtatcacagccttttcggggttgcacatgcgagcctttacgactatccctacttctccatgggcaggaataactttagggcttattaggatcacggtactgcaaaaacgtaggagtagaaaaatcgtaagaatatgatagaaatatatgtgtaaaacagaggattgaaaaacacaaaaattctgtagataggattggtaaatatgtgttcggataggcagaggaaaaacataggaaatgggaaaaataagatacgagtggatggaaattttcctttgttttctattgattccacatgaaaggaatttttcctcttattttcctttgggttgattcctatggactgaatgtcaggaaaggaaatatttcctatatatagtattcccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaa

SEQ ID NO: 100727 - DNA, 859 bp, Oryza sativa
cgagatcggagatggtgagtgctcgcgagcgatcgaactccatgtatctgcccgggtcgcttcttttcctcttcgttggtcggtgctttcgctttccctttttgtcccgtaggggatcggagttcataccagctttccttggcatgtactcatgcacgtctctttcccctcttcacccgcacatgcggttagcgaaaggggcatagcatttccattgatgtatccagccactacgctatgtcttccgttgcatatgccgtttgagtactctcaagctctcctgatcgacttcttttcatataggattctttaccggccgttaaacataaagcgcgagcgcgcatgcaccgtcacagccaggccgttttcatccatacaatctcgcatgaaaagccagtcgtcgtcgatcacttcagaattcagattagtgaattattctacgtgcgtgctggataaagagagaaacgggagaagatcgatcaacgaccgatccacgatcacaattcgcaaaccttaggtacgtagctaggcggcctatcctacactgtaaatggttgaagcgttcactcaatcgctcatcatccgctaacacaaacaacattaactaactggctaaggctaataaagcgaagcgtgtgtggtcaggtactaacttaggcgccacccgtgccgtgccgtccctttccccctcgtaccaccgacggatgccaggctcccctcctcggcgtgccgtgcctttggcttttcttctctgatgtactttggatcgatcagggagagagccggtggaccacctcggccgacctctgtgatcgagccgttgtgagagaaaagattgaagggctatgccacacgacgg

SEQ ID NO: 100728 - DNA, 632 bp, Oryza sativa
taatttggaacttctaacctatagagcgagcatggtggctcttttttcgagctatcttaataatataataggtagatgattccagtgctgattaaatgcttggaaagggaatttaagcaattcaaaattttagaaattgataattgaagtgactaaaaataaatcttttgttctaaccttagtattttcaatataacctagaaattcttatgtttttaaaatgagggagtattttctatactaattcagttatattaattgttatccaatgcgtcataaagaggcttcacagatagataaagaactactaaaaagcaaatgttttgttgaacttagcttaaaatgaccgaacagttataatgaatttaaccttcggtccatttcaaataaataaataattcaaaaagttaatagtgattttgaaatgtgtacacactggccatcacatgacaatgggacatgtaaacggatttctgattcgtgacgaaatcatcttgtggtgaaattatttctctggacatgaaaaagacaattggcgatggatggactaatctgacctcagcattcccaaagctagccatgtactattactacattcaatatctcaagaatgaacaatgtatcacaacttt

SEQ ID NO: 100729 - DNA, 780 bp, Oryza sativa
ccatttcattttttttccgttttcttcttcttcctcccgtcttcttcccggtgtgccatctgtctcgtcatcgtcatggtcgacttgctcaccgaagaaggggcggcaatcctccacggcggcggcctgcaaggacacagccaccggctccagcggctcccgtgggggttccgcggcacttgacgtagaagagggccgggagccgaagtagatgagcgcgaggagatcctcgacggatgaatcagcgccagaggaggagggcacagcgacggatgggggaaggggcaacccaggaacccaggaggagtgctcctcggcaagggcgtcggcgagcggggcacgcatccgctccgcacgagcacgagcactacaagctgcaccgcatgacggtcgtctcgttcccccgctccaaaccctgccaccaccagctactcctccggccgtgcaagtcgacgtccttcttctcatttcacttctctcttctctcatactgtatgtttggatccaatcccctcagcccaccagatccttacgcattcatccatccatccctactttttttgcctgaaaagattggagaccatgttcttggattccaggatcgaatccgtggaagcaacaaataaaaatcacatatatatttttctttgcttggtcctgagttttgtttggttccttcctgcttggtttcttcctcaccgtcgttgacgcccaccacaaggagccgcctcaccttggtgagcgcggtggcggccatggtgacgatgaacagcacccggg

SEQ ID NO: 100730 - DNA, 681 bp, Oryza sativa
tcggcggcagggtggggcgcgttgtgtggcgaatggaaggtgtcggggttcccaactacgatgcgggcgtaggaaaggatgatgccctggaggtgcgcgatggaggcggcaaggtgcgcgcggaggcctgcttctcggatggtggagatcttgcaagccttgtcagctgcgtggcggacggaggaggcgaggtacgctaagggggaggggttgccggcgtgttggtccgagagggaaaggctgtcgatgaggaggatcttgcgcgtgatgatgtcctccacctcgtcgggcgtccgctgcggtcacactgccggggacggcgacgccatcgccggtgatgcagcgcgagggttgttgcttctacttcgtcttgtagttgggcggcagcgttgcaacgacgacgatgaccagcacgccatcagggctgaggcggaggttgtcagctgagggccactgttcttcctcgctgctcgtgttgtgtcagcagcggaggcagagccgccaccgcaacgtggacgggttcgcggatccgcggcatggcgaagctggaggagctgttcgctcggctcggcggagacggcggtgacgagggaaagggaggccggcgtggtggcgcgggcgtccaacggctcggccacactcggctgggtgtcggccggtgaaaaaaggggaatcgaggga

SEQ ID NO: 100731 - DNA, 656 bp, Oryza sativa
aatcctatggatttctttgataaaatgattactatcgggttattatcaattccaagcaggttgctggagcactgtttacacaaatttaacttcacttgtaaattaaagaacattaaatgggagccctattaataatttattaaataatttataaatcctgaaacgaaaatcaggatgtgacaggcataactgcacaacaccacgattttgctgtcgccgcctgacgcgcgcgacggcgccggcgacgtacgtactccactccgttagctattgctgctgctggatagacgactacacacctataggctatagctagctagtaagtactatgtagctacactagtacatagttatcctccacgtacgtacgggaaaaagctgctggttttgttgtagggtaagcagtgtggttgatcgtgttggaattaatgaatgggtcttagcccactcgaagattaattctttggaaaatcacaaaagcccacctcatgggatggcatgcatgtggagtttagtaccacttgcttattctaggagagggggacctccttaaaaggaggataccctccagtcacttgaagcatgtgtgggggagagaaaagggaaacacgcgcgcgctcgcttgcctcggctgggctggcctggcaggcaaggca

SEQ ID NO: 100732 - DNA, 845 bp, Oryza sativa
cttttgactgtgtagagatgcatcatgcacacatttttgttgattgtgatttgactgtgtaggatggccaaatgatggcacaaaagaggagcagggagtattcaccatgaatatgcataagggtcaagcaaaagtttcaagtgagggcatgttctcatcccacctaaaaattttacatcctataacatcgaatgtttgaacacctgcataaaatattaaatatgagctaaaaaaaataactaattacacagattgcgactaatttacgagacgaatcttttaaacctaattactccataatttgataatgtggtgctgcggtaaatatttgctaatgacagattaattaggcttaacaaattcgtctcgcggtttactgacggattctgtaaattagttttttattagtgcccaaacatactatacgacactttatataatatctgttcgcaacacatacatacattacacccatgagatatgaggagcatggagtattatggaatgattttaccattagactagacagccatttctttacctaggagtagttcccacaatgacaataatgatggcctcaatggcgccgtactgtggtttgctcaggctttccaaatacttaatgcgtttcttctgtctgatcactttcacctatccctcaaaaaggtcatgcatgcatcctgcctttttctcagtgtcagtttaaactttaaagatcatcactgacatatcctcagtactaccagccagccagccagccacaggttttttgatgaatcaatgacactccaccagtgcctattactggctcccaaatccatgtactccctccctctaaaaaaaat

SEQ ID NO: 100733 - DNA, 763 bp, Oryza sativa
agaggccagtgaaaatcctggacaccatggagcgcaggaccaggaaccgggtaatccgtttttgcaaggttcagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcaaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccttttccctccctccccctcttgggccggctcggcccatctctttccctctctctcctcttccccgcagcccattcggcctcctccccgcgcgcgcgccgctgacgggcgggcccgcccgccccctcgctgacgggtggggcccacccgtcatccccttcctcccgccgctcccgccaccccgccagcgccctagcgccgccgccgccgccgcgaatcccgccgcccccgtccgccccgcgtgcaatcaagaggggggaaatattccccgggatcccctcccgggtaccgagctcgaattcgcctatag

SEQ ID NO: 100734 - DNA, 765 bp, Oryza sativa
aaattttgaactttttaaaacttttgcatcatgctggatgttatggttgttattgcttgccaaactataaattgtcacaattgaaaatttagctaaagctgtacaactaagtaatacttataaaattaagatatttattattaaatatttacacacaacaaagcaatacaaagagaaggttaattactaatttaatttataggttaaatattaaatattggaaccatgtgacaagtgtcatgacatctaagtaaccatgaaatagtcgccactacaatgactctgtatatataggagtgttccactagaataattaaattaatatttataacattcatcgagtctctcatggaataaaattgactcgcataaaataattgatcatgtaaatgaattgagctttatatataaaatacatttatgtgagtgtttaactaaacatttagatcaatatggtaccaagtctcaatttacttttatggaataatagattaaacatgtccatgtaaaatacattgctatacaaataaattcaaccaatgtgcagtgattcctataaatatcaaagcatccatggtatataggataattttgggcgaagtaaattcagttggggtgtaacaaataatcaaataaatgaataaatatttaaatgaaatattcaaataaaaaatgtataatgttacatctcaattcaattccaatctcagccacttttgcatattagcccctccccctcctttttcctttttctctcatttctct

SEQ ID NO: 100735 - DNA, 2143 bp, Oryza sativa
  unsure (1)..(2143): unsure at all n locations
aaagaagaaaaaaatatgtgaataagcaatgaactagtacacgctagaagaggtgaagcgaggcgggcgggcaccagacgtgcactcagattagtagagaagaaccaatcagaccaccagtacacgctagaagaggcgggcggacacccaacttttttcaaacttcaaatttttctatcacatcaaaactttccaacacacataaacttcaaactttttcatcacatcgttctaatttcaaccacacttccaattttagcgtgaactaaacacagcattctccaataaactagtctgtgctatacttgcatgcgtacagtagtgtacagtcaaatttttatccacctaataggacgctctacgctgagcaatttcctggaccttctcgtgggcggcttgttcctcacgccgattgtgtccaaataataacgatggcagtgaattcccttttttttttacgggaaacaggaggagagcctctaatgcaatatattaaaatatataaataagggttacaaattgttacaaatatttacaaagtagaaattttttggatggcagtgagttcctgaccgaccgggattcgaaattttttgaggcaatttcgttcttacccctactttcatatttaatattgattttacccttgtattttagggtttttattttttcccctacttttttaaaacgaagctaaatattacaactactttggatggacaggctaaaggtgttaaacatttgacgaaaagacatttgtacccttagtgtgttgttaccgtcatcgcctcttggcccgctcgtcactgtcatctccaacccgtggcaagctacctccgacccatcctcgtgcggagccgctgccagccatcgcctcagcaccgagccaccgccgtcgccccaacgagtcaccgctgtcgcttcctcctcgcgtagagccgccgcgccgccgctccttcccctgaccgagccaccgccgccatcgcctcctcctcgcgccgagccgtcgccgccatcgcctccaccccgagccgctgctgtcgtttcctcgcgcggagctgctgtgctgccgccattgcctagctgggctgctgccatcgcttcttcccctcacagcctcctcgcgcagagccgtcaccaccatcgcctctaccccacactgagccgccgctgtagcttcctcctagtgcggtgccgccgccatcgcttgggcgggctgctgctgtcgcttctaaccctcacttctccgtcgtcgctcctctctgctactccctccgttctgaggttataagatgtnttggctttggtcaaaatcaaaccgcttcaagtttgacaagtttataaaaaatagtaatatcttcgaccaaagataaaattattataaaaaatatatctaattactaatttaataaaactaattgggtaataaaaatattattatattatctataaacttagtcaaacttgaagtagtagtttgactttgactaaaagttaaaatttgtataacttgaaacgaagggagtacctccctagccgttgagagaagatgacgatagggggaagccggaagggagaggataagggaaggaaaaaatccaaaggtattgtgaccgctagggggacaaaggtaaaacaatacattcaaaatcaattacttcttttatttttctacttctgcggctcaattactttggtttaaagaaattactttggttaattaggagaaaaccnaaattacnaatgcatttaatatagggaattgtcagggagaattttttttcaaattttctttgctctaaatcgctaancaggacttaaagcagaattttcagagcatcggagttaatgtttttaaattaatttgtcgagagttgaactaattaatttttttctcttacacctttgatcatgaatcgtgccccattcactcccctctctatccgcgggtttgttttgcatagcgagccgtgtccattttctttggcaagaccgtttccattcttttcctaaaacaacaccatattggtaatgcgaaaaacacacactggcctaggagatctgcttcactccagtgcaggtcctaaatcttgcttttgggttcaaaggcatgccagttgatttgatcctacaatcaacaaga

SEQ ID NO: 100736 - DNA, 620 bp, Oryza sativa
ttaatctattcaaggaagcttatccataagggaccgagttcaaggaggatgccgcatggcaatttatctattaattaggcagtatttgttagtttccttttatctttaggaaagtatgtttagtgtccaataaggacattatgttttccttttatctttagaaaagtttctttcttgtccgacaaggactagtatttccccatgggtataaatatgtacacctggagtcattgtaaaatatatctctcgatcaatacaactactctcagagcatcgccaccctctttaccgaggtttttactaatcttctcatggaatttggcacctgacgcggggctgcatcggttcagtttgatctccggcgaaggggtaagtcctacgttccgctggccctggtgaatctaccggctacgttggtattgttctaggctgcaatgcttcgatctcttggatcgctctgttttggttgatatatttgcctatctgatatctcatttctatctctaattacactgtgtttagatacacatcggtttagttgggactgtctcagttaggtctgacctcctgtcttagccaatatatctcaacaatcacaatgctgatgtaaatagatttgt

SEQ ID NO: 100737 - DNA, 720 bp, Oryza sativa
ggtatcccttataatcggggtacctgccatctgagtagatcaagcagaataggtttccttatttcctatccctgccatttacattactaacccgtgggcccaggcccatgacctacccccgagttatgacccaaaggccttccatgtaccacctaggtacggtaatatccatagtacccccgagtactttgcttgatgaagaatatgaagcgagacttgtcaagtgacggagtcgaatctggccaagtactctttccaaagcatgcagatagaggcactcatccggacctgagtaaagttttccggtatccatcgtcttattggacagggatgaaaaccagactcgattttccaaattagggtaactccatgggccagcttgttaggaaaccaagagatataaatacccccggcgggagcgccgttgcccacttcccttgatatttggcacgccccttcgtcttcctcgctcatccccaactgctctttgcttccggcgatttagggttttgctctcagggtaaatccaacaaaatagccccttgattctccgctcctccaccattctccgtcttcctcctctgccatgtcccagtcaacagcggaattcgtgccaatcctcaaccaaactgttgcctgggctccgtttacagtaatggcggggaatcttgagaaggtggtggcggagggatacctcccctgcaagcgctcatcaactgg

SEQ ID NO: 100738 - DNA, 1065 bp, Oryza sativa
cattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcatagaattcttctggctttcctgaatccgtatcaattacaaaattatgaacggaagataaccaaatgatttatcagaatataatcagtagtgactgaccttaagatccttcttgtactgggatattaccgtcaatgattcttctctcagcttatggtagaaatcaatcaaaatcctatcacttgctgatttaattgaatggttttcatctgttccaaatgaagagttctgatcactgatcattagtctgtatcacatggggaaaaagggggtgaatgtggagccgaaataccatgaatactcaccatttcagtattagagaacatatcagaagagctttgcacactttctgaagaacattgcataatgtggacagcatcaatcggttcactttctttgtacaggtcgagtatggctgcattattgggtggaaaataactaaaggccttcacactttgtccagcggactcacgagttccaacatgatctgtagtttgaacattgttcaaattttcgctaacactagtaaataatgaccagccctcctggtcgctgctcattgactttggtacatcctgacaaaataaaaagattcagaccaatcagtggagaaggccatagacatatcaagacctaatacagaaaaaaaaactagaaagaggtcataacaggatttctaatgctagaatttcagaaatttttttttaatcaaaagatatataaggataaaattcatcctttgtttagcagggactagggaattcttataacaatgtctgtgtgctgttaaatttactactccgtaagtcagaattttatactatgtatacagattgtaataggcaataaaaatccttctaggcagcttgactgttcaacttgaagaatacaatcacatgattta

SEQ ID NO: 100739 - DNA, 856 bp, Oryza sativa
caagttttcctcctaccagaccgccaaagttcatgtaaagcactcagcctatagctaaatatttcagtggcaccaaatgcaaatacttcctactttcagactgacttcatgttaaaatattagtctacaagtaacataatgaggatgaggactgtgatgcagcttttattgatcagtaatgccactggcaaacaatttactagtaattaatgcaaaatggggtacgaaaattacctgtgatgttctcatccaagggacgtaccaaactgtcttcccatgaggctcagataatttttcctcagaatcctggttgttaattatttgtgtggttatttctatttatcactgtagaatccatgccatttaactttaagttttactacccaataagtataaaggtatggagttccgctatatgcgcaatactacattgttagatctgtgatcaaagaaggtctcatagtactgtaattttatttgtatatattattacaaagttataaacggtaacatcttgcgaaacctcttacagaaactaatattttggtaagggggggatacatactgaaaaccatactacattcttgtggtgtaggacaaattttacaacagctcttagaactagaaattagcaggctggacatcaaaagtcataaaacagctaaactgaaactaagcttcccttagatctgaagcaaaatcttgaaaactgatacatatagttcagatctggggttgggaatatgcagtagaaatgattctgctgaacaaagggaggtaataccgtaatacacaatgcaagcaacatgtgaggtaaaatataaacaaacggagctagtgagctatagtggtccaa

SEQ ID NO: 100740 - DNA, 1872 bp, Oryza sativa
ggaagaagaagagggggggtgagaatgacatatggggcctacgtgggtcccacctttttgaattaatttgtgtgaaagtgacgtgtgggtcccatggggtttattattatttttagatcgaattgccacgtaaccgccacgtcaatgacacgttagatgaagaccgagtcaatagccacgtaggcgccacgtcagccaaaaccaccgtccaaaccgttaagggacctaatgtgcactggttttgacatttgagggacgtgttgaatctggttttctagttggaggatgaaaatcggattcgttggcaagttaagggtcattaggtgaacttattcctacaaggattggaagcgtaccaaacccaaaggcctggaaattctgaagatctggattaggaagcctcgtagcgaagtggttccaccatccttttgcaggcctaatcgggcccaggcccacgtcaaccgcagcggcgatcactccaccccacatctcgccggcgagcacgggcggagccggcggcgagggaggcgacctcagttcctcgccgtctccgtcgacctttccccgcgccggtgaaccctcccggattcctcgcccttccccttccccttccctgtgagctagttccctcgccctcccccattaccgcctcggcttctatctgctctgcactaatcggtgagcccccttgatcgcttcccaggaactcctcttttcacatattcttcttccgagacaatatctcgtcgaatttttttccgccgacgagcgtcatgtcgaagttaatagtaggagaaatgatcttctgcaaacgtttgtttttgggaacctgatttattacaggagggttgcctgctcatggattaagctgttgcctgcatgtttaatgttaagtctctaaattttgcggtgataatgtattactccgtatagaataccctcatactgtatagatcatttgggcattttgtctaggagtatcatcttatctggaccgattggctacatgtaaacaatgcttattaaaagaaccataatattggaaattgaaagatcaatttgtaagtcacctcaattcatgatggcaacatgtgtttgccctttcttccaccaacctagtcatctagataagatataaactgttggttgagagaagcatgaatcttattgatggtagcatgtgtggagacagtaaagcatatatagagtaatggaacgatttcttctgtattggtgaaatctcggttctcaatacatgtgaattaaagttgttaatcttggaccactatagctcactagctccgtttgtttatattttacctcacatgttgcttgcattgtgtattacggtattacctccctttgttcagcagaatcatttctactgcatattcccaaccccagatctgaactatatgtatcagttttcaagattttgcttcagatctaagggaagcttagtttcagtttagctgttttatgacttttgatgtccagcctgctaatttctagttctaagagctgttgtaaaatttgtcctacaccacaagaatgtagtatggttttcagttgtatcccccccttaccaaaatattagtttctgtaaggtttccaagatgttaccgtttataactttgtaataatatatacaaataaaattacagtactatgagaccttctttgatcacagatctaacaatgtagtttgcgcatatagcggaactccatacctttatacttattgggtagtaaaacttaaagttaaatggcatggattctacagtgataaatagaaataaccacacaaataattaacaaccaggattctgaggaaaaattatctgagcctcatgggaagacagtttggtacgt

SEQ ID NO: 100741 - DNA, 839 bp, Oryza sativa
taagacgaatggtcaaacgttgattaaaaagtcaacggcgtcatacattaaaatacgaatacggagagagtattactgtaccaatttaagacatgttattatgtcaaaatattgaaaaaggttttgtcacccttgatatgtcgtacatcagcaaaaccaaaacaacccgttattctcttaggttatgttcgtttatagtagttgggaacttctctaacacggtaaacgaaccagtgaattaaagcatcattaattgacaccatagccgaaggcatggtatgttttaagaaatattataacaccatagtttaagaatgttaattcctttgtagtatttttatctatgtcttctatgcagttatagcatgctcaacatttaaacataccatattaccatccacttgtaattactattacaactttaaacacatataaaaatgccacataatctataatttactaaattttagagcttaacatgcaagcatattaaataatcactccacaccattttcataatatttcaatgtatattcatctatcatttatacaatatttaacatgtgttttctatacaagaatatttaacacgcattcatccactaatttcatggtaagtgcagggcatcatcatatccagtactcgcaataaaaaacccaatcggttttacttaaacgagaattaactgggattaccgttgatcaaatacttagacaagttcccccaaaaaaaaattgacatacctcatatgggctgaactcaaagtatttctaggtaggaatacgtctattttacctcttcaacttttaccttgatcgaattgcgttcctcaatcaca

SEQ ID NO: 100742 - DNA, 531 bp, Oryza sativa
aatcgtgtcattcatcatcacgtacagtatgcattaatcgtacgtatagtactagtacagtagcagttacgattgcttcatctgtaaacaaaggtgtgctaggtgcattatggctgaagaaacttgttacaactactaataacgaaatgacagcatggacatgctcaattagcaacctactacacgtacgttacacgacgtagcatcaagcaccactcatatatgtactaatacacccatgcgtgtcgtttcatcgtgacaccacactctctggcagtgtaaatccgcgagaagctcacaaaattctcacgcactgaatttaattaaatacataaacatcagcatggaaacgttctattttaaattggaatcgtatatacactcgtaaccacgtagaccatttaaagttgcttccccaagtctagacttactccctcataaaaactaacctatctttcaccatcttatttgtcctgaaaataatttgtatcttttaagtaatcattacattagagtttataaaagtgagaa

SEQ ID NO: 100743 - DNA, 662 bp, Oryza sativa
agtgggtgtggaacgacagctacccgctctaccactccacggactgccccttcctggacgtcgggttccggtgctccgagaacggccgccccgacgcgtcctactaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagcctttataatgctacagtaaacattctctaattatatattaattaggcttaaaaaattttgtctcgcaaattagctttcatttatgtaattaggttttggaagtagtctatatttaatactctaaattagtgtctaaatacagagactaaagttgaattcctggatccaaacacc

SEQ ID NO: 100744 - DNA, 946 bp, Oryza sativa
cataactgtcaccagagacgtgctctggtgagaaattgaggatgtcccactgggcccaaaagctccatttctgtatgcattatctacataggtcttagctaatggagtttgcctaaaagcttcattattgttagctgagcacaacgtaaattgattatccataacctgatgtgcatttgtctgggaaagcactgccatcttactgtcctgaccatctttcaaagttgcctgaacacttccattatttgctttcactggagtagcggtcgatagaatattggactgtgacataaggcttctaccaacctctttacttatttttgatctctcattctgaaatatatcaagtagatgactccagtactctgtcattctcctacatatatctgtatatgcatctgaagaggcaagtatttggacgactttgacaacatcacaatgattgtaatatcttgcacaaaactccacatctgaagatgttccaatcctgcattattttatttgatggaattaacatttagaaagcatagaacaaaggcaagtttgtcatggggtaacagtcggattactattaaacactcaaatgagtactactaaggttaccaagtcaaagtaatatgatttttcgcttgttaatttagtacattccaactttctggtgctaccatgtttaaccttattcagagatggaaaaaaaaaagcttatgttgcaaattaaatgttggctactctactctaatcaattgcagactggcagtgcagaacgaatgttcataaaccccaagtactgaaggatgaggatgaaagagcttacaccagcaaatagttgcagcatccgaggaagctcctgccacacatatcaatgcccaaataattgagctcctcttgcgccacgctctattcttgaagagggtggtccaagcttgttaaccacacattctggaca

SEQ ID NO: 100745 - DNA, 1092 bp, Oryza sativa
gagaaagttatgctgctagaattctaggcagaaatatcaggaacccatgcatgcaggtgcaggatgatgtcagtgtgagtgtgtctacctcaactatcctgcttgattgaacaattaaagtaggcataaaggtgaaactccacgtaccaggattgcagtagtaatcggctaatcgcgaggtaaagttgatagattctgaatctgatgaagggggatttcatcttcatggctggagtcaaatcaatgtttgatcaacgcgtagttacagggtgccctgatgatttgaattaatttttttaaaaaaaaacaataagaggaatgaagagagtttaacctgtgaatcgggaaagaaacagaagcatctcatcatcgagcctagccgttgggacttgcgttgcgtgtgatctacacctccaggcacgctgcatatctagggctaaaaaaaaaagttcatcatacaaggtctcatcaggatttcaggaccgtgtgagtgcggcagagctgtctccgcttgtggctgctagtgcgggctagggtcagcgggcgccgtgtacctgcggatcgtcatggtagaaggccggcggcgagcgggacgccggagcgcggcggacggcgtcgtcagtccgccgctgcggcgtggcggcgcggaaggcgatcgatgcggcgatggcccgatgcggccgatcttttctttgtggtggtttgtgggccatgggggcgtgggatgcgagttgtgcctttggcttgtaggcccaggcgtattatgttaggaaggcccatggatgggccgagcgggggttcggagttcaattctccgacctcccaggacgatctggactggaagctgttatgtgcagccacgtccgggcacagcacacgcacatcatggcagctggcagagtctctcgagtatgagtatacagtatactcctcgatggcagccagagatcgatggctgcatcgctggtgggtagatgttggttttggccattccattttttttttactagaatgcattggtaacataaaaaaaatcaacaacgtccgatcgtatccaacgtatttagaagttgattgggtaccgagctcgaa

SEQ ID NO: 100746 - DNA, 1663 bp, Oryza sativa
ttcaatgtatattcatctatcattatacaatatttaacatgtgttttctatacaagaatatttaacacgcattcatccactaatttcatggtaagtgcagggcatcatcatatccagtactcgcaataaaaaacccaatcggttttacttaaacgagaattaactgggattaccgttgatcaaatacttagacaagttcccccaaaaaaaaattgacatacctcatatgggctgaactcaaagtatttctaggtaggaatacgtctattttacctcttcaacttttaccttgatcgaattgcgttcctcaatcacaaaactaggtataaagccttccccatcttggaaaattgatgcaaatccactcttctgatggtttgggaagtggtttatgcatatgtggtaggttatctgcgatcaggttctctatctcgctgaggcagctcgtggccccccaaatgtcagtgaaatgtggcaaaacatatacggtagggtccatgtgtcaatgcattcctttactcctcccccacctttccctctctctcctcgcaagcacttgcgagggtgggacatgccagaggatgcgcccgccctctaagggatgaatcgacaatggcgaagcagcgcgcgaacaaagttcaagatggccacaatgggcaagccctgttcttcctccttcctcttccctgcacttatttgttcccttcaccatctccaaaaatcaatgccactcttcgtccttccggcttccagtgccatttggaatgggggtatcgaccgcttgccaatgatgagcaagagaagcgcattcttgcattactcatgctgatgtcaaggctacccggagactgcccatcttcatgcttgcttgtgtcaccaccactcatgatggagccactgttgggagtatcacgataaaggggacctggtgggcgatggtgggatgtagaagtcgacaatgatggggaaggagctagaggccggggggagatcgagagacagatcctgttggtcagctatacaaacctaggttgcggcggccttagatctataagaagagctgagacaaaagaggcagtaggtcggtgagtcaacgtcagggctcgaggaggccgaagaaggaggctagggagaccgcgaggtaatggagcagtgcagcatggtttgagctttttcccctattcctccccaagcgacgacaatgtcccaatctattgttcgtgttgctattaggcttgccgactgtcatcggagccgaaggtcgactccttggacgacaatggcagcccagtggtgaccatccccttcccgcgagcttgagccttcacaaatgccgccgcttggcttcctcgtgctaagtattttttcctttttttcgtcaacgcataaaaggattgcacgtcaatatattagaaggaaaagattttttgttattttttccttaatataatacaacttcaacttgtcacgtcaacaaaaatcactttacaaaacacccaagaagtcaatttatatcattaagttaggggaggtgttctaaccaattttacggatgagggatgcgatttgaccaacaacaggaggagggagtcacaatagacattccttttcggtgtacaaggatggaataagttcatctgaggtcccttaacttgtcaacgaa

SEQ ID NO: 100747 - DNA, 630 bp, Oryza sativa
atcccatttggtttctcacttccttttttttttgcttgattattagtacaatttcatttaggttgcaaattggaatgtgctaatccgaatgcttctttcttcatgttgatttctaacctcagaggttgaacctctcacattttttgcttgattattaggagcactctttcgtttataggttgccaattggaatgtgctaatctgaatgcttcttgattgattcttcgtgttgatttctaacctcaaactccgggtcaagctggccgcggacaagaaccgccttaccgccgccgacgccttgctcccccgccgatgccttgctcccctcgctggccgccacgtcgccggttggggaaggacttgatggcgacgtcacggccggtgaggaggtcgacgccggcctccccgccccccttgcttgcctacctcatccctcgatggcggtccgcctccgtgcctgtggcttctgcaatggcggacgagagcaatggccgcggcgcgtccccagtcgccagccgccgtcgtcgtggcgccccgtcgtcgggccgccgacgcccttgcccctttcctacctcgccccaccgaaagaagcaacccaaccgacgttcttcccagctgcctacccagaca

SEQ ID NO: 100748 - DNA, 509 bp, Oryza sativa
aggatccacaagaaatttggttgggccacaaatgctgccaagaatccacacaaatatggataaggaattcactagtggtttcagaacaagtccaaatatgatagtacttatttggtatctgttcctgataaaaagaactggatagttgctcatgcttctctctccttttgtgtccaatcacatactcacatgaagaaaaagatactactgaacagactgaacctgagcaagaaattgtttgtttcccctatagctgaacggcttatcagtgagaaaaaggttatggataaaagttttatatatcttaacggtttaaaaataaatgctaaaaaataaattacaatgaaaaaaactaactttaaaattaatttttaaaatttaaattttgccagcagcttatataagatgaaaagggctcctctgctagagatgactgaacagctcgttcacaattcctttcagacaaaggcagccgtggttttgaagggctcctcaagatttgttttgcg

SEQ ID NO: 100749 - DNA, 2012 bp, Oryza sativa
gctccgtcgctgctccgtccgtcgcccctcagcgccgccactcgccttctctccgtagtgtgggaggggagagagggggggatagagagaagagggaggctgatatgtgggaccacatgggcccaccttttttattatttttttgtagctaacatatgggtcccacaatttttattatttttccgggatgaaattgccacgtaagcaccacgtcattgccacatgggacgaagacctagtcaaaggagccatgtaggtgccacgtagatgccacatcggccaaaaccgccctctataccgccgagggagctcgtttgctcggtttcataagttgggggacgggtcgtacccggttttgcggttaaggaacgaaaatctcactgaccgacaaatagagggacctaaagtaaacttattccttttgcttcttgttatggcccttgataggctgaattccatgtataatagtacttgcgtttcatgttataaattgtttttactttttttctttgctatttttttaaaagctcaattaaatcgagtggacttaaactcaaacaagcctaatacaagtctatgggatgcacatgcacctaggttgcttgtcttatggcatgttactttgatgctattttcaaccaaaccattttttttaaaagttatcaaaaaaaagtctacgtttagtttgttgtcaaatatggtaaatacataagaaatcctgccaaaattttgacaatattatcatcttcctaaaattttggcattgccgaaatttaatatggtttattttggctacaatctaaacagacccctagatccacgaacatgggctacaattcttggtgggtcaaattcgcgcgatctagccatgctttctcgttgctttccactcgcgattctcgtgctcgcataggctcgatcacccatagccaggcgcagggcgttagctgcttattaggctcactcgtcaaagtggacttttccttccagacttgactatcctaactgtgttcttgaaaagggaaaacaatccttaactaaagcaacacatcagactctcgcatccctacttattcacatcactcacaagtcacaactaccccatacatgttgttgtgggtcatgcactactcccctctgcatgcactgtcgcaagctgctgcacatacacacctaggtgcatggtaaacatattctcactcttctctaaccaaccttttaatgaactttaaactatttttcttcataaattaattatcttttttgatatttgattgtacctctatatttgttacaattaaatctttaaaacaagatctcccatacttatatttctaataaaaatatataattatatttctaactagatattcttgtataatacatggcacatcaagttataactattgagacatcacgaaatatttactgaaacatccaaataacatcaagtgcaacatttgtgaatgaactggtgtaacatcacacaatacttattgaaacaatcaaataataccacgtgcaacatttacacatatactagtgaaacattaaaaaaaaacttattgagacatccaaacaacatcatttgcatttttttttaaaaaaaaacattgcaacataacaatataaaatatgcaacaatgtcgaatttctatggttgaaacatatatatatatatatatatatatatatatatatatagaaaataatcctaagtataataattctagattcattactactagtttatgtcatatcctattttaatttgatttattttaggacggataaagtaggggtgctcacgggataaatgaagattgatattcctaagcataaattattcaactgcacatgccaatacttgcattttgctgcataaaaatcatgtgcccataatttgacaagcatccataataagattcagataacttccttcggtcatcccgataaaaaaataaaataaaattaacaatcacaaccatagtgcttatcaaaacaaaaacaaa

SEQ ID NO: 100750 - DNA, 657 bp, Oryza sativa
acatcatcagtttcatcagacaaagtgattaaccggtgagatctcttgtttgtgcaggcgtttacttaggttagcttgcttgcagatgcatatcggtgtgccgagtatttgttaaatctgaatgtccagttgacctcgaacggcttgaaaagaactcaaataatgtaaaatatattcctcagattgtttattgagcaaatcagtcacctgtcatataagcatatgtaatattcaccgtatggcattcgcagatttcttttctctgttggaaatctcaaccaagacttgtatatgaatgaagattgaagagtcctgtgtgccatttcaattcttcggttttcgaataattatcgctattcagtattactctctctctctttgacgtaccgtagagaaattagggatatggtttttctacacctaggtgtacactaggttacaatgaacgtaaattttagtatgattgtattcataacgctgcacacttcaataatataacatttttataagtttttttttcccaagagaatatacagtcaaagtttgagattgaataataacattgagttactattcgagaacggaggtggtcataagtcaagccaaaattttctgcaaaaaaatgatcaaatgaagtactcaaagtacatggtttct

SEQ ID NO: 100751 - DNA, 744 bp, Oryza sativa
gcaagaggcatacctaaaggtactgccctacattatttcaatggcaatcgcctcgaaagcgattgcctggatcaggggaagcacaaagaattactactagaaaagcaagcaagcaagcaaagaatcttggctttgtaatttgccaacccacacggtgccaatgaatctagtacacttttcagcgtgtcaattcatcaaataatccaagttgcagtattgctttgggcatataattataccaattcatgttaatgtgaatctttggtttcgttcttaatacgaattggaagcatctcgaaggaacagttcaggaatggtttgtgcccacagtttcgaaaccaaagtctcccaaaccagacaaggtttcagctggttcatttcttcagagcatttctaattggataccaccataccaaaccagttgtttagattcgtttttgcttcgcagaaacgcacacacacatatggtgggacaagaccagcttcaactgggagtagagaaagttatgctgctagaattctaggcagaaatatcaggaacccatgcatgcaggtgcaggatgatgtcagtgtgagtgtgtctacctcaactatcctgcttgattgaccaattaaagtaggcataaaggtgaaactccacgtaccaggattgcagtagtaatcggctaatcgcgaggtaaagttgatagattctgaatctgatgaagggggatttcatcttcatggctggagtcaaatcaatgt

SEQ ID NO: 100752 - DNA, 1237 bp, Oryza sativa
actatagggcgaatttttttctcggtaccctcaagatcataaaagaaaaggaaatcgttatgagcattcactagttgtactaaaccatgtacctattggctgcagaaggcatataaagttgctctttggacattcatctaactcaagtcacgattgtattaaaaaatgataatagggtcattcctcagttcaagttgtattggaaaccttaatagtacaagtatgcccgcgaacatgaagcttactgaactcaaagtacaaaaatatggtgacaaccacagcaatggaaggagcatgaaaagagggatggaagtacatagacactatacacgaacacaacaacattgtgtacctatgtaatatccagttgggctgtcccacgttagtgtacccttcaccaaaatacagtttatactttggtttggctcactagttttggggctgtctaagtacatgaaccagtgccattaaaattaaaatgaaatcaaatgtgatcaagattgttttaaagaaaacatttgctatactcttgagatttcctattgtaatatcatactatagatcatattgtattttgctgttgactacagagagggaagtagaataatattggtgcctctagtaagttttgcttcttccataaacaagggcaaaatgactgcataaagcttgcacacataaagaaagggctagtatttatatgctcaaaagataagtgaattccattaaatcaaatatagcataggataatcaatcttaactctatagcattttctgttgctaacaccatattaagagatatagcataagaaatgtctttggtctcaaattttataatgaatttaaaaaagctaacggagcagcaaaaactcaataaacctcagagagctgtggtatttttgatagcgtcaagaattgttgtttccagtttatcctcagcaacccacatagagcttttcttgcgcaagagctccctgtgatccgccttcttctgtactttaagcttctccttctccctccagctctccagcttctcagctctttctttcatctgtacatgatctcatctcagttatacacatatatacttcgctgggtctttttattttacacaagataattgaaacaaattaaatttgcagaaaatttctaaaaacatgtagtatactacttaatcctctaataagagactcgttcagcaaactaggcaattcaacaaacaagtcgtgtgcaaggg

SEQ ID NO: 100753 - DNA, 5735 bp, Oryza sativa
acatgcaaatatcgatgtgcaaaaggagtggttgggaaaatattgatccagaaggcccaaaatagtgcatgtctagttggttgagctattacaaataatttatttatagataaaattcttacatctttattacttcctccgtcctaaaatataaacacttttgatcttcgacacggtattcgagatactactttaaccaatgacatttataaaagtaagatgttttaaataaaaagagtcgcatattgtgatagtttgtttaatgataaatctagtaacatcaatttgatatgattgatttttttattcttttgcaattaatagttaaatatataaatatttgacttgacactatactaaaaattgtttatattttataacggatggtggagtattaacagtttagaagcaagatatatatatgagggtgtttgggagagaggggctcaaaaatataagtttctaagatagagacttatatttttgtgagagggactaaagtttagtccctaatttacaaacacacccatagactacgacaagaaaacctttctgattggggctgaatggcaacaaacacacgcggtgagattgtaaagttgcggtagaaacccgtttgttaccattcgagaggcggcggtggtgcaatggcttgcagtatgctcgtgggaaagcatggaatttttggctgctgaagtggctagtacgccatagcccatagagtagctaggagttttttttttttttttttttttttttttttttttttttgagagcgagtagctaggagtttgggcctgaaaagagtagagacaggggtcacatggcgtctgctgcctcgggtggcccccgcacatgccattttgctgctgccccatgctgggctctctctccttctctctcttcccccgtttacaagtcaaattttacggtgctgctactaggtaacccattttgacgagataaaagaggagagaggtgcagcgggcgctatagttttataatcagctatagcacggactctaaaatacaagaccagatattaattactccctccgttttaaaatgctggacaccgttgactttttagcatatgtttgaccgttcgttattaaaaaaattttgtgaaatatgtaaaactatatgtgtacatgaaagtatatttaataatgaatcaaatgatatgaaaagaataaataattacttaaattttttaaataagacgaatggtcaaatacgtacttaaaaagtcaacggtgtcaaatattttgagtactccctccgtttcgaaatgtttgtcgctgttaactttttatcacatgtttgaccgttcgtcttattcaaaaaatttaagtaattattaattcttttcctatcacttgattcattgttaaatatatttttatgtaggcatataattttacatatctcacaaaagtttttgaataagataaacggtcaaacatgtactaaaaagtcaatggtgtctaacatttcgaaacggagggagtatatgtttatagctaactatggtataaattagctattaaattgactatagatgatttagagccggcagttggctataccgttaaacttgctccaatgttgctgcaactcgtcaacacatgaaacaaaacaaaatccttctcgcagccggaacgaaagaaagtgtcgggattacgaggaaggcgatgctgaatgctcccatgtccgagtcccgaaacatattctttggttcggcaggcataggattaattaactgaaaagataattttctgatcaggatctttccaaataaaataaaaaacagaagaacattttatgacaatggtttagtataatagaggtcagaaagagctaaagctgatgaggtgatgtttcaaattcagatatcagaatgcaaaaagggggtgcagggtgcggatattttggatgccgtggagccggcagatttttccttttcctcttcactgtgtcagcagaaaatggaattggcagttggcacccccagtgcaagtgcatagaatggaggcgataaaaaacagactccctttcattcggcgaaagttttatcccagatttttccagtattttcagtaatcaattcgatcaatgttcgatgttttttgttcagttatcaagagaactagtacacgtctacagttccgggatgaaagagagatctcctgaacagcaaccggagtggaagcattttagcactgtcggagattctgtgcatgagcacgatggacagtaactaatttaaagcccaatcctatgttggcaatcttacggcccacataatggacagagaaagcatgggcctaggcctccccgtattcggcctgtccagaagcttataattttagaccgaagtttgggctcaattcttggctgggtccttgtagaaagatgaagttgtaaactggcctggaccataagggtcttcgatttctgcgaaaatatgtagggcaaaaaccacatatgtggtggaagtctgaaaactaaaacctaccaaaatttatatacctaccttttaatttacctaaagtcgtacgggactacactaaaattacttaaaacagaatttcacaaaccccataattcatcaaatgactaatacaatttattattttaagtattagacacacatcatgcaaatttagcttagcatattattagttttatctttcagctacggcacttttacatgggcagatgagagaggaccatggtataccgattagaacagaaaatcctatccctaactccctccggtcaccatttcattctgctggaggggtgtcatcccgcatgttaagtagattgataggctaactaggcctaaccctaaatttacatcattccgaaaaaaaaatattaacactaaattacaaaatggtacaacaaatattgtaacacggcacaaataccgcgtgtgaggtgtgtaagtatagtgtgcatgcgtaattatgtgtgagttcttaaaaaagtacaaatatctgactaatcgggaaaaagaaagatctatttgtattcgggaaaaaaatctatttgtattctcactagacttactatttcactttaccattgaccttttgactttcattaacagtaatttgccatttatattgttatcacaaatttcattaagtattatcaacaacaaagagaagagagaggttatagtcgcacaaatggcataaatttcattaagtattatcaaccacaaagagaagagataggttatagtcgcacgaatggtgatatagcatgggagcggttttatttttaactcatctagaccgcataggtatgatgcaacagctagcttcggaaagagctttgctcctacaccctggaaacgaccaccattttaacccacaaaacacctcgctacacaaaaacaacagcccaaaaaagaaagagctaaatggctgcgggaagaacagacggcttcacttgatacaatttgtccagaatggcttcatgccagccatccagcaccttttgctcttctccccttaggaacaccttccacttctgtgcaagcgagagtgacctgtaaataaccctgtaaaggagaagaaaccggaaagtccttaaaagcccaatcatttattagccacgaagcccagcatacactggccaataagaccatccaaaccatcttctcccccctatcccaaacaaacccagtgcaatcccagaatgaaatatgtctccttctcaaatgcaaggcctcttcaatcacacaccaagcaaacaaagctaaagggcagtgaaacagaatatggtcagaagtttcagttttcctagagtttacaaagctcattcccacccttccatttccttttaactaattgattagcacaaggaagttttcctctcccagataaatatagaaaatgcttgattttgagaggaattctactcttccaaacagcctacatgtctgaatccttaatcccccaaggttagcagattgtacattgacttggcagtaaaggacttatgtttagtgtaaggccagatcacttcatcgcatccaccatcaatctgaacagattggagcatcttttttttttctttttgagaacaaagcggacagagtcgagcactcgagcacagtatatcgtgcaagctgcggatgccagcgacaaatatgaaacagaaattttgatttcttgagtgtgatagttcggaagtgctgatatggtggggctaccccgttttctgttagcatgtttcttaaaatattaaacggcgcattccatgcaaatattttatatgtaaaaaattctttaaaaaaatcaaataactcgatttttatattggtaatagttagtaatatttaattactcatactggtttgtttcatttcacgagccataatcagctcagttctttcagctgattctaacggacccccaagtggcacgaattcagcaaacaccccaaaactggtatcaaccactatggctaatctcctagtacaatttttatctgaactatgaatgactcagtgttcgaacaaaggccaaatgtcgtctgtaacaaaagcaaggcttaaaaaaattgctgttcatggggttcggggaattattctcttgggctcacgggaaccaaaatcgctaatgagcgatcagccgccgccaccaccccccctcccccgcggcgaggcatgtggcgcgcgcgggcatgcgtaggggtggggcgcacggtttttcccgttgttttttttttctgtttttacttttttcttttcagttttttacggttttctttccagtttttttctttccgttttttttcttttcgattttttagcatttacgtatatctataaaaagtttgtatacgtgcatgcaaactttatagacgtgcatacaaaccttgtgtacgtgcatgcaaactttatatacgtcacatatacgaactttgtatacgtacgtatataaagtttgtatatgtgtatattttttatacatcaaaaatatattatagtagtaatattagtagtatcataaccataatgtagtagtagtattatagtagtagtattagtaataggagtgtagtagtagtactactagtaatagactagtacagtacatagtagcaggtagtcgcgtgtcgcgcattagccccccccccccggggcggatctaggaacaaaaaaattggggggactcaattacacagttttttcaacctccagtcatctagagacctttagtttattatttatgatgaaaaaattgaagggggtgctccggagggtatccatgggttttgtgggtgtaggggggactcgagtcccccttgcacttacgttggatccccccccccccaacacgggaaccgtccgatcgagaacgtgcggttgaacaatcaagcggacagaggcgagcacagtatatggtgcaagctgcggatgccagcgacgaatatatgaagcagaaattttgatttttgagaaagagcaggtggtctatcgatcgatcacatccaaggcaatttcttcatacggatatcatgtcccaagacgtgcatccagctccagcttgctagctcccgattccagtcatccagtgtctcaaactgaatcagaccttgtttaccgatttactgaaccaaatataagcagaaggaaagaacaggtggttcagattccacaatcagaataactctctctgaacattgcttgtttctgcacttttgttcttgct

SEQ ID NO: 100754 - DNA, 660 bp, Oryza sativa
ttttcccttggtctggcgaccaaaagtaataggtgtacttttgtggatggaaggagtataaaaaagaaaatattgaaaggtaggtttatagcctatttagacttaatagaaattaggaattaaaataatgaatattagaataagagtatatagtccatataggaatctagaattaattaaaattcaaaataaaagcaataaaattaaaagttgagtttagagtaaatatagaaatacaatttacaaataactaaaattagaaattatgaaaattattggaacaatagtctagagtccataaaaatacaatttagaagtaactgtaattcataaattaaaaataaataatatcgaatgatgagtttagagtgcatatagaaatacaattagaaataatgaaaattcacaaattaaaaaaaataagcaatattaaaagaagtgtctagagttcatataggagtataatttagaaataactgaagttttgaatttaaaataagaaatataggagtaaaacttataaataatgaaaattcataattaaaaaataaagaacattggaagtggagtatagagtttgtatagaaatataatttagaaataactaaaatttgatagccccctaaaccctatcctgaactttccataccggacaaatta

SEQ ID NO: 100755 - DNA, 1512 bp, Oryza sativa
aaagagcaactttgtaccctgccttctgcagccaataggtacatggtttagtacaactagtgaatgctcataacgatttccttttcttttatgatcttgactgcccatgatactttgcctgccatttctttgaactgaactatgacttaagttatttcagatacagatgggcatcattgttttccttggtgcaggatacaagatggtgtattctgaaagcatgacggaggatggactgaaggaagcttatttgtgattcccttctggaactaatcacaactgcctaagcaataacaaccatatttgaaaattctgctgcaacactgtatgttatattgttagacttgaacgccaagctgaaattgtattttggcattgccttttttctgagagagacctctctcctcaaatttctgttaaaaatttgttgcacgattaaaattatcatggccaaattttgattttcctgcatgatctagttgcaaactgtgttttacgtttgggtacatttgtctacattttttgaatggaatattggagttcatcgttgaatttgctactgtcataatatatcataatatagtgcatagttcttttcttctcatatacaagttggtttgtgtataatgcaagcatgtccaactgctcaagaagcaattgaggtttgcaagtatttgtggttgacgaatagcattttgcgttcctccgtgaattgttaactccagtctgagaggaaaccggagccttgcaaatgggtcatggagtattgacgatgggatcagaaagtgttaatcaaataccatcggcacttcttggcgtgccagacacatctgttctagaagcagaatcggaatccgttcattccggtcaaatagaaacagagcagtatcttggtgaaaactgctgcatcaatcgataatacaatgttctattttttctgtaactgtcataaacaatgttctggaagaaagcaaatgcgaagaaaaagggaacatgaaatcaaagtttggatttcttttaagctgaaaagaaattcaaagcgtggaaacgaatttgaccgcgtgacgcgtgggatgaagaggagaggagacaagggaaaaaagaaccttctggaggccggtttaggcacggcttttcttttttgtcttgcttcattctaaaataataacttcattttgtcttgtcttctgatttatctaattttaatatatttgtcccttggtttttataatctcgattagaattctcgttactataattgtcctataaatttagtgagatcaaagaatgtattgttgattttcgtcttttaagcatgaattagggggcttctttatagaatgtaagtatggtgttatccgggtagtgatgtgtgtgcgtatgcgtttccatgtaataaaaaatgtctataatattatgccctcgaatgtaataatgacttccaaatgactgagaaaaaaaaagtaattgttagaaaaacggtaattatagggagctttttattagtaccat

SEQ ID NO: 100756 - DNA, 713 bp, Oryza sativa
tttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcagaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgcactgaacaataatatcaagtacttgagttgatcctagaaacaaactcaatgtctcacaacattaaataaatttgtcgggatcaaaagtgcattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcata

SEQ ID NO: 100757 - DNA, 657 bp, Oryza sativa
catacatatatattgcgcagttaatattctaattagtcatttaaaattccttaaaatgctctcaagctgccacgttgtgctctaataaattagggcaaatattagaaattctaagaaaaaaataaagtatccgttacttgattttcacttaaatcggtaggtccaatattataaaccgttagattaaattgatcttagaacaaactaaatactacgaggtcccacctcagcataggtatgcacctacgtgcatgggtacgtacgcctcccctcccttttttatttttctctttcttctttttttcccatgcatatgcttccctccttttattaccatatcatgcgtctttatgagacgatttaatcaaaagaattttgagtatcatgcactcatatttttcatttgtggccatactacacgtatgtatatatagatggactgtatgataattaactagcaatatttttttatttactcgagaaaaaaaacatgattcaaaagttataagtacttaatccatctcctattcaaaagtttatgaatggttttctaaaataccttaagaaaaatagaacccttaatttattataaaataacatcatccaaactttagtttgccctaaatttatgaggcaaaatttctgaacaaacaataa

SEQ ID NO: 100758 - DNA, 563 bp, Oryza sativa
ggtacccaacaagaactcacacgattatattttgatgaaaaaaaatataaattacttttataatatatctaaattacttttagatttcactaagttacttcttagacatataaaagtaattcaataaagcctaaaagtaatttacatatactatagaagaacttataaaaaaagaaagtaacttctataatatatgttaattactttaaaactttattgaatttacttttatatatttaacttagtgaaatctaaaagtaatttagatatattataaaagtaatttatgattttttatcaaaatataatcatgtgagatcttgttgtaaagatttaattgttatgaacacaacagtgtaatcggatcgtagatcggatgaatagattaagagaaaattatatttgaagcataaatggtaggaatattttttctacttgcttgatcaattagtactatagtaaagtaagattcttcaagacacatatctggacaatggctaatcgtatctggacaatggctagcgtcgctcgttatgactaaatcaagagcgctctcgatttag

SEQ ID NO: 100759 - DNA, 631 bp, Oryza sativa
cgttcaggtgctgcaaaaagcggcgtaacgtccctgcttcttgtactggctacgctgcaataattctgtactataaccacttgtcttagatctgataagatcgcgaggcctttatcactttgatctctggtcgtcatctgtcagcgacttttttctctctctctctcttttcatcttcttttctctcggaaagaccaggcttgatcaattcatgtgcatgtcttctttgcaggatagcggtccaggacattctgatattttagtgaacagaagaaagggccagttgcaaattttcccacacttaatgtattttgattttgcggggaaaaggtattttaagaaggcttttcatcactagttcactacaggaaaccagcagaaacatatcagacagtgaacggcacgaactagtagtagactataatatcttgtgcataagctcggcacatgattagtctttattttagtaacatgattgaggagccctctagctgtctggcatgcaaaagaactccagaaatgatggagatctgaaggaatctttcgtgctgtttttaaaatccatcaacttctgtacaaagcagaaataataaacctttttttccccctcacactttctgattgtcgacaa

SEQ ID NO: 100760 - DNA, 591 bp, Oryza sativa
agtatttatatgctcaaaagataagtgaattccattaaatcaaatatagcataggataatcaatcttaactctatagcattttctgttgctaacaccatattaagagatatagcataagaaatgtctttggtctcaaattttataatgaatttaaaaaagctaacggagcagcaaaaactcaataaacctcagagagctgtggtatttttgatagcgtcaagaattgttgtttccagtttatcctcagcaacccacatagagcttttcttgcgcaagagctccctgtgatccgccttcttctgtactttaagcttctccttctccctccagctctccagcttctcagctctttctttcatctgtacatgatctcatctcagttatacacatatatacttcgctgggtctttttattttacacaagataattgaaacaaattaaatttgcagaaaatttctaaaaacatgtagtatactacttaatcctctaataagagactcgttcagcaaactaggcaattcaacaaacaagtcgtgtgcaagggtggagaatgcgaaataggggggaagagagggagaggggaggatac

SEQ ID NO: 100761 - DNA, 684 bp, Oryza sativa
ttctttttgtcggatgctgtacaggatgccggcaacaaagcccatggggatctactcaggtaagcctttcttactgttgatgatgctaaccttgtgactttaactacctttcagaaatttgatgggatgtatggccgaccaaccatgtagtgacaatcatgaatcatcacggtctgaaaataacatatcggttggtttattgtgatgttgcactcacaacaaacctgatgaatgcaactcgttttcagctcatggggatccatccaatggcaattgtcggtggaaggcaaaataggtggaaactgttaaaatgagacaattcatcaattgcaaataatcccacttcagaaaattttggagctaaccttcgatgaaattgtcgttacgacctgcctcacgaaattaaatcaataaatcatgtgattgtattcttcaagttgaacagtcaagctgcctagaaggatttttattgcctattacaatctgtatacatagtataaaattctgacttacggagtagtaaatttaacagcacacagacattgttataagaattccctagtccctgctaaacaaaggatgaattttatccttatatatcttttgattaaaaaaaaatttctgaaattctagcattagaaaacaatggtaatgccttctttctagtttttttttctgtattag

SEQ ID NO: 100762 - DNA, 668 bp, Oryza sativa
ctagaggcaccaatattattctacttccctctctgtagtcaacagcaaaatacaatatgatctatagtatgatattacaataggaaatctcaagagtatagcaaatgttttctttaaaacaatcttgatcacatttgatttcattttaattttaatggcactggttcatgtacttagacagccccaaaactagtgagccaaaccaaagtataaactgtattttggtgaagggtacactaacgtgggacagcccaactggatattacataggtacacaatgttgttgtgttcgtgtatagtgtctatgtacttccatccctcttttcatgctccttccattgctgtggttgtcaccatatttttgtactttgagttcagtaagcttcatgttcgcgggcatacttgtactattaaggtttccaatacaacttgaactgaggaatgaccctattatcattttttaatacaatcgtgacttgagttagatgaatgtccaaagagcaactttatatgccttctgcagccaataggtacatggtttagtacaactagtgaatgctcataacgatttccttttcttttatgatcttgactgcccatgatactttgcctgcatttctttgaactgaactatgacttaagttatttcagatacagatgggcatcat

SEQ ID NO: 100763 - DNA, 528 bp, Oryza sativa
cgacattgaatggagataaactttatataaaagttgtagatcttgatgagatctataactttgtagtttatcacttttccatttaaaatcatttggagtatcgaataagcattattagtttttaagcaattaaaaccggtggaaagggtttaaacacaaataaaaattttgcatttaggttttaaaaatcgccctcccaaagggcggtaggcgattagatttgttaattttcgaaagaaaaaatatatttttaaatattttaataaaaaaattccgtgtttttggacgtttatttagacttctctctttttgcggtatgggactatgggagagtagggctgttgcatttagaggatattcaaagttggaggggccaaattttaccaaatactccctccgtctcataaagaggcaactccgagtttctcaatgcaaaattaaataagagaataaaggaccaaaatattcattataaatagcaaattagtattggtgaatctgtaggtaaggggtattgaaggagtaaaa

SEQ ID NO: 100764 - DNA, 721 bp, Oryza sativa
ggtaaaataaggtactctctataaaacatatacatctcagcaatagactcgattaatagtaaaccaccttaatagtatgtctacatttgtatctatagctctctcatgcattgcctcgtttttctctatagattatctctaagttagtagatagctttactctctctcttcatttaataccttctaagtaggaaaatatactgacataatcttttgtagagagcttataaataaccagtgataactttagaggagtaggtgaagcctgtccttaaactcaccttacaattaggagtagtaattgctatgtgtaggttgtcctgtggagtttgtggacgttggagcagatgatgttgcatttgctaaattggtaatggtgaatttattattgtcttggtgtgattaggtgaacacttttgtcctgtctagctagtatagtactccacaaaccaaccttgacgatttcaacagaaaataaaaaggctaatctaatctgttagctaagcttggctgggtttatctggactggatggatcatgggtgtgtgggtttagctcaggtaggcacacgttttgccaccctgctcgtatactccctccacccttaaaaaaaactcaacctactgatctcttctagttcagatttattgtcttaggatgtaacctcttctaggttaagttttttagacgagaaaagtattactctatgatatctccctcgt

SEQ ID NO: 100765 - DNA, 611 bp, Oryza sativa
aagatagccgagaataagaagaagaaaactttcatgggagataacaacgtgatgtttatcctctcctatatattgaccatatatattattttctctcattgaccagctaattattagcgtacgtatatatacggctctagatcgggcgccacgtacgtgttcggattaatctctagctggtaattgatttggtaataatagtgctgagatagatagatcagctggacaccagagtccgacgttccgttgaagcatcgctaatgtcgattagtacagttatggtcttccaaggtaaaaggacgtacggttagattaattgtgctcaatgatgaatacagccattcccttactgtttgctgcgtccagtttagattgtgacatgaagaattcaaggcctgcatatatatatgcgcataatatatataatgtcgtgtagaggaagcttcaatgtacctgtaaagatccttaaaccaacttgagccaactctcccatttactgttcttattttcaatcaagaaaaataccttcatataagggcaggtgttgtgtaatttagtttactagctagggcatgcttgaaagtcattcattttgcaagcttttcatatgg

SEQ ID NO: 100766 - DNA, 809 bp, Oryza sativa
actttattgagcttggttgaaattaagaagggttaatttgttaagttcgaataattatatatcaaattttgaagaaaacttgtacgaatttgaacctctctcatcgccatgacaccgagaaaataaatatgattttttttcttcgtctaaatgtaaactttcagatggaagtgtgtgaaataagtgtgcatgcactcatttcaaaacagctctggtttggaacggagtggtatatactccactaactgtttgaagttaggttgccatccattttattgagggaatattaattgtcatcaagcggtactacgtgtgaacttaatcggaacgtggtcgtggtctgaccaaaattagctgagatttaagtcaagcagacacgtgcactgcagtttgagatcagctgcgtcttcagaacaccaaacacgcgtacgtgacaattggcaaccctttcgttcatattcatcgatctttcaaagactcaaacgtaggattataagccaaccaattaacgatcaatatatggtactccctccgttctaaatatgctactttgaccaacagtattcaaaaaagatgttttaaataaaaagagttgaatattatgatagtttatttaataataaatctagtaaaaaatgttaaaaaaatgttagacttgtcactattctaaaaatacttatattgggacgaagggagtaagatctatttgattcagcacacgaacccccgaaatgcagcgatcaattaattagttgccaaaaaagataaagattaaaagaagatgaaccaagtcacggaggtgatttgaa

SEQ ID NO: 100767 - DNA, 1047 bp, Oryza sativa
gggaagggattagctgactggagtagctagtgaagtggggaggtggaggtcacgtacccttggttttggataacgagtcgtgtccccgtcgagctcgacgcgagggggggagatgagacgagatgggccggcggcccaagcgcgccaccgctcagcccaggaagaggaagcccattaacaagcccaatcatttatttattaaggttttattatatttttctcctttttttttgtcgacgacatggaatccgttaattaatcaacaaacaaacggattaaatgggctgtccatcttctcatattgaatagaaatgtcagttactagatcactgatcaatgcaaatatatattatatatacctcctccgctcaaaaataaaccaatcgagtttgtgtagtactattgatttattactccatattggtttatttttacaatggaatgactactctatatatactcctatagtcacaagtcagacatgaaggacaagaccaacttttggaattttgactgattttttattaaataagtttatagaatctaatactccctccgtttcacaatgtatatctatctagattcatgatatcaatatgaatgtgaaaaatgttagaatgacttacattgtgaaacggaggaaataatttataataatattttttaagataaatctacacgtgccatttactttctttttaaactaatcatttgataaactatcgacagtcacatctttaaaattttgaccagatctttgttaacaaacattaaatagcagttgctatatattaatattactttctctattttaaattataagtgttttggttaggttttgaataaatttatatatgggtctatttacaatataccacgtgtccaaattcatacggatgtaaatggatttttatattaagagatcaaaacgtggaacggagggaatatcatccagcatgaaatcgatgcattgatgacgtgcacgcgcatgtacgtatgcattatgcttatgcatgtgtacatgctaaactatatatagacgaacag

SEQ ID NO: 100768 - DNA, 525 bp, Oryza sativa
ataatacatggataaggataaggataatatatgttgcacaattttttttaaaagaaagactgagcataacgatttcttttatgcagtatgaatactagctatatgcacatgcttcttaaaatacaatttgttagtaacaggtcagggtttgtgtagcaaaaacagatcatcattctccctcaaagaaaacaccctccaaagaggaaaaacaaaaaaaaagaaatggagaggggccgtgggccatgtggagctcctccaataaaaccaaaagcactaaaaaaaaagccgaaagcgccttttgccgtcctccattacttttccccctcatcaaaaaaacccaagctacctcatcaccccaccatcaaaggcactgacatgtgggccatagtatgcaccctggcccacctgtcattgaccctcgttctccaagtggcacgagacggaataaactaaggcgggcgcgtgtatccggtacgggcacccgggtggttgtacacgaccgggtgatctggcggcggtgggccc

SEQ ID NO: 100769 - DNA, 1014 bp, Oryza sativa
aagttacgtggcattgaggcattgacacgacatttctctcaaaccagtgcgtcattgtcgccacaatacgcatcgcgctatagtataattagtttagtcggaacatataaaaattgatcataatgtcgtcattttgttaatcaacttgcccatatattatttatgctccctaacaaaatttgtcaaatatatattgatatgacttgagtgaacctgaatgggccggcacatatatggcacaggtcaataaaaggaagttggccaccggtacgctcgtgtcatctttgataagattgttcggaattttatttcccttaattatatttgttagtactacacattttgtcctggggctggaattttctacctgatgactctagtactccacatctgagtgatgttattttatccgtggcacacactgatgcagttaataactaataaagtagtataggctaggattgatgttagttggtgaccggcctataaatgagtgtcgcgttttcaggcaggattattgtatagttgtggtttgcaattctgcgtgctacactgacagaaattagcagtagtaggagtagtatactagtatatattactattatatacttacatcagattgtataaagtgtatgaaactgtgacagtctgaaagagtagtaatctgccgggaatatgggtatcatgagattcccaaagtatgtagtcgtaaaagcagcaggtaggtacgtggattggagaatggtgcggtcgtgcgcgcgtcctggaaagcaatataatgcccgtaatatcgtggatttgtgcgtgcgtttgaccgtcacttgttcggtttggccggttggggttgggccgggggggtgtcccactggcaaccaaattgaaccccattgctagatttgtttcaatctttgacccatactcatactggagtatctactagtatctgtggatccgaaaagcaagacccatatggaagaatttttggtcagatcgctagctagcagctggaccttt

SEQ ID NO: 100770 - DNA, 520 bp, Oryza sativa
tgccaaaacctgacaccgatgtggatgacggcaattactaattgtgatcatcagcaaaagctagctaagctcaagtggatcaaagcagcaactgtggccttatctgatccattattgatatatatcaagcgctggagtatgtgagttgcatgccttttttttcctacccttttattcctttcaaacgtcatccatttatatatgtatttgtatacagagatgctgtgcatatatcgatccgaataataataagaagaagaggataacaaaaataactccactttttcagtcaattaggtagaagcccatgctgctgattgccgcgccatacatatatatatgatgggacgagagagctagctaggcaaaagaaaatggatacatagatacatatatatataatcgatgctagctgctactgctgagatggatgagaataaattaaaggggtcattcgatgtggatatatggcggcgcagatgtatatattactccgcatattacatgatctagaaaaccg

SEQ ID NO: 100771 - DNA, 710 bp, Oryza sativa
cctgctactattaagctttatgatgaggcatcgatcgatatatcaaggttaataaatccaaattctacatatcgttttctcaccaattaagcttcctagctagctctgtcctatcagctacaagtggtgctatacagaaagaaggcgactgaaacgttagctgcagagtcgacgacttaatttaattaatttctttgtttttatcataccaagttagctactagtactcctgtttccactagattaattacgaaaattaatggtggcaataaaatggaaatcagctcgcatttaaaacccgaaatattcaacagtggagaatacggccactgcattcgcgtcaagttgttgcctaatacttaatcatcaagtagcactaggtagatctccaaatgggaaaaggataaccgggtgaagtaaataattaatcaattgcaagctaatctaatcattgaggagattagtatatctgttgattacccgacgcgtccattttttagcacgcaaagaccaaatctagaggaaaatgtcatccacgaacgaaaacattcttatctgatttttttattttcagatcgatgcagtgagctctacggaaaattcagtcatcaattctgttatatgacgcaggaaaaaattcagtctttcgtcatgcatttggctaacgaattcctgccttgtcagctccagcagtcagaacttaatttgtt

SEQ ID NO: 100772 - DNA, 607 bp, Oryza sativa
tgtttgaatgttactcaaatggttataaaaaactcaaaaaaatttaagaaaatatattaacatgtgatatatccctctacaaacatgcaagttcaaatttaacttctacatctcgcatcgaaaaaaaattaactatagctaggtaacgtattctcatagtcaaaattgtttttttacgagatatagaagttaaatttgaacttgtatatttgtagagtaatatatcacatggtaatacttcttctcaaattttttcaattttttcatgaccatttaagtgacatgcaaacaacgagtggatatctcctcaagtgattaaaatagtttccctaataattagctagctatatacacagtgcacacgatcgagatagatcattgtttgatatacttgcaccggtcattttccaccgcaatatttaggattaggagtgtgtgcgtaactgtgtatatacacgatgtgacactgcatgtgtgcagttaagtttagtacgagacactcattaatccgctagccaccaaaatattatcctggattaaagttaagcatcatcatgcctcctaaagttcattaagaatgcaagtggcagcttaaaggatactccat

SEQ ID NO: 100773 - DNA, 594 bp, Oryza sativa
ttcttttcttttgaccacgtaaggcgttctttggtgggcttttgtgtattttttttagtaagatcatccttatcgatgtatactacaaaagggtaagtcaaatcagtaacacacaaacataaaatagaagtaataaaatttaggatgatgtagagagttcacacattcagatattttctttggtgtttggttgttttgtttcctcttcttttcaccctgtaattagtctgtctggcatgatagcttctttttccattcgcgcttgaaaaggaggaaaattagtaccattcacatgagcatatgtaaggatgaaatagcatagtactgtgttatttttgttggtgtttgggttctgattttgtccttctttttaccccttgattcgtagatgaagttagtctgatttgttggtttgtatgttcttcatgtagaacctataagcctcttgttgctttgattgcactcgttactgtccttatgttaggtcatgttcacgttagtattatgataagttgtagtaacgttagcgagagaattttaattcactttacctccgtttcacaagtagtgtaaatgtttggatttatataggcc

SEQ ID NO: 100774 - DNA, 502 bp, Oryza sativa
aatggcacaatttcctgagtgccttgtagttgcagacagcagcagaatgtatagtaagcagaactaagtgttcactgttcagggcttcagacaggcgcttaggcagccatagtgtagtggtgcaagcgcgcgtttataagaaatgtgtgtatgcacgcgtatatgagtgcctacattatattatttaaataataataataaacgtctggaacagatatcgttcaccattatgttacatttagggggacatatatgtgaaaacaagctagggggacatatatgtggaaacgagttaagtgttggaaactcatgaaaatcatacctaaaagttttgtaaattcataaaaaaaactaggaataggtgtagatatgaaatacattctcattaaatctcaagtttaaactcaacttcagttaggagtaacaaaaaagacaaatttcaggtggatggtacaagactatattcatccgaaatttgtctttttttttctcttaagcgaag

SEQ ID NO: 100775 - DNA, 986 bp, Oryza sativa
cttttttttgacattttttcctcacgcgtttttttaaaccgtttttattttctcgtgcattttttcttttttaatatacggtagaaacttctcttttaaaatagttatattagattagattcgagataaagaagagatataaacggactactaaaatgacgaatagaaattagagtttttttctgccggcttttttctggcctttttattttttttttctcatgcatttttttacgaaaggtttttttcgccactctcttgtagtgtcggacctttctagatataataggattcgattttttttttactttagaatcggatattttttttattttttgcgccctttttttactgtgtcaacggagccggattcgtttcgattttttttctgtttttttgccccgctttttttttatcaggctgatttggtatttttcgcccgggttttttttcgccccatttattttatcggacttttttttcacccggtttttcgctcgttttttttcgcccggttgattttttttaccacatcacatataattcctttttacgtggaatcggacatttatttaaaaaaaattacccttttttttaccgcgtcgatggagtcggattcgttttgattttctttccttttttccccttttattggatcagacagatttgtttttttcgcccggttattttttcgctgatcggactttctttttccgcccggctttttctctcggttttttttgccggtttttttacggacgatggaagcacctcttattttttttaaagtataagtagagatagagattaacggatacaaatttacttatctagcctttcatctaatcttgaaagtgatacgtggcccacgtttttaggtacgttgtgttggaaaccgttagattacagccaatcaacggctatcagggtttccaatcccactaaaaaatctactggaccatagcttcatttttcttttcttccta

SEQ ID NO: 100776 - DNA, 601 bp, Oryza sativa
gcccctatctgccgcaaacctagggtggtacgcgaccaccgccgcatctactcctatcagccgcaagccgacaaggagcgatgcatttttctcttttttatgttaatttcagaaaaaaaaatccatatatggaatccgggaccgtccggaccgggtcgattttaaaaaaccatggtttttcggtcaatcgctcataaaatatagcggaacggtttattttagataaataaaaaaaagttgactattgtaggatgtggaacaagaacaaagtgatcccagagagcctgtatcaaatcatcacgaagaggcctatataaatccaaacattaacacgacttgtgaaacggaggtaaagtaattaaaattctctcgctaatgttactacaacttatcataatactaacgtgaacatgacctaacataaggacagtaacgagtgcaatcaaagcagcaagaggcttataggtcctacaggaagaatatacaaaccaacaaatcggactgacttcatctacgaatcaaggggtaaaaaggacataatcagaacccaaacaccaacaaaaataacaccaggtactatgctatttcatccttacatatg

SEQ ID NO: 100777 - DNA, 934 bp, Oryza sativa
ttccgacccctcggggagatagagggagggcgcgcctcatcacccttgggcccgacccccccgagggggtcaggccacgtgggtgaccgcggctgccccaaacctctagtcaagatatccccggtcccatgtcaccgacagacatggtatgtggtgggtcctaatgagatttagtcaactactattaggtatgtggtatctataactatgacaattatgctattttgtatgatagtacaaagatccatggatctcaatgtatttttttttcaaaagctaggggacccaaaccaactttggtctctatataaaaagctctgcagctagaagaaaccacctataataagattaataagattaatagttactatacatagtgtatatatatgtcatgataagtatgaaaattaataggagtagatggtttctgggatacgattacccttagttggtcaatagtaatcctgttatgttgttgattcttgcaatgcacgctccacggtacggccatgctgatctttctctctcgacctgccggaatttccacaacatgttgtccttccagagaactacaccgtactgtagaaagttgactataaatgtggatagaagtatcatggccgtgtatagatttattttttttctaaaaacgtcacatcgaatgtttggagacatgtacgaagtattaaatatggatgaaaaaaaaatcaattacacaatatgcatgtaaattgtgagacgaatcttttgagcctaattacgctatgatttgataatgtgatgctacattaaacatttgctaatgacggagtaattaggcttaataaattcgtcttgcagtttgtaggcggaatctataatttattttgttattagactatatttaatactttccgtgtacttaaaaagattttggccaaggaacttatcacag

SEQ ID NO: 100778 - DNA, 661 bp, Oryza sativa
gtacaaatcaccttagttacctcaggtacaatgctttgtcatacgtgcagaacgcaaatatacacacgtgagaagtctttagaagttttttctttttttacaaaagatagatatgacagtcttgttaataggtcctttaataggtctagttaataggtccatcagtttaagtgaaaaccgacatcaaaatattttttattaaaaataatataaaatagtgggttcattaattaatgtaaaaaattagttaatatagattataaattggtaatttactggtacataatataattgcgtaacatttatattaaacaatgtaattttaaaattttgatatagaataatggttcgatataataggtactcggtttaagtaaaaaaatattgtattgttaatataaagggtaaaataatatagtatatgatgatatatataatctatgtttataaagtgataatttcttaaaatttattatcactaataataattacgatttcgtctatatatggagaatagaaggaagaagaaggaagcaaaagtacgtctttactgatataagtaatttatatttttattttttttccaatttatctttttaaatgcacgttacaaatgtatatgtattttcggcttttttacaaatcgaacgtacgtacattt

SEQ ID NO: 100779 - DNA, 546 bp, Oryza sativa
gtcgaacccagtggcgcaaccagtggacatgtgagagcggccgcgctcagacagcaaacttccaactccaaccgccatccgaaacccaaccagatttcttcccaattaaatccccctccctcctctactcgatcgctctacacgaccgatcgatcgatcgatcgagagcctgacccacgcgtcgtaccggaccaggatgttggattccattaatgccagcagctatagcccaagtagcttagctagccatacaccgccgtcggccagcttggcgagaccgcgacgttcgcgcgccgcgcggcaccggccgggagggggggggggggggcgagcgcgacggggacccgcggccgcgcgcggcacggcgccttggtccacgtacgcctatctacctagctcgtgcagtgcggactacgcatgcagcgcccactaccaccttgccgcgcaacaccagcatttctttttcgcctcgtctcgtctcgtctcggctcggggtcggggtcggggtcggggtgtgcagtaaaaaacaaaactttgcaccattca

SEQ ID NO: 100780 - DNA, 691 bp, Oryza sativa
gagactatttgcacgctttaggatgcgggtcagttacctaatatatttcacgtaataaacgcccttccatttccagacagtaaatattcaccttttcagtagccttaacaaaatgtgcacaaaaaatacccaaagatgcgcatatagaaagggtttaaaacaaatttaattaccagcaattgctttcggtctgtgcccacgcgtcatgaataacaaaaagagtataaacaaaagcaggacggtgttatggctaatagcaccaaacttgtaaagcatcaaatgtaaatcgatcaagcatacgccacaaacataaatccaagattccaataggcaatacgtgcacgcgagctaataaataccaaaatcatagtagtctcgataatattagcatcaatgagcgaggaagagggtgagaggcaggtagtcaatatatgatgatgatatatacaaggaaacatacctagaggaactggcgtctttggctgactgctggggccagctgatgtcgatggtcaggacagagaagcacaactcaactggacaacagtcctaataattaataaataaacaaatgggtacatctaaaattttgaagaaaacaaacttggaccgcttctgtgcttttctgcttacccttcaaggcggctctcgaggtttggacggtttcaattccttgccttcttcaataagc

SEQ ID NO: 100781 - DNA, 1150 bp, Oryza sativa
ccgctgtgggttctcccacaaagaagacccttttttactgcccatgggctgaaccccattctgagctacagtgtccaacccatcgtaaccctcattttatatggcccaacccaaccctgcccttattccttcctataacccatacaagacacaccattttcagcccattagtgtttcaacccgtacaacccatgggttggctaccccattaccaggcttatctgtagttccccataaatatcttgacgggatgtgtttgcttgttgcaatattactttggcctagttggacagaaagggaagaagtctgttcattctgctttggtatattaatataacggagttagttacgttttcaaggatggctttcaattaaaagctgggccactggcctcttttctaaagaaagctatgttttccaaaaaaaaaaaaatcaatactccatgaaggatgatttcatggcagataaaatgaagcatacatgaacaaccttcatcaggaaaaataaattattaggcacttacctgtgtttacccaaagagaaagtcacttttatattgaaaattagaggggccgagataaagtgctatgttatgtagcaactttactcaaatcctgtcttttataatatacattggtcggaatcttggccgacccggcgaaaaaaactttactcaaccagtctgctattacaaatcagattttaatagctgcgtgctattttcggagaaatctcttgtatttcatttccaagtttgaacaatacaagttcattatgattttatacgctacataaacaaagaaacatgcaattcattagtaccttagaagggtaggttgaatataatataatataataatctgaccgattttattaatagaagtgtttcagttatctggaaatttaactttggacagacttgaatcacaaaacaaggacttcaaaatgcatattgtaatatttctgcactagtcaaaacaattcaagatttccacatcaagactttacacctagtggattccaaaatgcagagaatgtataaaaagagccaagagaatttgaaagctatgctggtttcatattccaacatctgtattatatacacatatgcttcataggtttacacatgcaacgccaaggtttagtcaag

SEQ ID NO: 100782 - DNA, 712 bp, Oryza sativa
cgccggtgggtgccaagggggtctgcgcggtgtgcttccggccgacgacgttcaggtgcaagcagtgcaaggctgtcaagtactggtgagttgtctgaattctgaaaccctcttctgagtccccctttgcatttcgtgaaatttcaccgggtgaaaggggaatcggaaagagagttctgcgattggtagtgcggatttctgtatttcgtagtaatttcggtgttcaaccttgaggagggctagtggttccagaaagcctggaatttgcgtctagttttggtttgcgcataacatgaccatcttgaataactgattggcaagtgagtttggtatggataaccctctatttagtcttttctttgtgcccatttgttgcatttgaagaatctaatgtggacatatggcattgctaacagaaacacagttttgaaagacattagcctgtgaatcgctcatctgtcatattcccaactaggatcctaatggctcaattctttctattacttttgttgatgatgatcttcttggaaactttactttttttagcctgacttaaagttgtccgtccattggctcggggcacatatattattgtcttttatttatgaatgaacttaggcacatgaccgggtttaagatgttaggatctcaatgtctaaaatgttctctagatgagaaaagtatcattttcacaaagcaatattatttgttg

SEQ ID NO: 100783 - DNA, 598 bp, Oryza sativa
gaatgagttgtgatcgagcttgtgactatccttataaacctgacaataaaacattaaatgctaatgttcactataagctcgtggtttggtcacaacagaaaataaaataaaataatattgctgcccacaggagggagttagttcatcgatcccttgaataaaaaactcccaagaagcaatattttctaaactaagtgggacctaacaggacccaccttaatttctctcacaggttttaaccattattatggagtttgctatagctttttttttaataatggatttttcattattagataataagactctatatctataaaagatatacacgggcaaaacatatataggtaattagattccaaccctcactaggagaaatacacaggaacacacacacataaaagaaaaactagctgtaaccctcattgacgacttattatttctattgcaacatgagagggcggaagtggagaatcgaaacagtttgtgctacctgtcgccacaccatctctgcctcgaatcacaatgccatctgctactaactaatgtgtctactgtcctacgccatcatccaaatccccttacgccgccgcattaa

SEQ ID NO: 100784 - DNA, 535 bp, Oryza sativa
tgtctacagttgacctgtactaaaaatttaggctatatttcagtttcatggtagggaaatttgaacagattagggtcaagaggatatcggcggagcaggacatgcccagttggcattgttctgtcccattggattgttacgtgcacaggagttgattttaaactctcgaggggatgtcttttcgttgcttgcatgttacttaaattattatgaaaaattttgaaaaaattgagaaatatattaacatgtgatatatatatatatatatatatatatatatatatatatatatatatatatatatatatatatatatatatatatatatatatatgtatatatatatatatattttttttttttatatatcacaaaaaaaaaaacgtgtgtgtgtgtatatacacgctctctatctgtgtatatatgtgtctatctcgcgagaaatataaagtatatattttttttgtgtggagagggagagatctcacacacgcacatatatttttatttatatatatatctgtgggggggggcg

SEQ ID NO: 100785 - DNA, 602 bp, Oryza sativa
attcctgcagcccagtcacgttgaagggtaacatcagaggatcatcttccgtgtttgggattttggacacggttataaaatacttttagcgagttatacctaggtagtactacatgctaaatttagtcattttttatggtatttgtaacgttacatgaagcttcgtcgatatgtttatagggtgggcgtttaatccgaccgaaaaattcagtctcgatctgttatttagaaattttggtcatttaaaattaaagatcgatcggtcttggacaccaaaaaattccggctttgtctaaatcatgaacgaaattttaaaaggtccaaaataatcaagcgaagtcttaatttctagattaaaaaattttaaccccaaatagacttttgactattatggatcaaattaaagcatactggagggttaaattgggtcaaaattccggttaattgggttggtgatcgaatactaaccgaattgaccgaataaaaatcaatctttcaacacctgactggcctatagaatgaaattttccggtccggctttttttgtccccccctatatgtgtaacactttaaaaaaattaaaagtgaattggggaaaccct

SEQ ID NO: 100786 - DNA, 684 bp, Oryza sativa
tgccattgaacttttgtgctgtcttgtttgcttttccacccaaagatattcggaggggaatcgtggagaatcagaattatttccgttgggaaccaatcgtatcgtctataggatggatcgttgctgatgaatcatcaaatgcttatatcatttgatagctctggcgcaccgtggactgtggctaatgaagtaccactactccattattaggtttagataccgtcacaagcctaactgacgggcggtccacttacacataacactgcacttacactttttcatcctcacctcgtgtaaaaagttaacccgagagtcgtctagggccggcgccatacgccatgccatgtgcctcaacatagatgccacatgagccatatgctcgcacaccgacccatacgtacaactgcgagaatcggctctgataccatttgtcacagccctccctccaaaaacatgtagcctaacccaactgacgggtgagcccacttacacataccactccacttacattttcgtcctcgtttcgtataaaaggattaacttgagagtgacatggttggagggaagaggccttctaagttgatttcaactttgctaaacttgcaaggtgggactaaacatgcgcacacagctctcatgagccacacatgccaatttcctaattgggccaagatgtcaagatac

SEQ ID NO: 100787 - DNA, 578 bp, Oryza sativa
aactagcaaggccatgtgtgatcgatgagtcgtgaagctgtgggagagggaaaaaaaagggttatgtgtgattgtgcaaggccgcagtgggaaatgggaatcagtgcggtaaaagtcaggtctaagttagccgcttaatcggacgtttatttgtacgtcaatgccacgaaccaaagaatcgggacgtgttttttccacggttttaaatctccggctacagcggtttgagaagaattatagctatttgctctcacgtacagtttagtcgctatagctccatttagcccgctataactaccgctatagctatttaagaagctaaccgctaaacattttaacctgctatttaaaataatggatttctcaccgccaacgcctgattgggcgatcctgcttaatcagccgaaaagcagaggattactcaccacttgcttccttctcgcgagtccgcgccttcgttcgctcaacgttgacgcccgcaccctgcaccttgagcagaagcacgaattaattagcagaggaggtcgacgagacgttaacaggaagcgggggcagctaggacgtcaggaggtgaccgt

SEQ ID NO: 100788 - DNA, 731 bp, Oryza sativa
ggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttagttgtttcgacgtcgcatcatgctgatagacagttgttatacaaacagcgatactacggcttggttcagttcccaacttttttttcaaacttttaattttttcatcacataaaaacttttctacacacaaacttccaacttttttgttacattattttaattttagcgaacgaaacacaccctacagctcgtggaacagatcgtgtgatcgtgtcgcaaactaaactactggttagaagaagaaggccggtgtaagttgaaacttcagaccaatagcaatcagttgactgtaacaacacactgatatttcgagcgagcgagcgtgaggagaagtggtgaaattcgcctcttgttcccgtcgtccactcatctcgcgacgacatgctcgagtgcttctgttgatggaaatcgatggattcttcccagaactcacccgctgcctaattaattaaaaatctagctctgatgcttgatgattaccaccaattggtctctttgatctgatgctatttagagtccagatcacaccatgtcaccatgcagcatgattaatttgtttttgtg

SEQ ID NO: 100789 - DNA, 511 bp, Oryza sativa
aagaccaatcggtctccagttttagatgaccgaaatttctaaaagaacgaagattgagaccagatttttcgatctgaccgaacatccacccgcatctgtcaccggcagagaggactggcagtgtcggtggacatggtgggtagtggtattggtggctctcggtggcagtgtcctaggggcggtggcggctaggtgagcttcagcgcctagatctgaccacggccaggcgaggacggggggtcagtggttgtcaatgattgggctagctgatgatgcaattgtcgttggcttgcctgacgcatatgaggaccatgccagcagaggctctcggtggtggcgtcctaaaggcggcaactaccaagcaagtgtcgacgccaaggtctagctgcggattggtgtgaacgacagtagagtacctttggtgagctcatggcagtaaaaacaggtgcatgtcatgcttgacgcttcacgacactctaggagtgatggcgagttcgacagtctgtgaaag

SEQ ID NO: 100790 - DNA, 645 bp, Oryza sativa
ttcgagctcggttcccctgtataccttggtctcagttgagtatccaagatgatcaaccaccatggaaaacattgacctacttaacatatggaaatcggcatggcatcgacgatgctacatctctggcaccatcaatcatcaccattggcatacatggtgtagaggaagcactataaggagcaccacaacaaaaaatacttcgtagagacatttttctaacactagaggcagttttaaaatgcctctagaatcctgtagaggaattttgagaatatcttcaacacacttaccatctccacctcatatcatttaagaaataaatcaatttatcaaaataaagcattttaattcacatcatttaatttacattttaaaaactttcaaaccttaccaaaaaagggccacttatactggacattaacttcaaaaaatctcctttaacattacttcaacccaaactttaaccatatctcccaaacaatttcaatacatattatacaacaccattcttacattaaatcaaaattttaaaaaatacctctacagaagttaaaacaccataacaaaattcctttacatattaaacaaatattaaaattcacaaaacattcctctacaacattaatttaacaaaatatactaaaa

SEQ ID NO: 100791 - DNA, 586 bp, Oryza sativa
tctaagtgaaatgaagtgcaactctcatgcgttttctaaaaagataatacagttatagcttgatatttaaaattgtggatggttattttcaatcacatggggggacaagtgctaaaacggtgtcactagtatacggatcactgccctgagcgccgatggcaataaataaattgtagaagcaacaattaagtaagtatcaaatagttaactgcatatttttgggtggcaaataattaattttatagttaatccacgcagagatatggtccactcattattcacaacaattaattttgttactttctgtcatctttgtgatggatttagaactcatcatacatgcattactggtaatttggaaagatctatttgaaaattttgatggttcaaagaatatatgcataaacttagccttagccttgcagcggccggctccaactttacgtagatggtgctctcatatagctcaaaataaaattgggaatacagaaaggcatagtctagcttttgaactcacattttcctgcaccacgtatctttattctaggaaattaataaggccagaataacaaaaagctggacagtt

SEQ ID NO: 100792 - DNA, 544 bp, Oryza sativa
tcactaggccaactgttctagctttgctagcatcttattatctgcagttgctatcagccagttccccctcgtgtccatgaacaaagctcaatcttcagatccacaccttactggtcctgcaatttagtcaggtgggagggattcaagacacaagcctctcacggtgcgaagaaagtgaaaaatgcaatatagccggagcagattgcagttgcaacaaccttggaaaaatatggggagttgaggactaagggaaggttagtaagtcttctatttctaagaaagtcaagtgtttaggagtttgaggatcaggatgatcaagctggaccaagttctaggaatagcaatcataagaaactgaaagatagcaattcgtatggtcatattatggagattgataaaccagtccaacagagcatctatctattatctatctatctatctatcttctattatatactaaaagtccattaaacttcctaaaaacgctcttaagccgccacgtggcacacctacaaacgggtaccgagctcgaattcgccctata

SEQ ID NO: 100793 - DNA, 762 bp, Oryza sativa
tttcagtatttttcatctccttgccccatagatttggaagttagcttttgatcaataataaactgagttttggaatatcacgttacagtagttgagaaaaaatacatataaaaccattcaactcatgcctctgcaacaggtaacaagcttgctctttgccattaaccttatcctattttgttcatcatgcataaatatgatcctgttttctatcaagcactatgatggtgttttatatgagatctcaaactctcaatgtactcaaagtaaagcattgctattattatattccttgcaaaaagttgctacagtatcatccagaattttagactgcagtctctgttgcctctgtttcccttcttttcttactatttttttaatcacataaagtgtacttgaatttttaaattttattttaatacaaatattccgcagcaacatgcgaggtatcctctagttgaatagacatgcactacctctattttataatttatattataagtcgttttgattttttttaaccaagttaataaaaaatatagcaatatattaaaaaaatatcaagttatgttccatgttaaatgtaatgaaactaattttgtattataagtgttgctatatttttctataaacttagttagttaaacttttaagaagtttgacttagagaaaaagaaaatcaaagcttgtaaaacagtcttaatcttaaactgagggggttattaagtatgtaaataggaaactccacgacaaataaataga

SEQ ID NO: 100794 - DNA, 521 bp, Oryza sativa
ggatgatatgctaatggttctctttgttgtggagagagaagtctggggttggagtcccaataccacatacacatataatttgtattaaaaatcatggatttgtggctaatgatgtgtaaagttaaaataataatttttaggcctttttgtgcatttataattagaaaaatcatgacatgttatcgtagatggttcataactattactcggaagagacgactagtctgcgatgggtggtatgtaatgatccaccataactttaccacccacgacacagatgactcatctgtggtagttgttcacggatgaggtttaattcgtcgcagatgtgcgttattacaacccatcatagatcaagggttctgtcgtaggatgtgatttcaatagcaatgtaatgaaatcagagatttaccactgcttttgtctcttcgaatgtgtgaacgtgtattaggagagcacatgcgggtgtgtgattttggtacacatgcataatgatgtctgcatttcttctatgtaatagg

SEQ ID NO: 100795 - DNA, 636 bp, Oryza sativa
aaaaattaaaaaaaattaccataccatagacaagcaaaacatctctttactttaaaaatcatagaagttttcgctgaaccgatattatagcacaatgttcaaatgaagctataacttccaaaatatattggaaagggatattacttcttcccatcacatcttaatgtaaccttaaactattattatatattagaatcaaaagtgaagcttcactttagattttgtggatctattgccaagtaatatgcattcagactagagttttaaagtggtaacattaaatagcccagcatgatatttattgaacctactcattaagaatgctataaacagtgaatattgctagcaaaaaacatacccagtttggcggatcttttttagccacttccttatctcattttccagcaactcttcctcattcatatctagcatttcagtagtttcttcaataataccaaatggcttctcagcttgtataataaatttagctccttcaagtttttctgatacgttagaagcaacttcatccgtccaaagtgaatgcacatactgaagaagctgcaaaaaaaaaagaacagttgtaataaatatgaaattactacaaataactaaattcttccgggtatgctataatct

SEQ ID NO: 100796 - DNA, 508 bp, Oryza sativa
ttactttgcagctacaaatctctaaaacaccaaggccaccattcatcctaggtttaaatggagcctatgttgaagttatttcttaatttctttctttgcatcatcagaatttttaacatagaccttatttgcaaaataactagttatacacatgtatgatgagcctcaatttcgatgaaaacagcatgctagaacatactgaatttaattaagagaaatgagaatggcatggaaggtgatatctaaatctagatccagagataacaacctcgctccatacacattacatctttgaaggctttcaaacctgcattcagctatgctatctatcaagacatacgtacttgtaatatgaaaataaattcgatagaatctcagctatagtttgcacgtatatacctatatgtatgcatgtcacaataatattctttgtttccttcctattttttccattaaagacatcctaatagtgaatgcagacaagcagttccaaatagattagtggcta

SEQ ID NO: 100797 - DNA, 1637 bp, Oryza sativa
tgagccatctttcagaagagctcgggaaagaatcagtaaagtaagtaacactcccttacagaagtagtgtaagtattttttttagcactgtatccaagttgatatggaacaacggtacaggtatgaagatttggtgtgggaacctggattgtgggaatcaagcactaaagtgcaattggttagagatgtttattggtgctacaacaaaaacaagaacagaatatctacacttaagaacaaaacagcccttggactcaaaagctttattgacaagttggaggtgaacaagtctagagcaccagacaaacaaatcaatgacgacaacttgtatgagtctctgttttttcttagagtttacatggttgcccacaaagacgatactattaaaggttacagtggcacaatggtgagctagctgttgttgaaattttgttgattttgcaattaatttgaattagtatgaaattgtgcattaaaaggacttacaatatgttttatgtctgaactctaaagtacaaatacttatatcctgatgagctttatgttctactttcttttcttttttacaatttgccatacattgtgtcatacaggaaatgatgcatgacaagaaagccattgtaaggttgcttatgatagaacgccctgaatacatggtgacactcatttcagcaatacggaagttaggctggattaggcaatctccattttgcgcagtaagaaatctgaaaatattttttactgtgttacttgttcaacctagtacttattatattatattcatgcgtgcagtggataaccagtacatgatagagttttacaccccaaatcctgcaaagtgcttggtatgcatacaatttcttcttatactcttatcaagctgattctttagcttatgctcctaaaaaaatcattccctttctttactctcatctaattatctaacaaaatttgatctccattcttgcagctatctcttagaaggattgggatcccatgcagtttgaacagggactgcaagtttagcagtcttaggtattcactaccatcagatcaaaggtttcaatggcccggatttagtagcagtactgtttgttagcacttgctacagtatgtgctacaggattcatctgctacagtacctgatgaacagtatttttgtgtgatctgagtccttgttatttgatccaacaatgattgtatgacttgctgaggaaaaaaaattggtagatggcaaagtttcaacatgcatcttgcagtagctacatggaggttgtacttcttagttactccctccgtttcataatgtaatactgtccacattcatatagatgttaataaatataaacacatatatatctagattcaataatatgtatatgaactggacaatgctagaaagtcttacattatgaaacggaggaagtacatattttacaccaaaggaacacctgcggcagctgattgggtgttggtaccaggatatttggcgccgaggcgctgtgctccttctcaaacttgtagcgtgtgttccatctcattgaccattttaagaagctcttttgattagagactgttttcacatgtgcaacttgacgatggagtattggagtagcatgcttggctttaagggttgg

SEQ ID NO: 100798 - DNA, 529 bp, Oryza sativa
aattcgagctcggtaccctaacccaacacagtgtaattggttttcttttccatcaacaggttggttattaacgcgaggttagaatatagttcctctgacacgagaccctaggtctcctttgtcagtaaacaattatacacatgatcacatatccgcatcttccaaaagaatcctcttagaacttgtctgtattacacatttctcccttattatacgaatacaaggccctgcctaaacaaaaagggaaggtgcttaacatcggtacattgtaccctcaataggaatcatccataaacatagcaagctcactgtttatagacatcaatatgtttatttattatatgatcgctgcaaactttcgattacagtgataagtagcgaactgaaaaccacaagcgtagctgctcattttgtttctggagagatatagctggcattgttctagtgactgcatcatccttgattggttctgtgatgatgtgataggactgcatattgctatcattcataggagaagcttccttctgat

SEQ ID NO: 100799 - DNA, 601 bp, Oryza sativa
ccaaagatgatttgccaaaagaggggtaatgagaggtacttatggggggtcctaatagcgtttggaaggagattagaggtgtgtttttgtgttttgccagggctactttgggttgctccttgcatcatttggttatccttgcatgcaccttttgttgtgccaaattatttttcaatatctttggcacattctctgccttatcttgttagctagtgtctagtgatgcatgcctcctgcagttgtcagcagcttcagagtatgtgtgttatgtgtatgaaaccctaaaccctccaatcatgatccaggatagaaaaaaatcttaatttgctgatgtctagctctactgtgcatcaaattgacccagaaaatgttgtatgctaggactaataaatttccacttctttcaaaaggaggactgaattatgtgttaggactaaatttgtagaattgtgccaaccaataaagattgttgtctttcagcatatactataataagcaaattgtgttatttgtcaattcaaatggagatatcattttcattcagaaattttgcttatccgtagttttttagcatactataataagcataacaatattgcct

SEQ ID NO: 100800 - DNA, 599 bp, Oryza sativa
ggtctgacaccgcctaccatattttggaaccggaattaaagatcaaaacgtacccctggccttttgaaccaggactaaagatattctttagtccttgttcctactcaaactgggattaatatagtttttggtcaactcagcaaagatggttttttcagtagtgtacctatagcctatctgcagtagtgaggtgttagctctgttataagacatgcaactgaagtgactcatgcattgatcatgaattacaatgagacacgatttatagcttgtatttaataaaactatataatttgtctgaagcgagtttagggaaaaaaaagtttactcccaacaaaattgatgccctgctttagttagctactagcgtatatacatacatggaaagtctatcagcccgttttaaatctttggaactttttacacacgatcaacaccatatatattcaacaactgcagaaaaggacacgactactgcagaaaaggacactacagcgagaatgctagctggatagtgctaaagagagacaccattctttccaaaaaaaaaaaactactagtacactcaatatctatgtatttttttccttcttagagaa

SEQ ID NO: 100801 - DNA, 540 bp, Oryza sativa
tcctttggatgttccagcacagcagccaagaaatcaagtacaagatgaagaacccgagcataagaaagttattgtcagttacaactgcagtacctgttaaagaagcggacatgccaatcgccaagtggtcactggagcaaatgcagtacctgttaagcctagcactagtcagaagcaaccataatactcttatatcagtgttcaaatacttttgttttatagttgttccccatcaatcatgtaataacagagaaacatgagataatgaatgagtttgataagtttattgagggatccatgttaagattgcaagtgctgggagttgtgtacattttgttgttgattagggagacctagggtctcatttctgtaaactcataatctattataaatcaaataacctagcgattgatggcgaagaaaatcaagtgatcaaccaaagagacatttgtttggactgagagtttcagatgtgtcttcttcggatcagaggcatgcacccgttgtggagaaactggacacgttgctggcatgtgtctc

SEQ ID NO: 100802 - DNA, 675 bp, Oryza sativa
gatccccgtgagtgttttcgtaaaacgagtggtattaacgtatgattaattaagttttaattattacaaatttaataaatatatttatctgatattttagagtcacttttatatagaaagttttcgcacgggacacatcgtttagcaatttaaaagcgtgtcacaaatatccaaattttcatccaattttgttggagattgatggaggcattcactttattagcgatcaatatgcatatcttaaatttctgaaaattgacgataaatctgaaatttgagtacaaagtgagtgggttgcacaaggccagcatcgggaataaacggttcctactgtttgccacatgaataagaatcaacacaagtttgactgctcttttcgaaaagaaattaatcagatacgagaaaacgtacctgttaatgaacaatatatctttcaattaattttgttactctgtggctcacatgtagtcatgaaaagcaagatatatataatataatatgtacattatattcccgacgtcaataaagcaagagaatgtattgtacgacgaggatcttctgatggtcaaacatgccctgcatctgcaactcagattacattctgttagtacatctcagaagcatctctcctttgacaacttgcaataagcatgtccaggttcagtgtattatata

SEQ ID NO: 100803 - DNA, 569 bp, Oryza sativa
atcaaggttattacgcattccaaaagtaattaacttttcatcaactaattaataacacatactacaaattaattacattactaaactaactacattaattataattaactactatactactcctgacatagtctcttcgctagtagctcgcctcccgaaggcgcgctggccaccatgcgggctgccatgcctaccacatgctcctctatgtgcctcccgtcacatcctcctctgtgccagtcacatctcctgccacttttttccttgttgttgatgtcctcctcctcatcagagtacaatggcactattgacctatcatcgaaaaaacgctcatcattggtgtttcatagttcttcctcagtggaagcgctagcagggggaggaagtagtccgacaatagctcagggagctcctcttcctcatcagtggtgttgtaacaaagttggtgcggcaagtccatcatggtcgaaggcatgcgagaaagaagaagagaagagtgcgatgagaaaaacccacccatattgccctctatttactgaatatgaggagaggggaggtgaggaggtgga

SEQ ID NO: 100804 - DNA, 540 bp, Oryza sativa
caccatcgtgtgtatatattgaccaactgagcaatactagtagtcgccttattttgctgatgtgtcaatatatatgatgttggctgataatataagaaaaaataattcgtagtaaacataacggtacatatcgctatttgatgcttctttttggtgttcgatctacgagtaatccaatatttaacatacacacaaaaataacggggccacctgcaaatcgtgtgcctaattttttggcaaaaatcaggcgctattccaccaaatagatcagaaatgtttcactaagtagatcaaaaatgtttcaatcatttaaaaagctgaaacacaaccaaatcacctcatgaaatatttttctacaacgtatgaaacaacgtttccaaaaaatcgtacgctgtttcaccctatataaaaataatattttaacaatagcgaagaatgtttcaattcttaaaaaaagtggaacatggtcagatcgctagatgaacatttggttaaacgtatgcaacaaatgatttaaatccattgcaacacttaaatccc

SEQ ID NO: 100805 - DNA, 586 bp, Oryza sativa
catgcaacaacgaagaaactatattccaagcacaagttcgtccctacttgactcacattagtataacaacagtatccatacgcatagaaaccatctagaagccaaatccccaaaggaaacatgtaaatacaacaagacaacccgaaaccgaacacgataagaatcctgccggtcagaccatcaggtcggctggtctgaccgctgcaacacctgcagtctggccggcggcacccggctggtctgaccgccagggtcaaccaaaaaccttcacttcacaaaatcaaccgtctacaaaatctccaaaataacatcagcaaaccaccaaaattttcaccgcaaaatctaaatcaactcattggttttacatgttataaagatgtgcttagcctaacatcatcaccttaatataatgtgaaagagaagattaaactgactaacattgtttaaatctatggatgcgacctccttctccttctctgcttcttttggtgtcgatgtagatatatgagtcatgagtatgagatttcttgcttgatcccctaggcaatgctagcgatcgacaagtgggtgatggtttcactctgag

SEQ ID NO: 100806 - DNA, 936 bp, Oryza sativa
taatccaaaagaaaacatataagaaatctatttaaaaaaacaaactcgcatgctaacttgagacgatcggactcctaactgcaacttatgattttctaaaaatatatatatccaagcgaactcccgtaatgaattttatcttcactaaatcatataacaataatgggattaatatagacttcacccgttataacgcacgggcattttttctagttttatagtaggtaaagatttagactaaaagtgtcccagcgttgcaacacgaagaaaattgaggaaaagttaaaaaatatttatattatataattaatcaaaaatacaaattttactatcttctttatataaagaatatatatatatatatatatatatatatatgtgtgtgtgtgtagaactactatatggcgttacaggcgccacatattacatggcgcctaacacagccgcaccaccactctgtcccatcttcccccacccaccacatatttgagttaaaatttaactcacgacaccccacacctatgccctcccccacgcccataatccaagttaaattttaacttggtgttactcaacttttagtgtatatatataccagtgttgtacatccaccccgtaaccaatcacatatccagatcctattttttcgaagatgagagcggcgagcgggcgtggcggctggcggtgccggcattgggcggatccggcacggcacgactggcggcgcgacgtcgagcgccacctccactgccgagcggcggcgggcgcgacgtcggcggatccggtacggcacggctgcaggcgtggaggtgacggttgacggcgtgtaggaggcgacgaggcggcgcacccggccgccgatctgcgccccacgcgcgaggatccggccatggtagggcgtatctggcgcgatgacggatccggggataatcctgc

SEQ ID NO: 100807 - DNA, 1606 bp, Oryza sativa
ccgctccacgccccacgcacacggcggcgacctccgcggcggcgagttcgaacaccgaaggacatggaggagcagcggcaaacacctccatggcgctccgccgttgatgtccggagcaagtgccgacaaaaatttaacttacgcttatagattgtgaggatgtatttgttgagttaaaatctcgttgtacacaagttaaaatttaactcatacaaactgaattaactctacaacgatgtcctgtagttttgtatcgcgagataatttttaactcagcagcgaccagacttaatcacatatcatctagaattgaacaacaacaagtaattttttaactccaaaaccatgtcatcgcatcccaccacccaattgtacgtaagttaaactttaactcatatcaattgaaaccatgtataatattaactcctcaacgacgtcatcgcacccaccacctaactgtatataagttaaaatttaacttcgctggttttaccccaccacccaactgtatctaagttaaattttaactccgcgggtgggttggatgccttgttggtgggattttgtcggtggtgggctgacctctcctcgtttgtgtctggcgccattttgtttcgtggcgcacaacgtctgtgggtggcgctgtgtagcgccaccgtgtatatatatatatatatatatatatagagagagagagagagagagaaactattctacacccgggttacccccctccttcccaagggttacacccacttccccctccttaccaaggcccaagaaccacctcccacctcggtcaaaggcccctcccaccggtcaaacccgcctaataactcccccaccacccacctcttctcagctctcgtcctaggacggtgcagtaacacgacgaccactgtgcagtaacgttgtgtcttacgtgcagtaacagtgttaaaatatagttgaaatatagttatgacggatctacttttgataagctctttttttctagcatcatggtgcaaacggttttaaaaaaacttacatcacttgggagatattgttatttaaagcttgacttttttgcaatttgtctctccacaagtagtaatactatactattatttgttactacttgtctgttgtacgttactataatcacatcacgatgttactacactgcattttactgtattttttgggtagtgttactgcataacacgtggtaacgtgtaccttccatgcagtaacacttttacttttgtgcagtaacagcatctgagacttttaacctataaatttttgtttcaattattgatttactgtaattcaccataatattattgtcacatcttacacatgcagtagcactatattggtgggaggagaccctttttcttgagaagagggaggaagaacggtttcttgaagagaggggtacgtagatgcattttgaagtttaaccctctacatgcagtaacactatagcatcatggtgggaacgattttaaaaaataacatttatcttgtgagatattgcttttcaaagattggaactttgaactttaaccctccacatgcagtaacagaatgtgtaacttgcagtaacaagggcatatac

SEQ ID NO: 100808 - DNA, 548 bp, Oryza sativa
ttgtagtgtgtccaactgtcatctcatcacctgtagtcctccatatctaattgcaaagaatgtgacgtgatgttaggatacacatgtatgtatttaagctagattaaaggtcaatgacatgtcaagcaggaaggatttgcacagcgaaggcacatttcaataccatatcacgctctgcctaacatctagcccaacaaaggtaggagtatgaaacactatgtatgactttactgcagagtaatattatagcatctatatgtgaatcaaaactagtagcatatattcattggcagcatttctgaacagtgaggagtccgtttccaaatataagcatttctagattgtttagcaggaataaaggtttgagaaatgcttatattgcatacaaaatatgaatcctagaatgcttatatttgggaatgtaacgattagctagtaggaatctaggcagggatcggaattttagatgaaaataaaatgagaactgagcaggaaactgtatatgccttgtttcctggtagaccatgctacatgatttcttagtttcg

SEQ ID NO: 100809 - DNA, 1411 bp, Oryza sativa
taggccaaggaactcattaactcaactcaagcatttttttttattttagggatcagcacagaaaggtgacgcaatggaaacactgcagaaatatttgaagattggctgtcaaagcaaatgatagtggctcgttataaatacacatcttctgatgaacttcaagacatggtgtggatctgggaggtatttcttcttgttcttctatttttggttttctaccttgatgctcatgattttgaatgaattttttccttacttgaccaatatatatatatatatatatatatattctccaatcagattgaagaagaatttatagcttatcttcatacctatgttgatatgttgcacaaagtggatgaaattggtgatacaatggaggtaattatttatacgtaaaaaatgttctttcaattaaagaaatgcataagtgagttgtggttataatgttggcacagtggcacatgtgtaattttttttgacctggtacacatgtatttgagttgggaaactgatacttgttgccccgcattactttaaatcttttgtaagagttaagagttgctaattccaaactttagcacacacataacctagatagatctgtacagctcccaatcctatatatgattcagaatttaatgtgttttatcattgttatatatgttttgtttgtttgtttagtcaggttatcatttgaactaatccatacatgcgtactgtcagggccgtccctagggttccgaggccccggtgcgaaatacaaattagagccttaaaatttaaaaaaggatatcttgcacgcttgctgcgagattttataactcttttattacgaaattgctactatatgaaattgctgattgattatagtgttgctgccatgttgcttctgcgaacaacggagagtggacgaacttcacactttagaaatcagtaattgttattaggaaaaaaagaggagttggcaaagttgtagctgataacaaaacaaagtatcaaatagtataagcattagggatgggattaggccttgtattcttttggggcttatttttttatctgtttccctgtaatttgttgctaattaggcatagataaataatactaattgtggatttgggggtcctattttttttggggggcctgaacatatgcacaggttgcacctgtcaatatacggcactgcgtactgtgataaaagatgctagcatcagaaaataagatactccaatggtttgaattattcattttcttaatgttcaaaccactgtgttgcacaaaagccactgcattgcactaattttgaaaataaactaatcatagttcacttgcgcattagaaatttaatttatgcacatgttttctctatgtctgaaaataaactaatcatagttcacttccgcattag

SEQ ID NO: 100810 - DNA, 1661 bp, Oryza sativa
tttataaaaacttacatcacttggaacatattgttattaaaagcttgacttttttgctatatgtctctccacaagtagtaatactatactattatttgttactactgtctgtttgtacgttactataatcacatcacgatgttactacactgcattttactgtattttttgggtagtgttactgcataacacgtggtaacgtgtaccttccatgcagtaacacttttacttttgtgcagtaacagcatctgagacttttaacctataaatttttgtttcaattattgatttactgtaattcaccataatattattgtcacatcttacacatgcagtagcactatattggtgggaggagaccctttttcttgagaagagggaggaagaacggtttcttgaagagaggggtacgtagatgcattttgaagtttaaccctctacatgcagtaacactatagcatcatggtgggaacgattttaaaaaataacatttatcttgtgagatattgcttttcaaagattggaactttgaactttaaccctccacatgcagtaacagaatgtgtaacttgcagtaacaagggcatatacatgtagtaacatggttttaccaaatgtataaaattattcaaaacactcctatatcaatcagacctcgctcaaagtgacctacagacattacctatagcccacctatttaatcttcatctcgtaaaaatgacagtaaaactacaattatcgtgcagtaacatagctactttaaagtggtaacatgcacctaccatgtagtaacacttctacttttgtgcagtaacaagtatatggttagcatgtgaggctttaactcagtaatactagtcacttgaatgtaataacaacctatatatttttgtagtaaccggacgtgctactatatttcgtgatggcgttactatgaaaagggtgggggtacatagatggaggaaggagaccgattttcttgaaaagagagaggaaggccaagtttttgggtagagagagataaggagaggagaaagtggagggatcatgagagggagagagagaccaggattatatctattttgttactacacactagttacattattactatatttatttcacaatgttactacggggttgcagtaacatatagtacaaagcagtaacgagcgggagtaaatactaaagtttagaaattgttagttctacaaacaataatcaatagcgtggtggtgaccactgctcatgaaaattaaatgatggcatatcatgttacaataggaatctataattctgatggtaatattactatatctgtgtaataaaagatttgggatagtgcagtaagatggtttgaagtgtatgctaacaaccatcctaggaccattactacatgttttgtgccaaatattacaggatttagcacgtatgagaagataaaattttactaagaaaactctatcacaactgagaaatagcctattggttagtgccatatggtaatttgagttgaaggtcttgagttctattctcattgaatgcaaaatttcctttatttttttctctctcaaaaaaagagagaggtggagggggatggggagaaaaaaaaggaaagggggagtgaccgggagaaggtggggtgggggaatcgggaggaa

SEQ ID NO: 100811 - DNA, 537 bp, Oryza sativa
catgcgtgtggaacacaacatcgatcttaaatctacttatctccttccttggtagctatttacatacttatccaacaaactaaccacctactcatttcagattcctttcaggacattaatttgtaccaattgtaaatgtgggcaagctgttagatttgcctcatgtttcaagtgttttgattcagacgaattgttagatgttgggtctcattggctctattagttaattgcactataatgcatactccatcatttacaaccagtatgcatctcgctaacttttggtcactaacaccataacaattcactaattgtgcactatttttgtgtgttagtttctcattgcttttgattaatggggtgggcattgctgaaatacccactcccaacttagctacctaagcttatatgactttatgtttcaataagcctttttatgctataaacctattaataataatattgttgtgctataaaacctgataagcttgtggtataataataatggtgtgataaaacatttttatgctctctttg

SEQ ID NO: 100812 - DNA, 581 bp, Oryza sativa
aaatcacaacttaggtgaatgtctcttcatccataacctcatccatcaagtcgccacatgaaaggttaagcaaagaactatcctcccgatcctcctcatgaactaagtctgagttactacaagaccccaccatgattttctaccaaaagagaagccaaagcacctaagttttcaaatttgagacaaccaccctcccttaagagcaaaaccaaatcagaaactaagttactagagtcacctaggttcaaacctatatcatttaaatttctaacaacatgaggatgcgagaaagaatgacatgaattcttaaattcattacctgagagagggtcgagattcatccatgcctttttggacttagccttttcaagtgaatgtctcccgctgctgcccatcaacctctcgctagccctttttggtgtcaccaccacctccccaacattagccagctgaacaatcttttcctgctgcacccccgcctcattttcctccatttcctccctctctaccctctcatacacctcctccaacacatcttagacagccacatccaagatattttcagccattatagaaaaatc

SEQ ID NO: 100813 - DNA, 577 bp, Oryza sativa
ctgacactatccagctagaagaagcacgtgtgttaaggctttccttagccaaacggtgtgccactttatttgccgatctcctcgttcatatgagcttgaaatcctggaatgactggattcccctcttcagctcctggattacaggcccaatttcaaaccgatcaaaacttttattcatgaccaaactcacaacttcaactgagtccgtttcgaagactactctggttgctgcaagtcttgcacccacccgcgtcgcttcgaggcaagccaacgcttcagcatgagttgcacttaacacttccccgaagaaaatcctgttcgcacccataaactcaccccgatcatttctcactatcactcccccacttcccatctgttcatctgcagcaaatcccccatccgatttcagcttaatccatcctgattccggcaacctccagtgcattgtcggactaggacagtatgatcagatttttcaaatagactagcccactcttccagaggaacaaaattctctccaccgtcctgtctgggttatctgggatctgttgatccgtgcatcattccgtgctgacca

SEQ ID NO: 100814 - DNA, 583 bp, Oryza sativa
tctaacattcaatggattatccgtaaagttgtgtcaggatcctgatacatgggtgtctgataatccctccattgtgctccagcagatgccatgctcatatggtaagtcttaattttctagtttaagtacctaaccattaatttccatattctaaatgttcatatagttgtgtcaaattactaacatttgtaatgatggcctaacttaatctgtcatatttttagtggatttccaaaggtgttctaggaagtcgtgtcaaattactgacattgcaacaatgatggatcaacttaattagattatattatatttttttatggattctaaaaggtgttctctagcaagtatagccacatgccatatttaaaaataaaatactactttcgtttatatttttaaaacttaattatctgtcttatttaaagtttatttccccagattatttaatctgcagtgcttttctcatacagtttgaaattaattaaagtacttatggctaaaatccgaaactttgcgcacaatcacatcatgtgataattccttgtttgttaagcttgtgcatatagatgcatgttgtgtccat

SEQ ID NO: 100815 - DNA, 552 bp, Oryza sativa
atctccttcacggttttcatagcggcccatacagatgcaattatctagtgagttggcgacaccccctctatagcttggttttataaatgcagctcctctcatcctccatctccatcaccacagggcttccgctcactagagtgagcgagcgagtgaaatctgtttgtagcttgcgagctaggacaatggccggtcctcaggtatgcatcaactaagtgagcagtacgagtattcaccatcccactaggtgtgtgttccaacccactacggtgagcttgtcatcaactacctttaccaatgcgccattcagatgtctctgccctatgacttcatcactgacatcgacatccttcaccataatcccttggacattgtcccaagtgaatatattttgacttgtgttgcctttgttgtcccattgaaattattaagccaaatctttgcaatctttggtttaatttcatcaatctatagcctcacctatgatatattaggtgttttgacggttaatttcttgtctaattctgtgtgtgtcatattttccttatgttg

SEQ ID NO: 100816 - DNA, 561 bp, Oryza sativa
aggtcaccgcccactactatggcccacagattatgcaacagagatgaagtatctggatttttgtgctggaatcattttttgagggacaaagtctccgctccaggaatcacttctttttgggacggaaggagtatgtatctaacacaagtactcactaaaagattacaaatgggacacccaaaatcaatttttaatgtagaaaactgacagaaaaacaaacactaatatgggaaaaaaagactaacttgtgcagaatagtgggatggcttacaaaactatgaaaatacaaagccaaagaattgaagacaaaatataaagctaataaaacttgcagtaccatgattagtagacagaactttatttaaatttaatttgaattggcaaacgaaactaacaaaattgacaaaatttcagaaatcgtcaaccattgctaatcttgttcaactttatctcaaaactgaaaactgtcaaaactaagtattgttcactcaaaattttgtgatgaggcattctaattactgacaaaactaacaaaaccatatgtactattaatagattaca

SEQ ID NO: 100817 - DNA, 505 bp, Oryza sativa
atgagaagctagcatacgcatgccatggcgagcccgtgtcagattgcattgagggagaagatgaagcctcggcagcccacactgcttcatcttctcacccgccactgcgccacccctccatgctgaccgccgccgcccctgccaccctaccggcgccagcgtgctcgtcgcaacggcggcaaggtttggagatggctatgagcttgtcgcagcgccatcgccattttttcttttttttttcctctctatattttttcaggagctaattggttccttgctgtagtttggggagaagatgacggaaagtgtgacagcgatggtatgggtccaaatttacaaaattggagtggcacccaaccgatatcgtgaataataatgatatttttctaatttaacatatttgcaatggcatacatcacattaacccttacttagttgatcgtggcccaaatcaacagcccaagactaaagcatgcatacagcatactccctatgcagtgcagtc

SEQ ID NO: 100818 - DNA, 526 bp, Oryza sativa
agggggaagccggcgtcggattggaggcggcgccgactcaagggggaggaggcggcgcgcgcgcggtgagatcggccagacttgcaccgtaggattggatccaaacctgtccaaattgcgcatttggtgtcttttttttttctttttgtttgggctaacctttattattctctttttttattattattattttgtatttttcaggttataagacctggatttttcacattttggtccttttgaaaaacttatttcgtaaatagacccctagaaaaacttatcccaaaaatggtcctttttggggcgccagagtggctggcgctgtcgttcgcgccatccccctgccgacgtggcagggcgatgctgaggtggctagggggagtgcgccatagtggtagagtgcattatgtttaacatgctgatcaaagggttttactaaaggagttatggtctaattttagtgaaggtgtaaagtagactaagtggtatgctagatattttcagacttagctaattggtagttcga

SEQ ID NO: 100819 - DNA, 517 bp, Oryza sativa
gcattgtcctattgagtattcaccactgcactgcttgattggattccgtcagcccgttgtgtgtaccttcttgcctctgggatctgtgagccctcattgcttgataatgcaaagcctgcaatcgctgcaactccctttgtaacccttcatattgttctctgttcaccgatacaaccccttgtgcttgcaccattttttgctagttctactttcgtcggagctgatgttcttgccgtgccttgacttcctcaatgattgtttcaacttgagtttctctcatttcagttcttccagtatcgggatctgcttatgtactattcatttatgctacctaccgcgcttgagaatgtatctgtatatcttgctggtactgtcttcgctcgttgtggacgttgcatttaccttttcaagctcgcctctgggagactttacgtccccatagacggcgccactgtcgtgaccttagggcacggacaaagttgggggatagacgagaaaaaagtaaattcccactgtc

SEQ ID NO: 100820 - DNA, 600 bp, Oryza sativa
cggattctattaaatgtcaaatttgtcggggatgcaaaaagggctatgttgtcagtttgtgttttaattaataaattctttgctgaacactatgcatgcttgtccccttagtctcggtaagggatgtttagatcatgatttgatcttgtactcctggtcgctacttttccttaaaaaagtggcatcactacagttattggtgaatcgaatgggggtgacactcctttgcccatattaggtactccctccatttcaagttataagatgttttgactttggtcaaagtcaaactattacaagtttgactaagtttttaaaaaatatagtaatatttataataccaaattagtttcattaaatcaataattgaatatattttcataataaatttgtcttgggttgaaaatgtttttttttcaaacttagtcaaacttaaagcaagttaattttgaccaaagtcaaaacatcttatgacctgaaacggagggagtagaaaattggacatagagaagttaccaaattcttctaattcagtcagtacatgagtagcacaaaactggcatgcaactattttttactactagtacacttcatccgtct

SEQ ID NO: 100821 - DNA, 1435 bp, Oryza sativa
tgccgcgtggtgctctaataaattagggcaaatattagaaattctaagaaaaaaaataaaattatctattacttaattttcacttaaatcggtaggtccaatattataaaccgttagattaaattgatcttagaacaaactaaatattatggggtcccacctcagcataggtgcgcacctacgtgcgcgggttcgtacgcatcccctccctttttttcatttttctctttcttcttttttcccatgcatatgcttccctccctttattactatatcacacgccttcatgagatgatttaatcaaaagagttttgaatatcttgcactcgcatttttcatttgcggccatactacacggtatgtatatagatagactgtatgataattaactaccaatagtttcttatttactcgagaaaaaaacatgatttaaaagttgtaagtactaaacccatctcctactcaaaagttcgtgaatggttttctaagataccttaagaaaaatagaacccttaaattattataaaataaaattatccaaactttagtttgccctaaatctatgagacaaaatttttgaacaaacaataatcttaccttttaataatataagtgcccgcgcatacgcgcgggccaccttcctagtttctttaatttttttttctccctcattgtcatacacaggtaaaacttcttcagtttaaggaaacaaacgatgctttctgctccgcactgtctcgctttcaaagtttcagcaaaatctgccaaatctactacagtacctttttgtgattcccctgcatcctagagtctgtacttgcactaatgggaaagaaatttgtgcttttattcgtggtgaacgagtaaactaaggctgtgttggctcaggcgtgttcctaaccagaacggtgcacacagaaaatagaacgatccattagcgtatgaataattaagtattagctaattcccttttcaaaaatggatcaatatgatttttttaaacaactttcgtatagaaactttttacaaaaaatacaccgtttagcgatttgaaaatcatgcgcacaaaaaacgagggagatgagttggaaaacctatggtaaagaacatagcctaagaccattcacagggcattttgccggacttcgtatgccatatagacccaaaaacaccaaaacacaatgttagccacaggttttcacggtgctatatagtctcaagtagggtctatataaataaaaaaagtttctcagtttacttttccccatactctccccatcaactgacgctttctttccccctctctctcctcaacacgaagccagcggagctcggggtcgaggagacaaccgtagtcggcgcagatcggaggacgacgatgggctccgcagcggcgggccaagcggcgacggcgacggccgtgggcggggagcca

SEQ ID NO: 100822 - DNA, 626 bp, Oryza sativa
ccattctgcgtagttatctccttttagggtcggaatatctttaatgcaacccatcaaggagtacccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaactgaggtaaaacatgcaaaaatctattcaaaattctattgaaatttgcatgaaaaattgacaaaataaaatggaaaaattgctactgttctcttttattcattttcggccccggagggaccttatatggactttttccggcctttgccggtcggcccatggccaccttgcgcgcgggcgagcgccccctcccctcccccaggccgcaacctgggcctgggccgggaa

SEQ ID NO: 100823 - DNA, 897 bp, Oryza sativa
ctcagctccagtccccaggcctccttacggagctcctccaccaaactatatgaatccacagacgagcatttggcatatctagcaaggcagctaatttgtggcgataagcgaacactggacatggtaccaagaaaagtagtttaagtagatatgcgcgagtgcgtgacctataagttccagggaacctttggcagttcggctcgcagatttttgtatagttatatgcacgcataaaccattctccgtatgtatccagtttacgacttttgcatgatcaattagtattggtttggccaacgcagagtgttatgtcgtgaacaactttcggacgctcggtcaggtacgcctgaatcatgaaaacgtatattctagtctctgaagaacacctactattgatgatgagaatcccttgtgcccgcatgaatgtcatgttgccaatgtacaaactgacatccagcatttagcagctacaagcacgtaaatccatgaggctaaggaatgtacaaatcacgcgagttggcgttccagtagttcattggaaacttaatttgccaggcagacttagactaacaagaggtcatctcctcctaacagctccgtagttcctagtgacctgcagagtaacacaaagtcgtaaaaccaacagtttgtaggtcgtattctaaaaaaaaaacagtttgtaggtcgtaaaaccaacggtttgtagtatcagtgcgtgtacacaacacaatgcaaacaatttaatgacaaaccacaagaagacccgtcaaactgacaaaatgtcaaggtgattcacttacccgaggtggaggtttcttcggcctgtcatcttcatcatcgtcatcatcatctttgctcatcagcatgctctggatggatgaaaaatctgtttttcaa

SEQ ID NO: 100824 - DNA, 780 bp, Oryza sativa
tagatctgttacagctcaaagtaacctgaactctttcagtgatgatgaagacaccagggagatgcttctcggtgcaagaacaactaatgctggaaggaaagcatctggatttacaagaccctctaaagatgctaccgatgttgccaaaactggaacttccagaaggggcaggggaagagggacggcctcaatgaagcagaccactctgaatttcagccaatcaaggttattaaattaattgctaccttgcatttataccataactgtgcaacctatgccaaaatggaatagccatggtacagtctaatttgcattttgagtgttaaaggtgtttgaaatcgtgtgccctggttttaactctgcagtagatgctccaatgctaattttaccatccaatattttgcaggtcaagtgctgctatccgcagtgaggaagtgcaatcttcttcagatgaggaaaatgagactaatgaagcaaacgaagttgttgaatcttcagtatgatcatttcctctatttgtagttctgtactttttctgtattaatacgcataaatataatgtgcgcttttgctcgtggcaaatgacctggtgaactgaaacattgtatattcttgaatactcacaggaaccggaggagagtccccaacaaactggacggaaaagggcagctcctagaggtggtagaggtaggggtagaggcgctactgcaaaaaggggtagaaaagcagatatttcatccatccagagcatgctgatgagcaaagatgatgatgacgatg

SEQ ID NO: 100825 - DNA, 1472 bp, Oryza sativa
acgtgcgacatgcaacggagttccggcgtcggagatcgatggcggggcaacggcgaaggagatcggcgacggagcgtgagagtagggggtggtaggcgcgaggagacgtcggcggcggggtaggtttcgcggctgccgccggcggagaaggcggggccgacgacagcgacggcaatggggtaggcgtgaggaggcgtcggcgctggtggagaaggcggcgggcgacggcggtggggtaggcgcaaggaggcggactggcggaggcggcagggtaggggagtgggagatggatcactaataacttcttcttttttctttttgtttgatgatcgctaattaatttttgtaaccgctacttacacgacgtggaatcgctaattgtagaggttgatccaactcttgatctgagccattggatgaatagatctaaaggtcagaaaatatttgggtttgatgaactggtgctttttatattagtgtagactagtgaaagctacagaagtttgcatgtggattgaaaattttcgactcgagggtgatcagttcgtgaaattttgagttaagtatgaacaaaatttgaagttgaaatcttggtggactggaaggggagaagtttcagcatgctgcagtgctggatatatttagaagaggctgaagtgctgaaccccattacaacttgtttgctgcatttgccttctgaacgcgagtgcaaatatgtgcagcgctatcggaagtagaatagaggcagcgtaagcacatgtcagaactgcgatcgtctgaaaagacaacgtaaatactagtagtactaattacacgaaaacagcccaaatcaaaagtacggtaaaaatcgtccaagaatttctgaaactacaaatgaaaatctcacacagtttgaatattacaatgaatatatttagacaacagtacaacacagttgaaaaataccacatactcacaaaggaatgctaaatcttgtacatacagcaaagaatgcaatcatctcacaagaacagagccccaaagagtgaccacgaagatcaggctgaagaggcaaaccaagagcatcgtcctgcccactgctcgccggtttgccagatcacctgccacccaaaacccgacagaagcctctacaaacccgacgagcaccacggtgacaaggcttccgtagtacagccagtggagtgccttaccatggttgccgaagactccgctcggagcgatgaagaagacgagggagagtgcagccgcggcttggaggacgccgcacgagataagcgccccgggaagcttgttgtcgtcgaggcaggcgtccgcgatcgcctgcaggatcttggcgaggaactcaggcagatccatgtttttgtgtagctccgatcctgcgaatgtatcgaacgattcgcggattcggagaaatgctctgttttttgagtggtgtttcagagagatgctctgtttgtgcttcgtgtaatggc

SEQ ID NO: 100826 - DNA, 829 bp, Oryza sativa
tggatccccctttttttatagatttccctatggactctgtcttttctttttctccgattaatgtgagaatttctaggtcatgagagcgaacgtggaggctcctttttctattcctttaattatataatagatactactgtaatagacaacttgcgttcctcttttatacatagatagtactcactccttctaaaaatctgaaaatctgagacctatttctttctctgggttttccaaaaatctaagtcctatttgtagtcactatgtgctaaattaaattgtggatcggaaaccaagaagccattctactacttattgattgcatgttcattggttttgccatatggtgagtgagttaattgcttcttgatattgatgaaaaagaaataggtcttaaatttttttgatggagggagtataagaaaagggtaattttaccgtccttgaaaaagtgcgggaagatactatactttctagggtaaaatttagtaccaccagatacctcaaggtaaaaaaaaaatagtgtaaattttagatatctcaagatactttttcaaagaccataaaatttctcgtaagaaaatcggtgttgtttgacaagaacagaaaaacaaaacagggtcactacaaggaaaacaaaaacacctaatctttggacaaatcgaactctaacctgattgttgggatatgaagtgaattatccgtcttttcttatcaacttaagtttttggttaaactggttggtgcatacgtattgataattaggattgctcaagttagcttcagcataggcgcctcttccaaataatttacccccaatacatacaga

SEQ ID NO: 100827 - DNA, 533 bp, Oryza sativa
actctgattgattgacctatgactaacaagccattgagaaacgaacgaagcaaatataatttatgggttaaacttatgggggatgctagcgcgcgtgcgcgcaagggaaaggagccggcgcgcgcaccagctgcatccctacgcgtttcttttttttaagatctcctattttaacgtcacttttttgtttccttttttaaatcgcttcttttttccagatttttttaatcgcttctttcttttccacacgcgcgaatgatttttttttttgatattttataaattcaatccttcactgtagcgcccgttccgtcgtggcgcctagcgggaaaattatctcttaaaaaccctaattgcgaaatttgtttctttgcttgttgtctagtgtctgtgccatctcaagatctcaatccccgatctatcgtcgagttcaattccgaatccaaatccttccaatcaatttcctccgcaaaagtctagtttgcctcccccgggttcgatgggccgaatccagctcggcccatctctccccc

SEQ ID NO: 100828 - DNA, 578 bp, Oryza sativa
  unsure (1)..(578): unsure at all n locations
tcggcgaggaggagcggtagcggcggttcagcgacgaagaggacgcacggtggtgaggagcggtggcgccagaggatgaggcagtggtgacgccaccgctgtcggccacctcaccaccttcgtctcccacctccatggccgacgagcgaagggcgngcggcgtcggaagaagaaggcgtcggtcgggaaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagca

SEQ ID NO: 100829 - DNA, 951 bp, Oryza sativa
aggcgctaacggcggcggcgaccgggcggttgcgcggcgcaggcgcggcagggctgacagcggcaacgaccggccggtcggccacgcgcgagcgcgggaaagagcgaaggcggtggcgggttttgggcggcgacggcgggaagcggtgtcggcgcgagagagagagaaagagagagagagagagagagagagggagggagaaacagcgagagcgagagagacagagagagcgggcgacgtctctctctctctctcggctcgcatgcgtgcaacgcacgtgcgagggagggggagatgatgggctgggaggggagatgggccgggggaggagaatcggcccatccaaaaacacagggaggtaaagtagacttttacagagaaaactgctttggatagaattggagagatttagggtttggattcgaattcgaatttgatattcaaaatcgagggtttagggatgtatcaagggaaactcaaggagaagtcatgggaaagattcaaaaggaatacttgggtatttgttctcgggaacatagggtggggtcaaggaaaggaaacaaaacgggggtttggacattttgggatttggaaatgtatttggcgaggattcaaaggaagggattgactttcggatttagatttcggagacttgaattggaagaggagatttgaggcggaggattttgatttcgatgagagggaacaacgggatttgaattgatatccttggcacaacttagactcgcacacaaagaacgaaaattttcgcaattaggattttgccgaaatagtttttaacgactcacgaaaagcggagcgttacacttcttttccactgatcctccccaggggaaagtagggatggattactggcacgcagcacctcaggtcacatagcccacgcaggagacggaggccggtcaggggccagacgtgacaccacagcat

SEQ ID NO: 100830 - DNA, 1196 bp, Oryza sativa
ttacatattattaaaaataacttattacaaataaatggagaacgcgaccctgtcgaactgcgccagttcgacggatatcctgtcgaacaggggaagttcgacagccccctgtcgaacaggggcagttcgactgccctgcctgtcgaacgggggctgttcgacaggtcctgtcgaacggcagccttccgatctcctcgccagtcgcgctctggccgttcgataggcgccctatcgaactgcacccgttcgacagggacctactttcgcgattttccccggttgaccactacttttacgattttccataaaaataatattaattctcaaaaaaattcttcggtttgctgcttcctataactataaatacacacgcaagcatggagcttcttctttcatccattctccgagctccaaaatcaaaagcattgtttcttccagacttccacacagcacagcacacgcatacgcttgagatggagctgatggccatccttctcagaacggcgagcttgatctcgaggcctgccgcaacgccgagaagttaccggcggcgctgataacgggcggcgcagtcgaggccgtcgcggcgatcttcctctgccttttcgtgccgcccggtggtttgtttgagaaccacggcaaggggcccttcttcctctactacggcattctcatcgcggtggccgtcttcgggcttggtgaggcgtcggccggcttctgggtgggcgggaacctgaccggccggcgttctgtcggtatgacgatcttgtgggtttcgattttgccgcttgtcatggtggctgcgataggtggatttatcatcttcagatagttgcacactctgtttcttctgttgtatgtgtccgtttcttattcctgtgtgagtaattcccatattcatttgcgatgtgagattgtgatcgtaaaaaaaaaaaaatagtaatgtgctataagagcgtcaggattattcagccgtgttttccacttgtactagtatggtctgtttgtgagattttggttactagtattaagttattcttgagttttcatgtgaattagttttgttgtgcgaatgtgtagtactgctctattgatcccgcacaaaataatagccgaactgagaaaacacccggctgtttatttgaagaggcaaccacgatgcaggtctgcagactgagttaagtttcagatggggg

SEQ ID NO: 100831 - DNA, 742 bp, Oryza sativa
tcgtgttacttatgtgacctagctagaactatatgcttagccatgcttaattaccactagctcagtcgatgggataattgcagtattagacattctagtatcttgttgagccgcgtgctcgagacatctggccatgttttgtggtttaattatccaactaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtg

SEQ ID NO: 100832 - DNA, 584 bp, Oryza sativa
taataatgcagaatgtaatagaatcagcctttactcacaaaactaaaataatgatggcataaatcacagtttggcaaagtaccttaggaatttcgtcagagttagactcagaattgttcctcttttttactatttgcagatgtccatgcatgattcaacaatgtttgggttgtgataccagagtctttgtcttcaatatatgagataatactggaagggaagtggagctgcaagatacaatcagttcttttttccctgaacaaaagcggctggtagaagaaaacaagagaagcaaatgatccatatttaccttggttacattgacagtaggaaatgaaatcccaaacaagtaacctagcataacaccaataactgctgagaataggagcctcatgccctcatttgatcttggcaagccactgctgttgaagattgacaaaataataatagtaataataaaattatgacgcatatttatgagcactacagaaaaaaataaacatattgctaatagtgatcagacattagtacagtacatcagctacgtactactacctccgtttcataatgtaagtcattctagc

SEQ ID NO: 100833 - DNA, 1252 bp, Oryza sativa
cttgatttcttcgtgccttgcacgccgccactgcgaaggtaatggatttttcagagactcggagtattgcgttgattggtggcttaaaagttttaactatcgtttggttcgggtcaggtgcgttaatttgtttagctggctattggtaaagtcggatctgtgacagaagcacatgagttgcgaccagactgcagctcctcagatgctaaacaagtgactgcataataaaaatcgttgggctggatgagtttgtcagctgaggagcacattttcctttccctcctaaagctagctgttcgaagtcaaagatcaaatgctagcagattgagttggtatggtatatgccttggtccaacacagtatgcatgctcatatgaacttcacctctttgaggcaactgtttttccaaaaaaatgaattttttatttgcatgtaaacttcgtcgatgttagagaagctagcaaacacgctttctcttgtccatgcagcatatacaatccactctcccttttcttaaaaaaaaaaacttagtgcagtatgctcaattagacaattgagggtggtttttgtccctcgaagaatgggcatacacaatacactcattttgtacataccaattaaaaaaatcatattttttagaaaaataataagatagattaaacttgtaatatttcactttacggacatgaaaattaaaattgtatccatagaagtgtacataaaacaaatcacgactgtaaatatagtatacacttttgatcgttattgtttctatttatataagtcgaagtcattttttttttaaaaaaattaatgtttgtgtctttgggtgacggtgagctagagcggagttatgggagctggtagggaaaaccgttagctggaggacatggctgtgttcggagtccagtgatggaagccaatccctcccgtacggaaaacgaagcggtcctttagcgcgtgattaattaagtattagctaatttttttaaaaaaaaatgaattaatttgatttttaagcaactttcgtatagaaaactttttaaaaaaaacgcatcgtttagtagtttaaaaaacgtgcgcgcggaaaatgaggaagatgggttgggaacatggggatgcaaagacagctgatgtggtagagtccttggatagaccatgtgaggccggtttggctgttcaatggagcatcctgtttaggtaggacttggatttagggcctgatcggaactgctatctgctgctgccgcta

SEQ ID NO: 100834 - DNA, 811 bp, Oryza sativa
ccaaatagaatcctaatgacgattaaaaggaaagacgactggcaggtcgtgaagcaatcgattcaaggcggttggcgatgacttcaagaaagtaaaaaaataaaccccaatgataatcatatttgatttttaaaatcttaattacaataaaaatgagaggcggcgggagggtcgtataggagtacaatggcagacccgccgatggttggtgggtcttttagaaagtaaaaaaatgaattccaacgatagttatgttagatttttataatcccaattacaataaagagtatgcggcggacgggtcgtagagaagtatggtggtagcgtttgacgggatttctaaaaattataaaaaaaacatgaaacccaacgagacaataaactttaaaaactataaggttaaatttttaaaggttcgggcttcaaaaagtaaaaataaaaaacctcaatgataatcatgtttgatttttaaatctcaatgataataaataagagtggcagcgggcgagccgtataggagtacagtgacaaagtcgctaacgttttgacggaacttctaaaaagtaaaaaaatgaacctaaacgataattatgttcgattttaaaaatagcaacgacaataaaaagaacatgcagtggatggttgtagaggagtataatggcagcttttgacgggacttgtagaaattataaaaaagaagcctaacatgacaataaactttatagtttttagatctaatttttaaaagctccaaggagaatgaatagaaacattggtagatcgagtaagctaataaagaataatatgacag

SEQ ID NO: 100835 - DNA, 794 bp, Oryza sativa
ttcagaattaaaaaataaggaatataagaagagcagaatagagtccatatagaaatccaattaggaaatacttgaaattcagaattaaaataaggaaaattagaagtagagtatatagtccatatagaaatccatttaggaaataatataaatttagaattaaaaataaggaatattagaagtagagtatagagtacatatagaaatccaattaagaaaaaaaatagaaattcggaattaagaaaaataagaaatattagaagtagagtatatagttctattatattattaaaggaatagaaaaaggagcctccacgttcgctctcatggactagaaattctcacattaatcggagaaaaagaaaaagtagagtccatatagaaatacaatttagaaatagctaaaattcggaattaaaaataaggaatattagaagtagagtatagaattcatatagaaatacaattattattaaaggaatagaaaaaggagcctccacgttcgctctcatggactagaaattctcatattaatcggagaaaaagaaaaagcagagtccatatagaaatacaatttagaaatagctaaaattcggaattaaaaataaggaatattagaagtagagtatagaattcatatagaaatacaattaggaaataactgaaattcggaattaaaaataagtaatattagaagtagagtatagagtacatatagaaatacaattagaaaataatataaatttgggattaaaaataaggaatattagaagtagagtatatagtccatatag

SEQ ID NO: 100836 - DNA, 1874 bp, Oryza sativa
ttaaatcatgtttttttctcgagtaaataagaaactattggtagttaattatcatacagtctatctatatacataccgtgtagtatggccgcaaatgaaaaatgcgagtgcaagatattcaaaactcttttgattaaatcatctcatgaaggcgtgtgatatagtaataaagggagggaagcatatgcatgggaaaaaagaagaaagagaaaaatgaaaaaaagggaggggatgcgtacgaacccgcgcacgtaggtgcgcacctatgctgaggtgggaccccataatatttagtttgttctaagatcaatttaatctaacggtttataatattggacctaccgatttaagtgaaaattaagtaatagataattttattttttttcttagaatttctaatatttgccctaatttattagagcaccacgcggcagcttgagagcattttaagaaattttaaatgactaattagaatattaactgcgcaatatatatgtatgggatatatggtaatatttgttccaacttcgtccttgtttatataaatgtagagagaaattaattttgtggctagcaagccattagatgtctaactaatagcaattaattttgacacctatttacaattgttcagagtaactcttatatattcatcttacgacttcgataatccattgatcaccaatttactaatcaccatgacttgcatgaaaaaaaaatatgtagtaaggtttaggatagctgaaattgatgaattatataatttatgtgatagctatttgagggtataaacgaatgaattgacttctaaaacgttaaaatgttgtttaaataagacaccatttagaaacttaaaaagcgtgcaaacaaaaatccaaaatatggaatcgggaaaataattaatcgctgcatcacacctttaattttcttttcatgttattaataaaattaatcatctccatatatgatttgatatgtggcaaaacggtagcgctacatcggttgtgatcaccttagatgtctcagacactgcgctttgttacatgtgcgaaaggcaaaggtgcagacgtatattgtgcagcgagcaaaaagagaatttcggacgctttatttattagcaaacaatagatccgatgattataataatatgtccaccagttctagtgtaagtgtaaatgagttaatatagattttaaattgttattttaatgggtacataatataatggtgtagaccttactttgaaacagtgcattacgtgagaataatagaccaatgtaataaaaagtagatccgatgatttatataatggggccatcagttttagtgcacgtataaattagttaatatagatattgtttatttgataggtacatgatataattgtgtaaaatttattttaaaatagtgcattatttgaaaatagtagtacaaagtaaaaaagtacaccggtttaagttatatgatggtagattatttgtttgtaaaattatgattaattatttaaaaatatatccattatatatataaatgggaaaaataagaaaaaaaagaaaaaaaggaaaaaaaagggggggaaggaggcgtacgtatgtacgtacgtatatactacacctgccaatgtgtgggaagaggataggtgggaccatggtatttagtttgttttaagatcaattttatctaacggtgtataatattggacccaccaatttaagtaaaaattaagggatagatgttttgcttttttcttagaatttctaggattttctctattttattagagcgccacgtggcggcttgagagcgtttatagaaagtttcatggacttttagtatacataaattaaatgtgtaaaatttattttaaaatagtg

SEQ ID NO: 100837 - DNA, 513 bp, Oryza sativa
agggagagctggagagcgagagattccggcgtctccgcctcgccgtcccccgtctcaccgccgccaccgacgctgcagtagcagccgaggccggtcatgctagccgacctcaacgtcgacccgccggagagcgacggcgaggaccaaccaccaactcccaaccccaacgtaaacccagccaccgccgctgtcaccgcggcgacggtggtcgccatcgattcctccactaggtacgcgcacgaagttaattctcgatctgaccgtacatgatttcttctgcttgtgccctcatgtcccctgaagtagtttggaattgaacgtcagattcgcggccctcatggtcgtttgtcgcaaccctagaatttatacaggacaaagtgatttttgcgtctatgggacaatagtcctgtcatggcatgttttttgttgggcgtattcatctgaaatgagccatccgttagattttcgttgctagctgaaattatttcataggatcattctgtaaattttaac

SEQ ID NO: 100838 - DNA, 511 bp, Oryza sativa
gatgttaagcgtgattagccacagtctaatgtgcaaatttgttctgtaaatatatataaaattgatggcttgatggggagaacagcaagtttatgtacagtggagtatgtaagagatataaaacgaatatcttgtattttgtgctggatgattatgactgttcagcattgcttatgacaaacgcattacccaaagaattaaagtatagaggcgttttgaagtgtttgaacatttggagcattttcagggggatttctaaatagttttattatctgaaccagctactccatatgctatacgaaacagaacgatatgcatgcgtaagctagagcgggagttgtcgcgcgtcttttctgttcaagatcatctccatgtcctcttagttttacgatcagtgcgttaggtgcccgtttccatggtgggcctgggtgtgcgatcaccgatcaacagtgacgattttgatcctattatcttggttaacctaatccaagaagagaatttgacgtctacc

SEQ ID NO: 100839 - DNA, 1972 bp, Oryza sativa
gccgtggcggtggtggtgaaattgcaagaggagaatggtgacaccagcggctggtgctcgagctcctttattggtaaaaggtctttggatccttgataagggtccaagtggggttaattaaggctcccatcggattgcccattaagcaagaaaaaaagctaaattttaaattttcaaacttaattatgagattgattttgagatattttcaacgtagtttctatttcagtattgacttttaagtcaccaagaacacatatataaaagttttacctacaaatttatttttattttctaataagccgttttggcttattagaaaaaaagcgaaacgatggggccctaaaagtaagggcgatctgctcggaccagggcgttcggagggatttcagcacgacgtgctcgctccccaagctatccacatcgccccgcacggtggctttgccatggcgcgtgggatttttacacaaaaaaaatttaccgttctttctctgttcgctgggccatactttcatgtgggtccacatgtcggtccgcccgcgctggaaggctggtgaatttggagcgctctctttaatcgtctggcttggccatccgattgatatctgaccgtcgggatcgttagctcagcagcacacgatttccccgcacccacaccctcctctctgtctctccaatcgcaaccagtgttggaaatttcagaccgaaattttcggtcaccccagatacgatattattttggccgaaaattttcaatttttcaattttttcatgaatttgggtaatatttgttcaaattcaactaaattttgctcaaattttcagaaatttggaccgaaatttcgggatttcggtgacccccgatacaaatgcctcaaccgatagagtgaaccctgatcgcagcttcgcaaggagcctgagcaaaccctagcccgccgccgcccttctcctctctctctctctctgttcccatccccttgggaaacgctagcccatcgcgaccgccttcctccttcctaggtcgcgccagctccctttctccccttacatcctcattcctcacgctgccatcgacccccaccgttctcttgtcccttcgttgctggcgatggcgcgatggaagatggtgaggtcgtcgttcaagagacagcgtatcggcgtatcgcttgaactggcctgctagcacttgattcggagggaaccggcggtttggcttagcgaggtcgtcgttctgctgtcccagcgcagcgaggcagcaaagcatagatctgaggtggcggcgcctagctctgatactgggtgcacacactctactttccccaagacatcatacgcagccgtgcctttggcaacggcacctcaagcgcttgaggtcgatggcgctctattttctcatgtgagtaacgtctttgtcagttatacttgccatggtatccctggttctgattgcttgccaaccatctcagtcactatctcaaattactacatctaatgataggatttttcatccatattaccctggttctgattgctcgccaccatctcagacataatctcaaattgctagctctaatgatatgattttgcatccatattacaccaggattcaccagtgctatgaggcattctacattttggtacagtaatcggatgatatcagcagaaagtgaatcaactaaatgcttatttgaaaagaaaatttctgagtttttatgcgctgaagcttcatctgttatgtgttaattacataaaaggaagtgactgctaggagccacagaagctgtggtgggcaaactaatatactttggagctgtgagccagtgaggctagattgactaaatatatgtggagaaaactgcccacaatatgtattttagaactagccgacaacatgctggcatcaccaactaatttctatcatggtagcaccctggtcaggacagagctttgaagttttttggtgtcctctatg

SEQ ID NO: 100840 - DNA, 634 bp, Oryza sativa
ctttctccccttgcatcctcattcctcatgctgccatcgaccatcctcattcctctcttgtcccttcgttgctggcgttggcgcgatgaaagatggtgaggggctgcgtggagactgtagacaggagacaacgtatcggcatatcgcttgaactggcctgctagcacttgattcggagggaaccggcagtttggcttagcgaggttgtcgttctgttgttccagtgcagcgaggcagcgaacataaatctgaggtggtggcgccaagctctgatactgggcgcacgcactccactttccccaagacatcgtacgcaaccgtgcctttggcaacggcacctcaagcgcttgaggtcaatggcgctctattttctcacgtgagtaatgtcttctctgttgtcaattactccctccatattatttttttgtttgacgttgtagttcaatcctgaatcggttttttatttgacgccgtagtccaattcttcctccgtgcgaccgtgaaattccatcgttgccccttctccttgtcaccgccgccgtctcctcctcgctctcgctatcgtttcctcctcgtcctcctccgctctcccaccttcatcgcggcactgctgtctccgcctctcacgttgacg

SEQ ID NO: 100841 - DNA, 1289 bp, Oryza sativa
tctccaacgtcacatacatagatttgtctgaaatttattcctcttacattacagtggagtaaagtttctgaaagtatcactgataccgaaaggagaaggaaaaagataaaaaggaaatgagaagaacaacaccaaagagaaaagaaaccaaggagacgtactgcagcttcaaagcattggttccaactaataagctggttttttttatgatcgctgttaaagggggattactttcaacttttgtgccgtgccgtcttttccacgtgtgaaaaaccacgcaagtgttaaagccttagcccgacgtgtttgtacgaccaaaacccatttgatcatctcttgccctctgtaacttggaatgaagcatctgatcagaatgcaatgaaaaacaaaggggacacatgggctaatatgcatatcaggaaacacttttaaattcaaaaagctttttgggttattacacctgatctccattctcaagtagtatattatatatttcttctcattcattgcatcatgaaagatcactagaaaacaagaacagaagaaaaaggaagattctgatcaggtcatcaggatggttaaaacttctttatcttttgctgcagtaaggaccgaagtgcagagaagagattgttggcaccatcatcagcttagcatttcagaagatcgaatcagcaacagtgtggctagtatgcttgtagcttatccatccatctgaccatcttctattgggattcttgaaggtgaagggaaagggataaaccaaagcttacatgtcagtttggtacgagagatgaaacgttgtgtactgataatagctggatagatggatgcatatcagcattaatcgggatgtggcacatcagggcaccggtgatattttttctccttaattatgatagttacggatggctgctcactagattagacacttaattttggccttaaatcaactgtacttatttaaggtactccaggaaatgagtaatacttaattttcatgtatttggcattaaaccaatcatgctagctttgttgagttggaatattcaaattccttggaagttctttgtcagagaggtatgttgttcctaccaaatattccagtgaaatgatatactgtttgcaacggaaaatgaccatttttgggccaattttgatcctatttttcctccattaattacaaaatatttcattccacgaagctgatcgaggaagccttaggatcacttctcctaggtgtggcgtcattgtacttgtacatgttcttggcgcccaaaaaacatttt

SEQ ID NO: 100842 - DNA, 591 bp, Oryza sativa
  unsure (1)..(591): unsure at all n locations
atcaaacatttttaaaaaagtcaacggcgtcaaaacattgntgggatggagggagtactactctattaaaaaaaggtaaactctagctataaatctggacacgtattttgggattgatttttttttttgggacggagggatacgtacttttagctgtcacactgtcaaatcaaattaatcccactcaataaaacctaatatatacagtatgctagtactactacttaagtaatcacttgatgaaactgaactttcaaaaagaaaaaaaaaagaactccgtttctgtcctacactgcagtattgcgaagaaatggagggcacaactgctgtactttggcttttgattccaatgcagtctttctccaacaactcatcctatgctaataatcctttcattcgcaacgaccacatttaggtttaggaggggatatatatatctccggtttactccaacaaattcagagaaacagacagttgacgttgatctgaacgctccaaccaccgtgagctacgaggcgataaggagaatctactcactcactgatcactcttgccaagttaccactaggatattacagacaaaaacgatgc

SEQ ID NO: 100843 - DNA, 1424 bp, Oryza sativa
aattaaaccgctgtctctactctatcatattaaatatcacgatcaaggacaaggtcacaagggccatcaagattctaaaattttatacacgtatactagggcctatttgaaggaaataaacagcaattagttgcagtcttgtatttttagacaacctttatgtcaaaaatcatttcgagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattccccatagaacatcatacccccccaaaaaataccatgtgcattcaatgagaacatacctggaaagctcaaagcaaggtagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcggagaaccctgggggctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtataaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaacacaagggggcaacggagaaattgggataat

SEQ ID NO: 100844 - DNA, 1053 bp, Oryza sativa
tctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataatacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgaaaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgccaaatcatagatgg

SEQ ID NO: 100845 - DNA, 680 bp, Oryza sativa
attccttggcttgtagattcatcactccaacctctgcatccgtcctcacatagccttccgcctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcaggagtagcccctgagctcaaactctctgtgactctgtgactccctggaagacccacccgttggagacccacttgtctccactcagtgcattagatttagcttagctctttggtttttggttttttctcttttagcctctatctcctggtcaggttaattaagctgttgttaccaacccttcttggtcagtgaggaagca

SEQ ID NO: 100846 - DNA, 632 bp, Oryza sativa
gctatctaatacattcagatgcagttgacatttatggtccctcagtgccgcatggcactcccacttcatgatcatgtttggtttcaccccagtggtgcggggtgggttttgctgactcagttcagaaatatgtggagactgaggccaatagaggcacaaagaactaaagttggagtcggaaatcaggcttctgccatcgtcctgtatatgccttgaatagatttgcaatgtgtcagagctgagtggggtcaatttccaacagaagagaggctgtgacaccaggagaaaaccccgagttccttcgatgggtcctcaagccaacagcgttattgccggcgtgtcccatttttcaggaaggccaccctgtgggtgaaaagtgacagttgggaaggcagagagcctgggttttagttgagccttgagaaagcactaaaacctttctaggcctcactttcctctctctgtgaagcggggatagtaatagtcattgtccttgatggaacggtgtcccacccctccaaattcaactcctcctggaacctcagaatgtggccttcattgaaaatggcgtcattttaagtgtaattagttaagatgaagtcatactagatgagagtgggcctaattctact

SEQ ID NO: 100847 - DNA, 669 bp, Oryza sativa
aaattataagggtggttcaaattatagctaaaataaaccttaccaaagccaacttgccaaaaattttggcgggatttcttatgtatttactaaagtttagcaacaaactaaatatagacatttttttagcaactttatcaaaaaaattggtatgattaaaaatgtcatcaatctgaacaaccccataatatgggcgaaatttggggggcatacaagaagaaaaatacaatgggatacctacaaaatcaacattgtgtctttaccacactagcttgggttttgtgtctctaacatgtataatcatatattgttgacatcattaagcatgttaaaactgtgcagagtactagatgtggatgcatgatctatcaagtccgttatagtgcaaggctagcagatcacaattaactacgcaatggtgcgaacgttataacgtggttacttacaacaagttccccgtatcctgggtatgcagattcaatcggtactatctccatccgaagtgcccaaccaccgtaaccttcaacgatcggtgtgactgagtctattaaggtgtgaagccagttgacataggtatattagtattataacaatgaaagcataatgtgtaattgaataacaatatcttcctttacctcactaaaactaagaacattgagcaatccttta

SEQ ID NO: 100848 - DNA, 573 bp, Oryza sativa
aatattaaggagtgttaaattaccaaatatcttctgagctagatatatgatatggtttgcttgatatatggcggttgagtgttctcaatgatcaagctggggagagtttgctggcagttgtttgaagttccattacggggaagggggggggggagggtgctcattagttcgcatggttgatatagctatttgattttaatatatatatatatatatatatatgcaaaaatgttaattagaaatataagattttggcctacgtgttctttacacgtagtgtgtctatcataaattactttatacggatgaattaagtataaattaattagctaggctacttatagtgcaacatgtccgacaatgtttgagtctcctctactcaatataactttggcataatgctgagtagaggatatgaatttggcatatggtaacgtgtggtgatttctagactagttttttaatatggcgcatatggtaaattggtcatgtctttctgggtaaacaatgcttgtggtgacctgtgattattttattagacaggtatttttcaaaggtgccttaattcgaggt

SEQ ID NO: 100849 - DNA, 580 bp, Oryza sativa
gtcgactctagaggatccccgctgcaatgcagataaataacgaggaacaattcagtcttcagtagagaaaggatgtgcaattaggcattgcacagtcaacacaatcttcaaacatggtgcacactccacaaaaaaactaatcttttttcgatcttgtatgcaaggagcagagaaaccatcaacgcaaaatctgcagaaacaatcgctacctgcggttttacctaaccagcattgccatgcaaacaacttgccgagataggcggagccaagaaaaaaattgcagattgtagatggaagtcaatcgggcgcctggatgcaaacatccatagaaaaaccttgcaacttgcaaaggagagcataataaaactcaaatgcaaaatgcatccaagaacatgaaaaaaaaagaaacaaaagaaatggagaatttcaaggcctacatagtacataccgaacgatctcgcaggcggtacaaaaacctcgcaaaagggggcaaaagaagaagagaggaaacgacgcacaattccccatagaggaattaacctcaaagaacagattgaaccaaaaaaacaaaaagaaaatt

SEQ ID NO: 100850 - DNA, 683 bp, Oryza sativa
ggtgtacttttcgtaccactagtagtactttttcttttttctttttggctggtctcggtcgagccagctgaacgggacaacttccgaccattgaaacttctggataaatccctggtataaatttcaagtctaaaatggaatatatatttttttaatctaaaatatagtacatcagtactaatttttaggctgtttgaatattcctttttagtcacagtttgtcaaattttgaatcgccttatgtttcattcctaaccttctgattgcttgaaaatgtttggatttctttgcatttaaattagtattagagaaatacttagattgatctatacaaattttttaatattacaaatacttgtattttggaacagaggaatatgtaatatgggtaaaaagttttggcgtgtcacatcggatatacggatacatatttaaagtatcaaacatagactaatacttgtaaactgcgagacgaatttattaagcataattaattcgtcattagcaaatgtttactttagcaccacattgtcaaatcatggagcaattagaaaaaaaaatctgcctcttatcttacacgcaatctatgtaattaaactttttctatatttaatacttcatacatatatccaaacatttaatatgataatgtgaaaagtttttccgtatgaactaaacgtagc

SEQ ID NO: 100851 - DNA, 557 bp, Oryza sativa
cccgagccatactggtatcatggttcgcttgatgtagataggtcttatgtacccaagtgtattggaaaggcgtctccaataaactcatgctggtatttggcggacctttgtctggtctttaacaaatattcttatttggacaacttggcctaaaaatatggaaagttaacgactggtgtcccagggatatctatgtgacttgactggtacaatttacgaagtatctcatttttttggggtgtcaaaagtagttcccctgtcggaatagttatgaaagtgggttgatcaagcaattaacttaacgatatattattcatatcatgtccttgaatgtgtcatccagtgggtaaggccgttaggatccccaatgggactgactgtatataagtttgctcaagatttgacttgggctgaatgagctctgttgttcaagacttcaagtcacatctgtttttatcagcttcttttagcttgagtatatgagattgacaatttatttatttacagaactaaaaataatttcagaatgtgtcaactctgtggaccattagttgact

SEQ ID NO: 100852 - DNA, 995 bp, Oryza sativa
tatgtactagctactataaggagtatatgttttattcatatcttttgagaaccaattcagacttgattaaggtttatccttttttcattctaagtatttttcctaaaacacaatatacatatagaggctcatatataaacattaccacactcttattcaaagttagagcatcccagcaactcgtctaaatttgatcttccatatagctatatagatggtcataaaaaaaaggaaaaagtacgaattactccctctcaactattgcacgcgttcaatttacccccctaaattacaataccagatatttttaaccctaaacttttcaaaccggacaaattacccccctaactcacctcgaagcggttttgatccaacgtggcgcacacgtggcggtccagtcaaccaaaaataatactcctaaaaaatagtggctcccacttgtcagcatcttctcctctcttctactttcttccaccttcccctcccatccatctctctctctctctctctctcaccaaggagcaagggccggggaacggcagcaacggcgtcaccagcgtgggaggagacgagcagcaggcagcgcgcgtctcgcgaccgcaacggcacgagctaggggtggcggaagacggcgcgacagtctaggctagggcggcggcagcgttcccggggtggaaacgggtcggcggcgggagacgcttggcagtgcgccaggcggcaatggtgtgcgaaacgagggcgcaaagatgggacgcgaccttgcttccatcgacgcacaggagggccgccggacgttgtcgtcgtcgtccttgatgtggccgagctccatcgccatgccgaagacttgctgcaacctgcagatgctcctgaggaccacctgcatcacgatctggaccacgcagtactccatggacgcccccgactcgatccctcatcaaacagaaactatcctaccatgatccatccagccagagatcggtcaagaaccgaatcca

SEQ ID NO: 100853 - DNA, 680 bp, Oryza sativa
gttccaaactttcagatttagatctgattattggattgcaagacagatgtggcagaaacacatcttgggaaaccaacaatgtggcagttacatgcttgaaggtataactccatagtctcatctcgaatggtacgcagtcttgaacatttgcatttcaaatgatggcaatgcttcgatgctactgctttgagttgaccagagcattccagagcacaacataacatatgtcaggagatcttatttttcatgtttggactataaatagactaccatttgatccccctgtgttgctaattttataccattcctggaaaatgtgtatatcattttctttgctcgatctagtaaacaccgttggaaaatgttcttctcctcatctccattttctgaacattgagttatgtgattacttaatggccttctcattgctttccatgtaaaagtaatttgatttttgttctgtccactaaataaggatgccagtattcaacaagctgcccacttgcaacctcagtgttttgattacgatgaatttccagcgttttgatatttgcttttggctttaatttttgccacccatacaaagttttgagcattagtcatagctaacctagttcctccaaagattgtttggcaccagcgacctcatgatcccaccggttctggtcgacgctgggaga

SEQ ID NO: 100854 - DNA, 604 bp, Oryza sativa
tagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgtccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaaataccaatctagagcggttttatcctacgtggcatacgcgt

SEQ ID NO: 100855 - DNA, 2206 bp, Oryza sativa
  unsure (1)..(2206): unsure at all n locations
tcatgtaaaatggattggctactaccatagaaggtgctaaagtttgtcaaaattccaggagcgtttctcaaccttgtggctctgctttctcatgttataatgtgctaagcagctgcattgcagttcaagatgtattattttatacacaatatttggaaatgtgagaattgccactaatcttaagtttctcttaagcatgttctttaaatacagcggtatcaccgcttagttaccaaagacaagaataacaaacttttttttgaacggaaaacaacacaagatagtgccttttcattgaataaagcaggagaaaatacaacccctaagggtaaagagagaaaaggtgttacacgtaaaatatacactatacagggtgcgggatgaactcacgtaaacgtttggcccctgccagagcccaaaggctaacctcctctttgattttcgttagcagggagctcgttgccatctctttatggtcaaagatcctccgattcctctctttccagatctcccagacaactaacacggtgagggatataagtcccttcttcagaatgtcgggcgtgtttgccatgttctcccaccgctgctgcaccgagtaggcttcttcccaatggcccggttccaaatatagaccaaacaacctgacaatagaacttgctgcacaaattatatctcatctttctattttgtttgatattagttttccatttctaaattaatgggtaagaggaagaaaccaaagccgggagttcattttttgtttactctttttttctatatatagtntaagtgataatgttgacacttcttaccgacatgtactataaagtgattatanaatctatcgattgacttccatgcatgactatctttgtacttaatattactcaaactggtcagaagtatgctttgctttagatgctctcagcagctcttgcatagtcatattatttgcttttctttgagtactattcaatgctatcctataatcatctgtaagctacataactctttaatgaatggcagggcgccgcgaagcgcgcctaaagtcgtgcttcttaatttcatgttacatagccatacataaaattaaattgatcaatgatcctggaaaaaaggattaattgagcaattatactgcacagcttttgcggtccatttaatgtaactctatattggcaatttggcatattggcaatttagcatattgatcgataccagtatcatgcaatggctccgttttatgctgtgtgtatgcatcatgcatatatgcagttagaccccccctagaaaggtcgaaaatgctgatggctaacctggtgatatgataaacacactaatatacatgatgcatcaaagaaagtgcaaactttacccctcgttgatttactggcacatttgttatgtcatggcagtcatgctcatgttacattgcggtatagtgttanagtgtacatggctaccggtcaggctgaaatagagggacgtagaaatcgtgtcagacagatcgtggatcatggatggatgatggatggcagaagcagaacacatcaccgaccggtcaaatgcacgccgagatcacttagccagttgggctctaaacagacctaccacccatgaaggtccaataaacaacctaggactgaacctttagagcccgtgacccactagttgggccaaaacattttttagcccatgtaaatgtccttgtcataagggcgattaggtcaattcccgagtaaacaaaaaccatagagttgcaaacatggggctttaaaactataaatagaacccaagtggtttgtatcagggcatccaattttgtttttaataaatcaatatacatcccacatagttaagtgataacttgcccttcagcagatttgtttgtcaatcgacaacaattaccaagttttggtagaatatgataaatgtgtttgctaaaatttgacaatgctaaaatatggtaatcttaatagtagcaataaactaaataagtcctgtatctacatacacatccacaataatattgtttatttcttataaatgatccatatgttaggtagcagagcctaaagactactataaagaatacttttataatatgtaagacccactctattataaacttttataaactagcaaaatattgttttatatctttgcaataaacatgacacttgcaaactaataaaagagcttt

SEQ ID NO: 100856 - DNA, 2030 bp, Oryza sativa
aatattttaagagtatcttttaactaccatcaattaatattaatttttctttttttttcaccattatccttctctttcactcccttctctttcactccagaagtccagagagcttgagagaatgggaggacgcgagcgaaggacggaggagcggaggggcacgagcagctcgccgccggtgggagcggaggggcggcgcgagcggctcaccgccggccagagcggaggggtggcgcgggcgaaggggcggcgcgagcagctcaccgacggccaagcaaagtggcggcgggagtggaagggcggcgcggccgaaggtggtcgacggcgggagcggccgacgaaggtttgcctcatcctctctccttgatctaccttcattacttcaccctctgcctcgatctcgattcggatgggatgggagaacggatgggagcggtggttgcgggatggcatgaggagagagaactctgggaatagcgcatgcgccatctatggaggcctagagggggggtctaatgggcgatcgatcgctagggcgatcgcccagtgatcggtccacccccccagctcctatagacactcctcccacttccccccttcctcctccccttcttctcttcctatcagagtacaccacaaaaaaaattaaaaaaacaaaaagttagaaaaatttatgtataaaaaatttgaattcaaattcaaatttgaatcaggtatgtaaacttttgacttgtagattttggatctataaactttaggtgtataaactttagatgtatagaaatactatatatgaaaaatatttgaattcaaattcaaatttgaatcggatatataaactttaggtctataaactttagatgtatacaaatactatatatataaaatatttgaattcaaattcaaattcgaatcggatatataaatttttgacttataaacttttggtctcaactttagatgtgtaaacttgaggtgtataaactttaggtgcataaatttactaaaataggaaagtaatacggtgccaaaaaaggaaaccaggtgaagaaagggagggggagaagggagggaatcgatcgctcgctcgctcgcccagtagcattcccgaggcccagatggggtatctgttggagccggattttctccccccatacactattttttggatggaagatgggatgccggaattgatgggaatgctcttagatcgcaagttttatttttattctagtattaagtaagtgatgcatcattggttgatagagatgcaactcaatatgaatcattgtgggcagcacccatcagggtttcccaaaccgcgggggccagggttcccgcgcccggccggtaagcacggttaccgcgcagtaaccgcggtaaccgcaaaaaaccgtacaaaaccgtgcaaaattaatcaaaaatttaaataattttttaaatttatttgaatttaaggaggttacaacggtatttatattaccgtacccccgcggtaagcccggtaaccgcgataacctcacggttaccggcggtaaggtaaaccctggcacccatacgacctaaccatgtcaagattcgatcggtttttcccttttagaaaaaagtaagagatcaactacacttcatttcattaagaaagaaaacaaaccgcccatatttcattttttaaaaaaacaaaccgcccatataaccaaggcctcacgagccattcattaaaaaaaaaggctcacaagcacttcgtcaagaacttatccacaatgagcatcacacaagacgacacataattattttctttttttagaaacaacgcagacactcaccttacccctataagcatcttcaaagactgcgcctcactgttgacaggtacgtcgcctatcactaaaaacacagcgccgttaaatcctataaaattcgctctcatggggagtcgaactaagacctcaggtgctactgaggcttttgtaactattaggctattaggctacagtacggttgtctccgctatagacccgctctcaatcctc

SEQ ID NO: 100857 - DNA, 740 bp, Oryza sativa
tgttccgatcgaacatctaaccaaggagaacatttagccagttgtttaatgagcagatcatatggaataatggcttgctttctgcatgaccgttgattagtagtacgaactatctatagttatgtatgatattttctatgagagaaacgcgactaatatttgagttgagttttctgtaacttctactcgttggagtgaaataaaaataagaagttttccttcgtttttttttggctattttagcttattgtgttatccaaattctctattgtcatctttgtccgctatgccccatctttttgtttcgtagttgctgactgtcgtgtgaattggagcagtacaagttcttctgcttcttctgcggatgtagcagaacatggatcgtagttttctgcttgtgtttgtatttgggtttagagatgtagcagaacatggcgaacagcagaactgggagcagaacatgacttattatcgtccagcgtgttcgtttctggtgaaaacataaacgagagccaccaccacctaatacattcgcacctgctgcaggactgcaaatgcaaaatataaagaaaacgaattaggaacagaaacgatcaagaaaagaatccaaaagatgaaaaaataagcagcaaaccttagaccggaattctccatatgctagagctttcatcgttatctgctacacagccgccggtgaggccactaatctgagctcagttcggttatgaaccatccaaacg

SEQ ID NO: 100858 - DNA, 721 bp, Oryza sativa
  unsure (1)..(721): unsure at all n locations
caaaaacatcgatggatcatatccgactcagagcgatttttttaatagacggtgtttttttcttgcacggttttttaaaaccatttgttaaattggcgcgttttttctgactgttttttcctcgcatgttttctttaaaaaaattaccgacgatggaaataattttaaatgactacgcaatgtatagggttgccaacaaagatgcatgccacgaaatgaagcttcacattatctaatgtgtgaaatgtagctgagtagtttttattttttaaaacagacgaatatccaagttcaatttggataacagtgcctcacttgcactatctactggttgagcgatacaaaagacaaccatgatatctccaatgaatcagcactatttaatcagttaaaagtattgtatgaaacaacacaaattgtacttgcatcattaattcatcatcttactctcgcagagttccacttgagctattaatagaaataacactgttgcattactcacctgagaaaatgggtgtacataaacaacatgattaaatttcccaccagtaacctatgatgtcataacataaaaataaattagatcagtacaggagccaatgatagtatatcatggtacccataggtacaaatgaacagcattttgaaataacatcagnctatatatatatatatatatatatatatatatacttatatatatacaactgattagaactac

SEQ ID NO: 100859 - DNA, 685 bp, Oryza sativa
  unsure (1)..(685): unsure at all n locations
ttcctgcagcccctgagcaagagcatgagattacttcgccatggcaaggacaaaagcatatctgcatatgccgcgagggttcgctgccgtcgacttttctcgatctctatcgagagttcagttttgtagcgatagtttatcttttcggcttttgacggaagaaaataggtctcggcgacagattgttcttttttttttcttcaccagatttttgtcacatggttatttacttccccaancncctcntcncgatcttcttttttttcaaatagtttggatcatttattctaagctatttgttctatgtaaaataatctattttaatagcccgtgcaaaaatcatatgtgttgtctcagttttccaaatatgtgtttatagaggtgagtgtgtgaacgttatactgtgttttaaaaaaacatatatattgtaggccagctatttgctctaaactattttgtgttaagctacctgtactaagttattttgtttttttaatgtttcttaaccgaaaaaatggaggggtatttggtaaaaaacccttttaaaagggggggggggaaaacccttttcccaattggggaaaaagggggggcctcgtcaactatagacttgttggctgacgggtggttagtacagcgctaccgatgccatgaaatggaatttggttaatcgtggagtgaggtc

SEQ ID NO: 100860 - DNA, 689 bp, Oryza sativa
  unsure (1)..(689): unsure at all n locations
catctcaattgttgctttctccggcatcctgaagaagaattggagccaacaggctcaaacccatcgaggcattggcaacttgggacggccgacggggaaaaagggggggttccgccaagtaaaagggccccccccccggggaaaaaaattttgggnggncncncacacgnnaagccataaaggtatcgcagccaggggcccttgggagttgatttgcgacagtccatgaggacaagctgctgttccaactcatgaacctaaagttgcccatgtagtcaatcatgacgcgcgtgtatggtgaatcatcagagattgtgtacttgaggtaaaactcatccttagtgttcacgactgttttatagacaaaagaggtgctgttgtgcaagtatgttgcaccggacaccgagacactatcaaacagaatgaaacggtaatatgcgccccntctngggttctcggtgcgccagaaatgaagatctgaaagtttgacgtgggatcgccgctgaaggagaaatccccggtggatgggtcatctgggcccttccaagcgatgaaccgcatggcgacttgtccgtaggatctcactaaaaacttcatgttgggcagaatggtatcagttggttgatcaaagctttgccatatggttgtattgttcgatagccgaagaaccaaatttcctgggggtgcag

SEQ ID NO: 100861 - DNA, 1606 bp, Oryza sativa
ttacagtctcaaccgtttaaggttattaaaaatacgcggaggtatgacccgctaaatccaatagaatgcattcagttccatctcaaaaaagtggtgataagaaattatggaggaaggaggtcagatgtcgactttgccaagttctttgttctgaatgcaaaagcgctaagagaaatggagttagctggccttaacaattgcaatcagaaatggttggccaatcaacacaggcggcttcaattagaaaagaaagcatctcaaaatgctcaatttacatttaaaactacccatacgagtgatttcagtatgaacaagcacacccatgatttgtcaatatctgatccctttgataggtctttatgaccatgctgctctcggatatgatacacatgcagtcttgtattatgttcaaatgttatatttgtaccttctcttgtttggattttagtgtcgtactatgtcagcaagttaatgagttatctttatttaaagccgcaacctagtaagtttttaccactaatacattcccttggctatggcagtcctattttctgatgtgtaatattattgctgcccttgaattgttccatacatttttccaactgaactaaattaaaaccacacgcacaattatgctacatgtggaaagtaatttggctggcatatccagaatagcctgaccatcattcctcgaatgtatttaatagatagtaatctatttgaatttttggtgcgtaaatgccatttgtggatgctttttggtttcacagattataccattctaatttgataacataatgtggattttatgtatcaactgattaatatatacagaagcgtgtgagttccaatcaacacgtcgatgtattatattgtattgttttgatgtttatacaaggttaaaatagtgtgcatacaaaagcatgtgaagttcaagattcaaatcaggatttctcaacatatttatatcatatactttagatgcttggagaaggtaaacctgcagtttggtcccatttaagcctatgtaaaatgaggaaaacgtgacgctactgtctttattttcctgcaatatgtattatgatgtactatatattatattttcacaaggagtgtttggtgttctatttaatgacttagtcatatggaatagtatgagaattaatgttagcataaaggctcggagttaaataaggcggcagttctttttactgaacgttcatgcgattagatctgtactaccaactaattgttatgttctgaaataataaattcagttaactgtgactggcagagatgaaatatgactttgttacttctgtgaagaactgttgcattgggtgtgctttcagtagtttgacgttaagcaatatcttttatgttcttatttagaaccgtgcagtgcagcatgttgagtcatccattactaggcctatctaaataaaagataatcccttgtatacctttttgtttaagccatatttgttttagcagtatatacacttctggtttaattttggttagtgttgcaaatccgttagtggagtcataacataatatcagctaaatacagctaccttttctgcacaacatattatactgtgtg

SEQ ID NO: 100862 - DNA, 739 bp, Oryza sativa
gtcacatcataatgagaggctttttagtctctcatcatagccggagtcgatttatccgctctggtcaaacaggagcccaaaagtcttcatcccttaaatggcgactgacaggggcacccctcgtgtcagtcgccatttaatttgacaggccccatcatcaagacgacatgcgcttggcttcccaagttaagagacaagacatgcatttaatgcaaagattgtaatatttctccactaagttaggttgttggacccatgtggtaaccccttaaggtataaaaggagatccaggcctacttagggagggggatggacggattgaggggggcagcttctgcccctcatgatcaacaccttctactccaataaggagatcttgtaatttctcccacaatcagcatagcaaaggagtagggtattacgcttctcagcggcccgaacctgtataaaccccttttgtctcatcgtcttggaggggcctaaccctctcaagatcacacagtttcgctctccaagccttcgaatctcacccactgcccccggtcaaacctaaaaagggaggcctcacggttccctggaggaggagttcacccttcgacacgcacgttaacgttgttgtgtactcgtagtcatccgaaaatcagacgatctagttgtgtgtgtagcattttcgaaaatatttaatctcggatggacgtcaagatttgtaccatgttatctggcctggaacacattttta

SEQ ID NO: 100863 - DNA, 649 bp, Oryza sativa
tgtggtggaaccggatatcagaagtttgggagtgaaatcggcttgaaccttttggaccaccttgtgcctgtatttagttaaaacttttcacttctgaataatatattttgttatatatctagatctgtcttacaaatgccactgcagatatggtttatatttattacttttattgcattactattagcaaaattgtgtgtgcggataggattgatttgaattattatatgttttgcgatgagtgctagcaattacattgatttgaaaatatactacatccattttacttccttactctgctgaacctaaaacttatcatagtatattaatgtatggaaaatatatcgagtcaatttgcatatttttttaatctaaatatacttggagcttttcttggaacatatcttagaatatagggatgcacatagtttgttcatagtagtaaatcaacaatatatgctttttttttactactaatactacctaaaatgtttttctaaaaaaactactacctaaatgttaatttctactctctcttaaaaaacatttgatgctaggaaaactaagttatgctcataaatgtacttatatagtgggtgtaaatgggtatacaacttacaaattactcggtcaatatattttttttttg

SEQ ID NO: 100864 - DNA, 525 bp, Oryza sativa
gatattttgaaaaaaaaatcacaaaactatatatagttaaatttactataaatatcacaaagttacatatacagcatatcctttatcataaaattacatattataactgctccatcctaacattgttattctaatggaggcttaaaatctgtattttttttaataaatctaagatttaaaatatgtaggtttatgataaaactgatggtatatatgtgattttgtgatattataactaaaatctatcaacctgattgttttgcttacagctaaataagccgcaaaacaccatataagcaataaataataatttatatgtacaacttttatatttatattacatacagttaaaaaaacaattgctaaaattaaagtacaatgaaccaaccctccccccaccctaccaccaccacaaaaaaatgaactcagcatgtaagttttaaaatggtttatacgctgaaattcaagctccgaaatctttgtgataaatttagcactgaatgtgtggttttgtgatcaatttag

SEQ ID NO: 100865 - DNA, 578 bp, Oryza sativa
atcttttcaactttttcttttcttgagcctttttgctcatattgttctcttttattacgggtacgtccctgtcgtcaagactgtttccaaggattcggcacccattattttgctcacattgaatacgtccttgtcgtcaagactgtttccaaggattcggtattcattttttttcatatttttattctctttttcacaatgagcaattaaagctatttgagaaataacaattcaataaagcatatatataaagcatttagaaatcaaaccacatgctagcatcaacattgcatatttgcttaattcaagtagagaatttaagtgtcatgcatcatctcccttaaaagcaaaatctaaatctcatgaaaggactagaatacatacaggctatgctagagacaaatcaaccttcatagtattgctagcatgcacaagaaaataccatatgtataacaaagctctcttttctcaatttttctcattgtcatattattgcttgataaaaccatgggatacaaactccccctcaaaccatgccaaaaggatgaattgttcctaattcaccacgaagaaaagca

SEQ ID NO: 100866 - DNA, 1074 bp, Oryza sativa
cattcattccctcctccctcctgttcatcttctcagcaccaatggcagcagtacaagcatgggtgaaagcgctggcatagaaggcgcttaacgacactgtcggcaacgggaacatcaccatcttcgagccaaggaacgaggacatggagcgcgacctcgacctagagttccgccgccaccacgtcctccccgcctgcctccacggtggtcaatgagggtgggcaccgctcgtccacggacttggatgaccttgttcgagcgtgtagcccgcgccgccgctgctgccatcgacccgaggagatactctcgtggggatccatcagccgatcgagaacgacacctccggcggcggtggagaagcccctacggctaaagtgcctcactcagatttgggctatgaagttgccatcagcctcgacacgccgctcacgttcctcccggatgagagcagcagcgaagaggagacagtggcgacttggcggctgttgacggtcgttatcgatcagtttcaaccgtcaatattaccaaaatagaggagaactagtggtgcttgcaatgcatatgtttgttagaataataatattccactagtattaggtctactaaccttttgcagagaatgacaataaagtggaggagaatcgacatcaacacaaacgataaatcaatcggacgatgtcgagaaccagacttgtgtatgaatgggccaagaactcagaattgacacgacaaactgggccaaaattcacaagtctgcggagaagaacaacagaggaggccgccagccaaaccatgggctggttgggccggccctaggttcgaccgaacctggtggttcggccgaacccccctcatcgccgctggatgcagggtttcttctgaacggtgtggattagctcccaatgacggttggagggtatttctaactattccaaccgtcacaaccgtcattaggaggctatataaacccctcatcttctcactttactcacacacctcaaggaagagctctctcattcctctcaagtttagtttagtagtatctagctggtggaatagaattagaataggaat

SEQ ID NO: 100867 - DNA, 683 bp, Oryza sativa
  unsure (1)..(683): unsure at all n locations
attcctgcagcccctcttaccttcttgttgaccccacttgtcaatgagtcaaggatattctcgagaatatcttttccaatattccacaaatatttccctcttctagaaattcaaaaatcattttatcttattccatgagttaataaatctttttcccttgttccataaatcatttccattggtcccacacgtcagtgactgtcaataatattcttgagaataattatttattattaaatntttcnanaataaatcaatttccccttgttccacaaatatcttccttcgcccagaaattccacttaaacttccaaaattcatatctccctatccgtaattccgattgactccgttcaacttccaataattccataaaattgagatctatttaatggcactattatttagtctaaaataggatcttttcttggtctttgtttaggttttaattgtttgcgtacagttgcggttgccggattttcgtcgatcgcgggttttctcgaagaaattcgtgaagaaccccttgnagnccccaaaaaaggggggggccccccaaaaaaaaggggttcaccccccttttttttgggggaaccaattgctcctataattggaaaatcattattattttgtttgcaacttgcattagtagaatcacacactcaacttgattggcctcggtttgc

SEQ ID NO: 100868 - DNA, 613 bp, Oryza sativa
tgactctgtgagaagtgcgcgagattcacagtcacattttttatttttaaaactggtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcctggtacagggcgggaaataggtgccgcaactcattacccctttaccggtaggggatatcatcaaacattccc

SEQ ID NO: 100869 - DNA, 631 bp, Oryza sativa
ttgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaa

SEQ ID NO: 100870 - DNA, 517 bp, Oryza sativa
  unsure (1)..(517): unsure at all n locations
ctcgatctgtagctagttcctgtcttccagctgtaactgtaactgtaacgagaattaacaggcaaaagaactttgttatggggatgctttaataaagctggataactaggtgatcnnnnnnnnnnnnnnnnnnnnntgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaatattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaagga

SEQ ID NO: 100871 - DNA, 506 bp, Oryza sativa
tgacatttccttataaaatcatttgcagtatgagatatattttgccatggattatgttcaaagcaatgtcaccctcacaacttaattattgtcttttggaaagaggaaaataagatatataaacgatccattctgcaattctgaaatgatggtagcactccattaattgaacattaagtaatcaatcaattgatgcatagaaaaagttaagctttaattcattgtatgaacagagcatgtaagttataacaaaaaaatatgcacatcaagacttgctcctaaggtcattcgtgcaaagttatggtaattataaggcataacatgggccactctgatctacacatcaaacaatgctagccggctagcctaaccggccaatccctcctaaggaattgttggaatttttttgatggatttgctcttaatccatgaatttagtattaagaaataaatgcaaagattctgagctgagaagttgacttgagggacatcagttttaagttttg

SEQ ID NO: 100872 - DNA, 581 bp, Oryza sativa
cttccacataccttcatgagcagcagttacaagtctcgtccactttctctaacaggaggtaacaatgttgaaagtacacaccccactgtgaagcctaacactgtgcactataatggaattgggttcccttcacctgctattgcaagtggctacaagccatatgttagttatggccagggtgtttcaattgatgatgatgacggtgagtagaactatccttgattaacttgaaaagtatactgctgtaacttgcgattagtacaactaaagtttttcccttttgaaacctgtcagatgatgtctatgaggttctgcatcaaccatttccgttcagtcattcgagtttaggtgacaagaagatcgaggaagaatccacttggaagtacaatggttttcaaacaagttctgcctatggaatcgagatgcctacatctgcaatgtcaacaggttggaagctacctattaatagcaactgaaaagttaaaactgataatgatgatgttcatgtaccataattccctcaaatattctgatgggtgatcacataaaaatagttttactagtataaaatgcgatattag

SEQ ID NO: 100873 - DNA, 618 bp, Oryza sativa
tcaatttgtggaggaaacgagtggggagggagatcggcattccttgaatatttttgcattctattgccttgaatatttcactaaaatcagcaatcttgtcctcggagaatcacccggtttcaccttgaatcataaatgacagagcatagtcccaaaggcgtcctggtataaacatataaatcagtcgacaaatcaaaatgtttgtggctcttcaataatttgagaaacaaactatgcatgagggcaactaactttaaaaccaatttgagaatgccatgacatttccttataaaatcatttgcagtatgagatatattttgccatggattatgttcaaagcaatgtcaccctcacaacttaattattgtcttttggaaagaggaaaataagatatataaacgatccattctgcaattctgaaatgatggtagcactccattaattgaacattaagtaatcaatcaattgatgcatagaaaaagttaagctttaattcattgtatgaacagagcatgtaagttataacaaaaaaatatgcacatcaagacttgctcctaaggtcattcgtgcaaagttatggtaattataaggcataacatgggccactctgatctacac

SEQ ID NO: 100874 - DNA, 676 bp, Oryza sativa
acagattccctgactttgtgcagtctgcagttgtgccactgatatgtggaccttagtttggtatgacccacatatcagtggcacaactgtaaactgcacaaagttaggggagtctcatccgtccccaccacctacgcaaccgccctctgcactgtggactcagatcgtctgcattggctcttgtaatgcagagaagttctctgcattagcccagatctaccgttcatccaaaatccaacagatatgctcgtttggtgtctcttcgtataaaatcagcaaaagctcctgagtttatacagtgagtgagctaaaaaatacaaatttaataagatacaaaatggattccagataatatatttagcacgtaaatattgttgtttgctctcaccttcctccttgctacacttgaaaaaaggatacacttcctccgttacagaatataaagcatccataattttacaaaaaagtcaataatagtaacttttgattaatgttcaggctaatactagtaatatgtatgttcagtgttatatatgtgatatcattatattcatattttaaaatggtttcatatattgttaattttatagtcattgataatatattataaaaaaattaatggtaatatcgaagacagtgtaaaaaacataagctctttatagtttgggatggaagg

SEQ ID NO: 100875 - DNA, 1506 bp, Oryza sativa
cattcgataaccttcactccttgcaatttgatttcttgcaatttgatttctccatggcgtagatggtaatcggctccttgatatgtatatttcatttatgacggcactcatacaatttccaataactaaattgcattattacttggttcttgtttgatcaagcttagttttatttttgacagtatacgaccttacttgaataggatcaagcttagttatatggctatgtttttatttacaaagttgcatgcaggattgcaaaaagtttgatgtcgctaatttgtagtattgctagttcttccccgttacctaatttcaagtgtagttaccgagtttatctcagcagttagttggaaacaaccgttgccttctaatgtgatatcaggtacaaaattacctatataaccctccacccaatttttacttaataccttggcccacatttgtaataccttcctatatctaccttttgttacagattgtcagattagaagccatcaacggatataatgcctcccaagcaccttagaaaatctgttatcttataaaatagtaaaaactaaaagtaagaaataatcttgcacgtatggatattaccttcatgttgtgcttacggagtatatgaaattagatacatcaactagaggccaatcaatggtaaataaaagaacaaaatctcctctgaccaacatcctggatagatatggagacatgttgatcatctatattaaggagttcatgtggtcctgctcctctgcctctgtctgaagtttgggtagcctgaaacaatggaattgttaaaactaaacacaagacagtataattagttgaccaacagttgtcgtactgattagttcgccaattccccttgacctttgtcaaatgcaccttcatatgcacaacaatttactcacatagaaattccattgaatatcttgcaaatgaatgaaattgtgaatctaacactacagctaatgatttctagaggaaaagcataatcactgaataaaatgaacccttttttttttcctgagagcaagcataatgtaccttgtttgtgtggatatgttgtttaaccaaaaggagctccaagccaccattgtctagagcctccatattatctagagcactataaccaaaatatgctgtgtactgtttagcagtcccaagtcacataacccaagctgctaggaataaatcataattgagcttaatcattgattttctacttttgtggagtatggaacaaatctacaaataaccaacaaacccattacttgatatgtctatatgtacatatcacgaaacataatgtatatacattaatattccccaaatgaagtcatatccacggtgttttgtgtagtgagcttaatcaagtagctcttggggattagcaccggatcaatagggcatgttgatctgttagtcgatgcagtagttagatgaacacaaccccccacatgaccactcacgggtgaaacataataaagaaccttagggtta

SEQ ID NO: 100876 - DNA, 647 bp, Oryza sativa
atgtgtagaggacggcagactggaccatgtgccgttcggtggatctgatgccgctggtgaggtatggatggctgtgattgatcttgtctttcggcgtgcttaaccagggaataataatggagggaaaaagaagcgggaataggaggcgcacgcgcgccaaaattttgtttttgatggagcggtgcccgtgctcgagattttttttttctatatacatgatcagcgtgttttctatcaaatcgttactcaaatatttagaacccagtacgactcctccatccgaccggtgtaacagcttctgcctgaatttcgtcaagctaaggctgtgtttagatccaaattttggatccaaactgcagtcattttccatcacatcaatctgtcatacacacacaatctttcagtcacatcatctttaatttcaaccaaaattcaaactttgtgctgaactaaacacagcctaaatccagtgcttgctaactttgtctcaatattctgtttttgcgtatatacacacataataaaaggtatagtgacatcgaaaaccataaagtacgaagtatactgtactgtccaatcattgcataaaaataaacatgctaatgtcttgtttagttcgtcgattgaaattagacctagcacttgga

SEQ ID NO: 100877 - DNA, 536 bp, Oryza sativa
ccagtttgccatgagccacgttttctgaaccactaatttcgtgcaaaaactgtatatattttattaaaaatcaaataaattcacttctgtaatttataatagtccatacttaacgatgcgctaatggcatgcctcgtttcacgtggtgctgataagctcagccaaagctttacaattgaacatagtttccaaatgactttttctctgatatgttaccttcattcttaaacagatgacatttttgaacatatgcaagctgtcaaatattaaaggaaaaggtttattctacaaccttgcgcttttaaccatggtttagaaattcaccctgtaactttctaaaccgttcatcctaccgtcataaactgaggtagtgatgtggttttggcttattcagtatagtcccccatccccatgccgttcccctattttcttcttgctcctctcctcactccccttccccactctgcttcagacccccaaccaaagtacccaatcactgtgtctcagatcatccgggtaccgagctcgaattcgcc

SEQ ID NO: 100878 - DNA, 510 bp, Oryza sativa
acggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctgatccaattaaccattattgttatgggctctctaacccgtaacaaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgcttgacgtggcacctacgtggctaatttaattaggtttttggataacgtggcattgtcgtggcatttacgtggcaatttaatttggaaaataataaaaactgttagcctacatgttagt

SEQ ID NO: 100879 - DNA, 657 bp, Oryza sativa
tggtacaattgttaaaaagcgtgggctccacgtgctcttcatgtagctggcatgcgaaaatcacttacaggtatacatgcgaaaatagatttattttttaatgcgggtgagtaaagatgtccgtctgttaaaattgattttttttatatgagtcttttaagtagccgtatataaaaatacatatcgatttttcaggcatgatcattattgttcgcttacaaattataaggggtactcgtacagaaaaatcgtgaatggcatgcggtcaggaggggaagccgagcattactggtgcctctctggacgtctctgccgttcttgtgtgggcgcccggcaatgaggcgtgcagtaaattagccaggcgagtgtggcgaactgacgatgggtatggccctgcagcaagaatggcgggactgcacgagcgcagagagtcggttcgtggagattatcacttcgttcgataattagatgaatgaacatgggatcaataaacagaagggcaataccgttaagggataatttcgttactaccccaatattgattttaccattgttttataaggtttttgtttttagccccactttttccaattgaatgaggtgtttacctatttttgaccgaagggactggagccagattgaggtaaagtaataggg

SEQ ID NO: 100880 - DNA, 632 bp, Oryza sativa
ccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcacccagtcaattgaccatttcaattccttcttttttcagtttccagttaccatcgtatcttatgaaccaagtgtacttccttcactaatataaaaatattcccaatctttttcttagagagaaagtatggagtgaaaaaactataatggcatttattaaata

SEQ ID NO: 100881 - DNA, 516 bp, Oryza sativa
tttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaagttttcttgaatttatggataaatggagatgtgaaaatgtcaagagagaggaacgtcacccaggctggcggc

SEQ ID NO: 100882 - DNA, 738 bp, Oryza sativa
tttaatctcaaacgatttttaaggttaacggtccggtcaatgatttaacggttatagcttcttatcgtatgcctattggcttatctactatcaaaatttaaattttagaacttaattttaagttgagcttaattttttcggtgtttttaagtattattggcttttaaattactaacaacaccctttataaagtgtaactcataaattattttttattgtgtttttttggctaattagccgaagatcaaatgattgattatagacgattattggttcgttttcatttaaaagccatggtttcttccccagtttttccaactcacttctctcgtgttcggcgtgcacacttttcttaatgctaaacgatgctttttttaaaaaaagtttatatatgaaagttattttaaaaaatcatattaatatatattttttaaaaaagtaaataattaattaataataagaaaatatgtcgctctgttttccgtgcgtagagttcctaactaaaaaaacgaacatatctatgtggtaaactgtaatgtacgtatccttgtaaggcagctgtacctattgcctaaacatggcgatcaacaaaataagcacgcacatagcataaagattgacaaggtagtccaataataagcattctgaagtgttgtcattgtaaaacagtcacaaactctcaatactgccaataggtttatatatttattatgcagattagccacgaattagggtacc

SEQ ID NO: 100883 - DNA, 547 bp, Oryza sativa
tgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaagggaacattatatatgactcaaattcatgtaggactaatagaacatttttgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaacctatcacacaggcacacagcgacagtacataactatgcagcatattatgcgat

SEQ ID NO: 100884 - DNA, 772 bp, Oryza sativa
cccctaaagaaaagaagatacctgagtggccctgttttgattctaacttttttcttcgaactttcaacttttccgtcacatcgaactttcctacacacacaaactttcaattttgctgtcacaccgtttcaattttttcaaactttcaattttggcgtggaactaaacacagtgttggtctatggaaaaatggaatctctatgacctggtataaccgtaagtctgtagatgcatgcattcacatggacacggaattttgactttgaaatttttgtcaccgacaacgtttggaaaaaagattgacagcgaacctgttcaagctttcctttactcacggtaatcaggtctgccaagtatttttttttcttggttataagcgtgtcctcgtggctagtttagcaagctcttcggatttcttctactcctacttgtaactagctgcgcggctaacaacaatacagagttatctattttttaatatgattttacttaaaatttgttaaatcgctatttcattgtcttacgattttgaaagaccaaaccttatcatcctcatgttttaattttatgattcttaaaaatcacgtcagatgctaccccttactttttttgtcacaccttctttatatgcttccccgatctacatgcttatatttattctccttgaaacatttaaaaattggatcctgtagtttttatagtttatggtctcattaggtttcttttttataatttttaaaagtcacgtcaaacgtcgtagagcacaccttta

SEQ ID NO: 100885 - DNA, 706 bp, Oryza sativa
tatgaacctatagggtcgcacgcttaatgggccggaataagggaattggatagagatccaatatgagcttaattcggataaggatccgaataggagtcctacgggccttggaggcccgagtgatggatcctatatattcgtgaggggtgtgaccggcggaggtattgcatcacgtgagaaaccctagccgttacttccctccccgagcaaaaccctagccgcgcgcgggtgctagcacatctgcgcgtggcgttccgtctctgtacgtgtggataccggtagaggcgccgctggtttgcggtgctgatcggtgcgagagtacggcgaggagaacgcacgaggaggagaaggtcgagccggtgcgatcgacgcgcgctacttcgcgagagttccttcgacttctcaacgtctttttccgctgcacagcgcgtcgagtggtagtgatctatgatctaatacttgcatggttcccggtttacgcgatagaaaattttgatttatgctatcatagcctacgcgtatcccaacagaaatgttacagcagcatggattcatgcagcatgaatttctgtcaaaaattgatcggcagggagtaaatttctcgaacagcttttgtaccaacttgaagaaaacactactacagtagtagaacaccacaaaactactatagatgctggaaatgctagaaccggcacctataacgttt

SEQ ID NO: 100886 - DNA, 571 bp, Oryza sativa
aattcgagctcggtacccattcagagaagagaagaaaaaaaaatgaaagctaagctcaggggtcctcagtgatgcacgagaggtgcggttgtcacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcaactgttgggggg

SEQ ID NO: 100887 - DNA, 734 bp, Oryza sativa
aagaaaggcactaaaaacctttgcttttccacatcaaggtgaaagcgagatgcatctttatccaactggatactggagaactagtagagactaataactagtggcagcagcagaaagcaccaaacaagcaccccaaccaaacaaggcagaatccacccaccccaaaaacgaatttaaaggaggaaaaaaaataaaggaagctaacgcaacgtagaatctaattagcattgttcctctcactctcaggcacaaatcagattcttccaggagtcaaaggctctctctcaaagctttggctttcggttcacatggtgacatggttcagattcctcgtgtgagccagggaggagtcgacacggcggctgagagcactgagcagaatcgcaactcgctctgccggagattccaagtgccacaccaaagatactatttctctcctagtagtagtgcattctcctgcatggctgcaactatggacggctacccggctctatctttgcctttggtttttctctcgctttctcactgcttgcactagcatattaatttggtgattgatctgaatcagctgcatgcgttggccgtgacgaattcagaaaattgagggtcatacacataccaatggtctaaattgagcaatattgtatttaatgtagcctaaaacaacaacgagaaatggacattctacccggtgtcttgtgcgctaggtagtgtaccaccatgtataaccatgt

SEQ ID NO: 100888 - DNA, 564 bp, Oryza sativa
tcgagctcggtacccaatatccttggcatcaacctccgccggtcgtcaacgtgggactagggatggcaattgtgcccgtttgcccgtttacccgcgggtaaaaaccctattagggttgggtttgttctccattttatacccatgggtatcttattgggtcaaaagctatgcccgatgagtaaatgggcatgggtatgggtaatcactacccatgcccgctttgcccgtttacccacgaaatctaacttatatgtaggctaggagcaaaatccactagaatacataagcccagttctttgatttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcaatgggcataggtaaccatccttacccgtcatgtagtaatgggtatacccacgagcacaaataatctcacgggcatgggt

SEQ ID NO: 100889 - DNA, 708 bp, Oryza sativa
tgtactacctccgtctccatctaatcctaggttatataacatttttggatggaggaagtattatcttagcatgaacacaactgcacaaggcacaaggcacatattatcttagcatgagcacaaagcacatatacctggtcatacatggcatgccgtagtcatgcccttcaagtccaaactgaaagttaatgaaaagcttcggaagattttcagctaaaaatttttctcctgtcattctagctggttgaggtgcacgctttcgatctatgtggacttgcttagctatgtaatctctttctactctcaatttcaaaataaattaacccagtacgagatataatatatcctattgccatgtaaagagatctcgtactaggttaacttatttgggacgaagggattattacagtacatttcagtgtgttacattgatcacacgtggactcggatcaatcaacgccccacatcggtggatgaaatagtaaccatacacaagtatgcttagaaataatttggcagctctaaaagagtgatacatacacgcgaagagccagactttgaacatgttcccacctaaattggactcatttcatcccaatcacatatatatttctttatctgtggatatactccaccccattacttgtccttgttttgcatattaagaatttcgaatagtttaagtaagaatatagtgggcgaattggc

SEQ ID NO: 100890 - DNA, 805 bp, Oryza sativa
gaggtgcgtgtttgttttattttttgtagctctttgttttgaattaggaaagtttcatgtatgccactgaaattgtgatttgtttatccatctatatctccaaagttttgcattaatgttatatggcattctttactaattaatccttgttttctttaaatgtctcattttaaaaagaaaattttatgcgagaacttcagtatttgaaactttggaagtcttaacttttcaagcataaatctgaattttaaattccccggatcccttatttttggtttggaaattcaagaattcaaaatcaaggttgagacatgaaattccatattttaaaatattccttttcttttcaaattcgtgttattttggtagtttgacaattgtaattttagttttatttctaaatatctgaatggaatacttaaatcttagttatagctagcactacaatattaaaagattcatcgatacggtacaagtgaacaatggaaaattcaactattgtctaaatttaagtgttgtggaaatttccgtttgtgtatgttatggtttagcatgtcctgttttctttctgaatgtgactcccgtgtttgcttcctctatatcatttatattcttctttttacttactttctcatctcttactgttcaagttatttgaatccctccggttgcgtggtaaagttggtttgtcttaattgatcaggcagttattttgaatgtacagatctaagatcgtttgattcccctacttagtggtgattccagttacggagttaccattatcagcaacaatattttaaaagtt

SEQ ID NO: 100891 - DNA, 540 bp, Oryza sativa
agagagagaatgagagatagaagagatagaagagagagataaactgacaggtggggcccacctattttttaataaataaattgctgactggaccgccagaccaaaaccaccgcggatttgggtcgaggggggtaattcgtccggtttacatagttcagggtgaaaaatgtccggttttgtggttagggggggtaattcgggatactgctatagttcggagggtaattcgtactttttccttatttttttttaatggagtagactttgcaaggcatggaaatgaccgagggttatccatccttttcttgatgctcaatttaatcctttggccatcaggtcagtaggtggttgccctacgtacgtattcttctgatactgacatgcgtatgatcaatacagcttaacgtcatttttcgcgtcagtaatcgatcattagtgctagtaccatgtgtcatcattcgattagtagttagttgcatttattcagcgattagttgcttataaaatagtacttacactgtgacagtaacctagtagttg

SEQ ID NO: 100892 - DNA, 503 bp, Oryza sativa
ttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggt

SEQ ID NO: 100893 - DNA, 550 bp, Oryza sativa
gatccagcatctacaaactgagttatcagtcagatacctattggtgacccttactgagcaagacattggcaatggagtaataaaattattactgaacttgttcactttgccactgtagcttaaatacaatattacaataccatgtcattccttacaaggatattgatcacaaataattatagtagaatacaactgtcattctatcaactcacatgggctacacatacatgctgcaagtatacaggaagtgaaacatgcaaaaactcttctctggactgaactacgtaacataacacttcgtagaaaatatgtgataactcaacactccatgttacatatatagctagcgtggcaaactgactgaggatgataattcttgctccaaactgtagcaactggagatcccttcatatgataaatcacctgcactggtatagttgttctgtgcttgggatttaccaggtatctgggcttaaaaggtgctgaatctctccaccaattcctgggacggggagaaattggaattttcttagcctcttagttctcagga

SEQ ID NO: 100894 - DNA, 603 bp, Oryza sativa
atagcctaaagaatccgataacattttgatagttgggaacattgttttctagtttttcttttagaactcatgcactttatttgtttgaaagttttaaaaacacaagcaagagtgattcttacatctccttttcttgatcggacatacactttgttggcaaatatgagtactattactacagtcaaaggccatctgattttgctctgaagtttgtctagttgctctcgcaggaccatcagcaaccttgttcatttctctaggaatccatttgatttgatttgcatatgttgaccctacagaatgttatttattttgtaaaatgcaggccttagggtccaatgtcctagctcattgatgaagtcatctattcgaattgcttcggccaccgtctgtcatcagatagaaatataggttgatgataatgatgaatatttggagcttcagacagaccttatatttctgtaacaagaggagctcctgctttggagctgtcttcttcgagggatgtgaataaaattccaagcggccttttttccttctcctttcttctgcgacaacctttttcggcttttcctctcagaaacaaagctcacaacttatgcg

SEQ ID NO: 100895 - DNA, 635 bp, Oryza sativa
cttgtgaaataagtggtctgtgcctttaaacatctcaaagaaaaaaaaatacagtgttttaagatgagcctaatacacagtagataatggcaaaaaaaattaataccttatagggtatgctttggtcttgcatgtcatttaaatagttatctatatttttaaaaaaattaacagagatttatttggatgatacgtaagaaataaggagatgtccattttgagggaccaaggctccgttcatttggtctgttagggatgccacttgtttttttagccgcttcccaaactgttaaatgatgtatattatgaaaagttttaaagcttctttaaaaaaaatctaataaaaccatttgtcatatttatagtaattaatactcccttcgtttcatattataaatcatctagttaaaccttttaagtaaagggtttgactaagtttataaaaaaaaactagcaacatgtaaaaaaaattaatttcattaaatactacattaaagatattttaataatgtgtttgttttgttttaaaatattgctatattttttataaacttgattaaatttaaaaaggtagaatagaaaaaaaattcaaaacaacaatactatgaaaatggagaaagtattcaattaacctg

SEQ ID NO: 100896 - DNA, 594 bp, Oryza sativa
tttttctgtagatgtccatgcatatattatttgcctgattccgagtccgtatgagaaagttacgcctattttaatagatgacatattttgtccgtttcggtagagttttggaaaattctacatgtcacatattttgtccgtttgagtttattttttatacggttggttcctatgttctcctaagtgtgaaaaaaatatcaaaaaaatgaaacaaaaataaaaaattatatctctatgtactgtttaacttatatatgtcatttaatgtggttatattttgaattagattaagtaatttcatatagtggtagagtgcattatgtttaacatgctgatcaaagggttttactaaaggagttatggtctaattttagtgaaggtgcaaagtagactaagtgggtatgctagatattttcagacttagctaagtggtagttcgagtttaaattttttttttgtggttggttgtatcgtgatcctgagtgtgaaaaaacatccgaaaaaataaaataaaaatgacaccgttgtaactccatacagaaaaacaggatggaggcggcggcgccagcatgctggcgccctcctccctggggc

SEQ ID NO: 100897 - DNA, 597 bp, Oryza sativa
ccaatacaagttcaaaatcagcttacataagtagaaatgaaaacgacaaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggagg

SEQ ID NO: 100898 - DNA, 520 bp, Oryza sativa
ggttaggtcaggtggtggttggggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaa

SEQ ID NO: 100899 - DNA, 586 bp, Oryza sativa
atcccccagcgtacttgccaaatgcaacctggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttatttgccgctacacttcgtagtggcaggttcatttatactcggaataagatcactttgactccctcaactgaccaccgaatctaaatcgtatccctcaatcgcaatactagaaatctcgaccccctgaacttgcaaaaccggtgcaatttgactccctcaccggttttgggaggtggtttcgccgatgtagcgccatgtggcgcctatgtggtgatattgaccgagtcttcggtccacgtggcattgacgtggcacttacgtggcattagaattataaaaatgcgtggga

SEQ ID NO: 100900 - DNA, 603 bp, Oryza sativa
atacgaaatttctcctataggataaaaatccccacaattttaatgtttttcctccaaatcgaaggatctctttttcgtatatgcctcaagcgattttggtgaagccattgctacaactttcttttttcatggtttcacccaatgatggagttcgagaaccctttgaatcgcaggaatgacaaaacgtcagggttttaaatatcccgctatagctgcgctatctcccgttgtagctgtttgagaaggattctagctatttgctctcatgtacaatttagccgctatagctccatttagctagctatagctgccgttatagctgtttaaaaagcaacatgctaaatgccttagcccgctatttaaaacattggaaaatgtaggaataggaaaaacgtaggattttgatatgaatgtaagtgtaaaacagagaattgtaaaacacaagtatggttgtttgattggaacgcatgaaaaatacaggaattacaggagagataaagactcaaaggaaagtttccccgaggttaaacctcatgtaaaaaaaaatccggaacttgcaaggcattaggcattccataggaatttcataggattccgggggat

SEQ ID NO: 100901 - DNA, 623 bp, Oryza sativa
tactgggcagcaatgaagagagcaatggagatgttttgcaagaagatggggcttttggtgtaaatgacaaaaatgatatatctattcatgattatcttccagcaatgaaagccatatgcgataaactagaagaagctagtggaaaggtcaactgttccttcttttcttttccatttggtattctcctggattttattttttctctatagttttctaactctctgctattatttcatcgatagactcttgttgtttcggatataaaagtagatctcaattacaggatgacatatgggcacagagcatggagaaatgtaagtttgctcagaatcacttactgcatatgctctctagtttctgctcttctggttttcctccttatagggtattactgagacactgtttgcttaggtactgcataggctaagagacgcacaacttattgaagaatttgatgccaaagttgatgataaggtgacattaatctttcctcctgttctgttggcattttcaattaataatgtatgctctattcagtaatagttttgggcttgtcagtgcttcctgtcaggaactggaaattagaaaagactttataaattaccatgtccatatgtacccct

SEQ ID NO: 100902 - DNA, 533 bp, Oryza sativa
tccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaa

SEQ ID NO: 100903 - DNA, 599 bp, Oryza sativa
tttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccct

SEQ ID NO: 100904 - DNA, 604 bp, Oryza sativa
aattttatttttctttcgccgactaccaatgtatcatgcctctgtcaatactccaataccggagattattgttgtgttcgttcgtactgaagatgaaaatgaaggaaaaaaactattaccatataattaattgagttttaattattataagtttgtaaaaagatttacctaatatttttaagctttatctatatacaaagttcttgtacgaaatacatcgtttagcagtttaaaatgtgctaatggaaacaacataaaagatatactccctacatttcaggttacaagatgttttgactttggtcaaagtcaaactactttaagtttaactaaatttatagacaaatatagtaatatttacgttaccaaattagatttattaaattaataattaaatatatttttataataaatttatcttgggtcgaaaatattactatttttttctataaacttagctaaacttaaagcagtttaactttgatgaaagttaaaatatcttataacctgaattataatatctcaagcagcgatcaatgattcgatggcaattgcgtggcaaagaaactgagaaatcacacaaagttgtggtcactcacgcttg

SEQ ID NO: 100905 - DNA, 571 bp, Oryza sativa
cttgattaggggtgtgcattcctgtagtcgaattgtttgttttgttgggagttggctttgccgttccttgtcgaaagcgatgcttgcgtgatggcacactcagttcatgttgtgacaattcttccttctttcaaaattttggcccttggattaatagtaaatctttcatttgtgattttctttgaatagggtgctgcattttgatcaatacacttagcctaggaatgcattagtgtttacttccttaaatagttttatgtatcagtttattgcacatcactgtgcctggtttaggcaaatattgttcttgatgtaaaaaagtgttttttttaaaaaaatatttttaggtgttatttgcaacccttgtatgcaccaagttgaaattgtatttcctatctgggctattgcagtgccccttgaagaattaaaccacagttactgctgcaaattactgaatgcatcatttgttcagacttctgacttccaattcacaaattattttgcagaagatagtattcaagtgggttcatcaagataatttgtttgcagtgtgctggagatagtgtggtct

SEQ ID NO: 100906 - DNA, 645 bp, Oryza sativa
taaagatttaaaaaggtatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttaaagaatgttggttgggtgcttgcaggtaaggatgatgatgttaaaggttatagcgaggactattgggctgcatcacttggttttgttgaacttctatccatatcttcaaagatacgttcacgtatgttcttaacttggcatgtgttcttcttgtagcaaccttatggtagatataatgtttatctatactctatactaatataaaagatggtagtggtggtggacccacggactgtgagttgcgtatctcttaacccccacatgccatatatcccgtcgaaaggaaaatatgacaatagaatattatgaaaattttcatctttacgaaatgacagcaaaattagcataatgattatataatagacaattagaaaaaaaaacccgtgcacctcacgtgcattatactaagtcatactaattttgataataa

SEQ ID NO: 100907 - DNA, 571 bp, Oryza sativa
ggcttttagtcctacaagtctagatagcgtatgtatccatggttgtaaaaaaaaaagaaaaaaaagaaagaagaagcttcagaatcgatcccactattgaggaaaaatacaataatattattttctatatcaagtaaacccgtgcatattaccattacatgcaacacagacaaaatgcattcagaaatacgtctcattgcaaagaaaactatagaatgttaacatccaaatttaacatctaagcacgaaataggaaatcattcgaatttggaaaggactgagttttcttcttggtgatagtcagaccgaagcctatgggctagtctgactagctggtggtgtgcagtggggctggtcggacagactgtatgtagctggtcagactagctaagttcggttccaagtcgaatttcatcaggtctagagttttcttgcctgcactgaggtttttcgagttctacttgatctctaccacaagtaaaacatggagaagaccatgcagaacagcagaaagcaagactaacccctttgtaagagctatgaccggtataatcgagcacacattctactt

SEQ ID NO: 100908 - DNA, 608 bp, Oryza sativa
acaaataatttatcttgcgtcccgcgtatccacactctcttatatcagatcctttgtagttctaaaaaaaaaatcagctcctttgtgacgtggtgtttttaagattggtttacacgtggctcacaaagtaaaacaggaatggattttacaatctatggtgacgataatatcatttattagtcaatggctagatatttttggctaacgtggggatttctgcaaagtgttcaattaatataggtatagatagataaatagatagattagttttgtagatctgattgaatgttttttctatttacagaatgagctacttccatctgtcctgacgatttataattgcagggaaaatgataaaatgttgcttccagatttaaaattattttttactaaatgaaaccaatgaaaagttcagttagaaaattttattatgacttgaaattatttgctgaccaatgaaaagttcaagacaaattcaatgttatgtttcctctatgatcatttcctgactaaccgtgatataatttaggactattattccgcatgtttaattccttcgtcgcattactctccccttctcgctctccttggctaagctaggatcgatc

SEQ ID NO: 100909 - DNA, 637 bp, Oryza sativa
ggatcgatgatcgatctgttccataataatagacgacgattatgtacagtcttcattacgcatgttcgcattggattattgctccacgattatgatgctcatgctgagtcattcacaaatcgcaaccacgatgcctatcgtcttgggctcttggccgacatctccggggtaaaaaaatttgtaccagagcattgaccacaagctaaattaagttccgatcggttaagtttatcccagatgtggttgatgtggttattggggaccacttgtacgaattatcttttatagtggagcctgacaatgggtctgacgagcctgtaccaatggatatggagaatctggatgatgggactttggagaaggaggaggggaatctgaaccaggatttggggaaggaatctggaggtgatcctggtaacaattccttaataggttctggtggtcaggttagtgagaggggtggtccttctataccggctgctcatttgagtctgatacctgaatctgatggcttgaatgtatctgatgaggaatttgatggcttagatgaggattctgtaatggttaagaaggttaatacccagcaaagtctaggggaaaagctcgctgctattcttgaagcagtaatttctctctc

SEQ ID NO: 100910 - DNA, 635 bp, Oryza sativa
ccggcagtggtcgggaaagggaaaaagaaggggaaaaaggggcttggtctcttgccataatgaggagagggagagtgaggaggaggaggagagggagagcagctgcttctcccactcttggacgggtgcggcgtggagtggcgggggggccatggatgacgtcgacgatgacggcggcggtcggtttggcatggagcgggggcaaggcggcagcgcatggcgtcggcagcgaccggccggtcggccacctcgcgaggcgcgcgcggtaatgggcgaaggcggtggaggttttgggcggcgacggcgggaagcggtgtcggcgcgagagtgaaaccgagagggagagagaaaacgagagagagagaaggaagacgagagagcgagagaaacagagagagcgagcgacggctctctctctcggctcgcatgcgtgcaacgcacgtgcgagggggaaagatgatgggctgggaggggagatgggccgggggagaaaatcggtccatccaaaaatacagggaggtaaagtagacttttacagagacaaccgatttggatagaattgtagatgtttagggtttggattcgaattcaaatttgacattcgaacttgagggtttagggatgtatcaagggaa

SEQ ID NO: 100911 - DNA, 686 bp, Oryza sativa
ctaaaagaatattcgcaaccaactctgaatggggtaggagatgatgagatatctcatgttcctaccaccagaacagaacaaatgatattatacatgattgtttcatcatgaggttgatttttcctttttcagcttgccatcagtatttagattcgtgctgcttatgtttatcagagtaagcttttccatgttagagtagtttttattttctacttttatggctgacagggcctttgatttggtcccggtctaggtctagctattagcttgcttgatctgatcaaacaaatcaatttctttgttcccttggaagcctgtatgcaagtttatggaaattgaattgtgcctcactacctcccaccatatcgtgcgctttcagcttgaaccatgaaaccaacactatattcatggtcccaatgccccaatgctaattttatttttgtgtgcctgttcttttggttacccacacattccctggtgtggttctcatcaatcaaggtatagattttaatatgaatctaaaacactgaatgggacctcaaaactaaccaactatatggtattataaatttaatacattgaacaatcccctattagtgtaatacttctttatcataagactaattccatttccaatgctgcagaaatcatggcatctatggaagacattggaagtgcattaatcc

SEQ ID NO: 100912 - DNA, 2117 bp, Oryza sativa
gacatagtgctctactagttcttacttttgtgcctagtgtatatctgatttgttataatgaattctctagatctgttcagaatatttattctgacttacgatattgtattgttgtttttatgtatcaagctaattatttcagaacaatatacttggaaaactgtaaatatgactcatttgctcttttctgtttatatttcaatacatcgaaacccatataagactggataaatattaataagacacttctgcctagataaaatcctttgctctgtctctgacaagctatgaaaaaaattgatcgaaataatgtgtaaaaattatatttatgttcctagcaattaaaaacaaatgatagaaaataaactataatgaaaatcatctataaaaaaaattggttgtaactgataaggcaacagcaaaagataagaggttaaacgattatttgattggcggagtgataattacatggtaaattttaaccaaaataatatctgacaggaagaaactctaggacttgtttagtttattgccatttcaaaccttcccaaaaattttgtaatggcaaaatatggcatttgttattttttggtaagaagttactgtttagtttgatgccaaaaatttgccaagtgcttaggttctcatttttagggcatgtataacggtttttattaatggtctctttattgtcatgcaagtaaatttgatgacatggaagaaagagaaatgagtatggttgttatgcatgacaacggttcagagtcgactcttagcatttattagagcaaattttgttgcattgtggtgaaagtaaggaaagaagagaaagaaaacgtatttttatacattaatgattagagaccatattgtctttaactgttgtaagatgttagtctctagataacgtagagctcatatctgactctacctttgtacatgcccttatattgttgtagtgtagcaaccaaatacattttttttggaagggggcattgctttttttttaatggtaattttgagcatcaaacaaaatatgcccctattgtcgcgagtcatgactcgtaataaaaacactattgaacaaacaatctcgctagtaaggaaactttttttataaaccaattggcacgctttattaatatgtaaacatagtcgcatcgttttctagaacattcagcaagaaaataggagccaaaaaacccaattacaagaaatcttcaactttaaaaggatgattagctagaacatatgccacacaattttaatgctcggagagtcggagactttaacaaaatcatatatcaaaatatagcattcatgtaaaatcgttgctgacgttattgttgaaacgcctccatcttgcatcgtctccaccaccttgagaattttttcaggaatttattactcccttcacttcatttcaaaatgtttgacaccgttgactttttagtatgtgtttgaccattcgtcttatttaaaaaaattaattatttatttattcttttcatattatttgatttattgttaaatatactttcatgtacacgtatagttttacatatttcacaatttttttaaataagacgaacggttaaatatgtgttaaaaagttaatagtgttaaacattttgaaacgaatggagtactagttaatatggcaacttgcttttacgttccttccagtcattttcaatttcaataaatttataagttgtactactttggtacaaattcaatattggaccgttccactagtaggccaacctaactgcacctaaccaaaaataggaccaggttttggacggaccgtttactttgttgtcctgatcttagaataagatcactttgactccctcaactaaccaccgaatctaaatcgtatccctcaagcgcactaccagaaatcttaacccccgaactatcaaaatcgatacaatttgactctcttggtggttttggatagcggattcgctgacttggcacacacgtggcagtgtagacttggtgttcatcccacatagcattgacgtggcgcttatgtggcatttaaattaaaaaatatatgggggtgccaattggtattaacacacacaaaaaatgagggtgccacatgt

SEQ ID NO: 100913 - DNA, 1426 bp, Oryza sativa
aaagaagaaagaaattaagtttcaacttaagatcatcgggttaacaagtgacctgtcagccacacctcgattgagatattctatattttttatacgattacaaagcagacgctcataaacacacagcactacacacgtaagatcgctctcacaccccctatgcacgtagacggaaatgaaatactacattcacactccctaatacacgatctaaagaggcggaactagtggcacatccctaatctcagtaaaatcttgttaaaagccccctacatatgtgtaatatttataaacattaaaatttgaacctggtgaatgaaagcatgcacatataactctaccaccacactactaatactttcctatatattttgtatacctctatagtgaacacgattttgcatatatcgtgctacgatgtagttttatccgtttctatgtaagatgactggattgtcgaagaacaaaggggttgtttggttcgatgccgttggtagccagccaggttgtggcgctgccacaattttatggcgaaggaaaggctcgccgcacttgtggcgaaaactatcacataaatgaaatgtaacgtggtgtggctgcctcaacttacgtgggaaccaaacaatagcctattttgcgtggctaccgcattaaaggcttggcgaagtctggcggggaaccaaacagccccaaaatgtctcagataccaagcgaagtctcagattacgaattatccaaagggcaaaagacatgcaaaaataataatatcataatattgtactactcaataaccaacaaaacataccaattttatagtatccgcaaaaataaaagccctagttagaaaacaatttcaccgtgtgcgtatcactcatagtgttttattatgcaattttctcacatggatgcacgtggttttcaagaggcgcctacaaatcgagcgttcgatttttgtttgaaaaaatcgggtgatgttccaacaagtagatcagaagtttttcactaagttgatcgaacatgttttaatcgttttaaaagttgaaacacaaccaacccaccttctaaaacattttgctacaacataggaaataacaatttttaagctatttcaccatatataaaaataatattttagcaaacagagaaatgatgtttcaattcactgcaacatttgatttatacatagtgacatgaatatacttgctgaaacattattggtggaagaaaaaataaaacggattctcttaatagagcatttccataatatatgggtgatttattgcaacggtgcgtgtggtggagcgcatagtgaggacgacgtggatgcttttttgggcgaggcgcgatgggaggagcgggcgcctgatgcatgcatgcccgtatcggatgcccgatataaaaaaatttcgtggttttcatcttgatt

SEQ ID NO: 100914 - DNA, 983 bp, Oryza sativa
actacagtagctgcatatacttgcatgttgcatccatccgtttctccaatacgaggtggtttttttgtgctttgatccaaagagagtggtggctactagctttgctgtgtactgcatggtacagaagtaaggcttgggacgggacggaagtaaggcttggtacagtaatagtttttgaaaccacgtaattatacgatttttacagtgaccgccaaaaacgataaccccaacacaaaagatttgataaacactgcgaggcagcagcgtagcagctgctgctggtgaatgcatgagctgctgcaatggcaatgctgcgtgatcttgcttgggcctgtttagttccaaagttttttttctaaatttttaaattttctcacatcaaacctttcatacacatacaattttttttctacatcttatctagtggagtactctcctagtggagtggtgtactcctacctgcgaaatcaatgggagtacgaatactgggctaagtgcatgcgtgcagtggcaaatgcaaatgcagtgcagtgcagccggttgggttggggcagggtgaccacgaaaaatctgggagtcgcagagtgaccacaaaagatctgtgcgtcatgttccatttgaccgctgagttgatgcgtgtactattcgctcagatttgaggggggtgtttgggcctgtttggtttccaggacttatttcaagtccatgtcatatcggatatttggatactaatttggagtattaaacatacactaattacaaaacacattccatatctttggactaattcacgagacgaatattttgagtctaattatgtcatgattttgacaatgtgatgctacagtaaactttttataattatagattaattaggcttaaaaaattcgtctcgcggattagctcttatttatgaaattagtttttttattagtctgtttaatactccaaattagtgttcaacatccgatgtgacatgggct

SEQ ID NO: 100915 - DNA, 700 bp, Oryza sativa
taatcatgttacttatcaaaggtcttttcagtcttccgttatgagaatgtgagtataaccccaccaggattagatttaattctctttataagatgtaattttttgcactatctatctatctatcaggctatagttcatccagacgttggacaaagccctcctcatgaaatttccattctcttctgtctctagctgtcctagtcaaagcggccgttcccatgtatgatgttaggtcatctctccatcttctcttctaccttcctcttcttctctttcccatccttggttgccattctgttaaacgatttgtccatctattgtccttaagtcttgctacatgcccagcccatctccactttgattatctgactttctccatgatatctttaacctttgttttctggcgtatgactttgtgattaattttgtctcccagagataaatgcgacatctttctctccatagctcgttgagtagtcacaagcttctgttctaggtcctttgtcaatgaccatgtttctgatccatatgtcatagttgttagaatgcattggtttaacattcttcttcttagagacatgggtatgtttttatctgtcaacatgtctttgtatcttccaaagttcatccatcctgcttttactctcatcataacttcttcttttgtggtgtcctccattttcaaagtttggggctgcag

SEQ ID NO: 100916 - DNA, 748 bp, Oryza sativa
cggccgctctattctagtggatcccccttcaaaattttccgtccgtacgtgtccccgcgcgcggtgcgcgcgctcacaacgcgcggaaaagatcaaattcaatttgtttacatgatttagattcctcttaccgtaaatgacaatttacattaatttcagtcactcttgacctttcataaggccgtgagcgcgcgtcaaagttcaaattccgcgcgtgctgctatgggcaatataatgtaaatttgatcaaaaacatgctactttataaatcgaaatagctcttcagatagtccgtcgacccccattttttatatcatggtcggaaagagcatgagttaaagatatgatttcataccaccctgactcgtacaaagtgaaacaaaatcttcatatttgcatctaaactaaagaaaatgtattttgttgatgacgtcatttttgtctttgtttaattgagattatctcgcttatcagtgatcgattttctcccatatttcgatatgttgtagctgagataattctctatcacaaatatgtcatttatttttcatttagatgacgtcatcatagttaaatattcgattaaaggcgcgatgcataatttgtcatatttgcgtgttatgtctatggaaggtcacttatttcaaaacatgaatctgcatgacaatgtgttttgaccagtatctcggttgttatacaacagttttctcccaaattttagtatgttgtcgctgagactatatgttat

SEQ ID NO: 100917 - DNA, 529 bp, Oryza sativa
atccagtctatagcacgacatgcaccaccacccgaaaacttcctctgctcggactcgccgctggcgctactccgatgtctgctgtctgagaaatgtataggaatggaatcgcaatatcatgcccttcattttctattttggtcgcaaccccaacggagtcaccgtttgtcgccgacaccggcgagcagagatgccgcccatggctgctctgctgcttatcgaatggaaaaggagacagggacctcgcttggagaatttaaacaactataaggttcattatgtaatgttttcactcaatgacatatgggcctaggactgcgggttttttactgaaactctaggggtctttttgcatattggcctgggactgacaatgcacacctaggaacaaaatctgaaattataaaagaacagtaactaaaacttgtaaaatccatataaaattaaatatagctcattttaagatgattcaaatttctgtgaactcaccaaattgggaactttgatgttatggaacaaaacttgcact

SEQ ID NO: 100918 - DNA, 671 bp, Oryza sativa
ctccttcgtgtgctaatattttcattaattgacaaaagttcaccgcgcgaatcacgaagtgagtttttaccacgaaatcacccaatacactgcaatatagccaaaaatcatgttttggcattttttgaactttttgattccggtaaaaaacaacgcttcttcgtgtgccaatattggcattaattgacaaaacttcgccgcgcgaatcacgaagtgagtttttgctatgaacgcacccaatacactccaatatatccaaaagtcatgttttggcgctttttgaactttttcattccggtcaaaaacattgcacccgtttcggccaaaatatgccaatattggcattagttgacaaaagtttgccgcgcgaatcacgcagtaagtttttgccacgaacgcacccagtacactcgaacatagccaaaaatcatgttttggcgttttttgaactttttgattgcggtgaaaaacatcgcaccctcgtgtgccaatattggcattaattgacaaaagtttaccgcgcgaatcacatagtgagtttttgccacgtacgtacccaatatactccaatatatccaaaaatcatgttttggcgttttttgaactttttgattcagtcaaaaacaacgcaccctccggtgccaatattggcattaattgacaaaagttcg

SEQ ID NO: 100919 - DNA, 623 bp, Oryza sativa
ggtaggtaatgatggttgcgacggttggaatggtcggtaataccatccacccgtcattggggatcaatcccagccatccatccaaaccctgcatccatcggcgccacgggaggttcagccaaaccccccgagacatgggttggctcaacccagcccatcttcgactggcggcctcctttgttgtcctccttcgtagacttgtgaattttggcccaatatgttgtgttatttctaagttcttgacccattcatacataagtctggttcttgacaccgtccgattgatttatcgtctgagttgatgtcgattctcctccactttattgtcattctctacaaaaggttactgtacctaatactagtggaatattattattttaacagatatatgcattgcaagcatcactagttctcctcaattttggttatattgacggtcgcaactgatcgataacgaccgtcaacaccgattcacagctagtcgatttggctttccagtgattgattgggtcgataagagagaaattttcatcacaagactttgagagcttagcacatctggctcagaagggaacggctcatgagcaacgttttcaggaggccaagaaggtcaagaaggttaa

SEQ ID NO: 100920 - DNA, 607 bp, Oryza sativa
caaatatacttacattatgataactatagagataaaatttcagttgcatattaatctaactctatacatgaaatatcaagctccgtgcaaaactgcggggacaatcccctagttttaaaataaaccaatgtaattatcaaggaaaatcatagttaaaagggtggttttatatatttatatatattataatgtgaaaaaaaatataatcccgcagattatgttttcttttttcagtgtatatcatacagttgaattttttttaactttttagtaatatttcgttgtcttaatgtttctaccattactttgttagttgttctgttttttcagttgtttgttcatttttatcgtgaatatagctaaagttttgcatgtaatcacatcccaatcaatgcgatgttaaatcttaatcaaatttcttttatcctgcctgtattctcatctattaagtatagaacatgctaattttttctatctcacaaatcgcacatgatatttatcatcagttacaattgaaatttcttcgctacctttttttttttgcaaaaatttttcatttgtagactttcgaacaaaccaaacatgctagagaagctaaatattgcag

SEQ ID NO: 100921 - DNA, 586 bp, Oryza sativa
ttttggcccaaacgggtactatgtttttgactggaatgaaaaagttcaaaaagcagcaaaacaagatttttggacatattggagtgtaaaaggtccgttcgtggcaaaaactcacttcttgattcgcgcggcgaacttttgtcaattaatgccaatgttggcacaagagggtgcgatgtttttgaccggaatcaaaaagttcaaaaaacgccaaaacatgatttctggacatattggagtgtattgggtgcgttcatagcaaaaactcacttcgtgattcgcgcggcaaacttttgtcaattaatgccaatattggcacacgagggtgcgatgtttttgaccggaatcaaaaagttcaaaaaacgccaaaacatgatttttgaacatattggagtgtattgggtgcgttcgtggcaaaaattcacttcgtgattcacgcggcgaacttttgtcaattaatgccaatattggcacacgagggtacgatgtttttgaccggaatcaaaaagttcaaaaaatgccaaaacatgatttttggacatattggagtgtattgggtgcgtacgtggcaaaaactcacttcgtg

SEQ ID NO: 100922 - DNA, 650 bp, Oryza sativa
ttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatca

SEQ ID NO: 100923 - DNA, 1039 bp, Oryza sativa
tcatggttccactagtatgaatttaggtagatgcttcgctgattaattaggcaacattaggtggttttataactttagactttgggaattctcaaatcacttggatactatgaaatggttggcttatggtggaattggacatacccctctcttcctctttcaaaacccctaaaacatgttttctggtggggtattgtatgcatgccagttatgggaagtagcaccccggccaatataaggattaagctcgggcctctgttgcaaagcactaccgtactaaccacatgtctaatgggtaaggcttaactcggtgctcagtctagtcctgaacaataattgacaaaagttcgccgcgcaaataacgaagtgagtttttgccacgaacgcacgcaacacactccaatatatccaaaaatcttgttttggcgttttttgaactttttgattcctttcaaaaacatcgcaccctcgtgtgccaacattggcattaattgataaacgttcgccgcgcgaatcacgaagtgaatttttgctatcaacgcacccaatacactccaatatgtccaaaaatcatgttttggcactttttgaacttttcaaaagttcgccgcgcaaatcacgaagtgagtttttgccacgaacgcacccaatacactccaatacgtccaaaaatcatgttttggcgttttttgaactttttgattccggtcaaaaacatcgcacccttgtgtgccaatttttccattaattgacaaaagttcgccgcgcgaatcataaagtcggtttttgccacgaacgcacgcaacacacttcaatatgtccaaaaattttgttttggcgttttttgaactttttgattccggtcaaaaacatcgcaccctcgtgtgccaacattggcattaattgacaaaagttcgccgcgcgaatcacggagtgaatttttgctatgaacgcacccaatacactgcaatatgtccacaaatcatgttttggcgctttttgaacttttcaaaagttcgccgcgcgaatcacgaattga

SEQ ID NO: 100924 - DNA, 583 bp, Oryza sativa
tccccccgaattacgaagtgaatttttgccaagaactctcccaatacactccaatatgttcaaaaatcatgttttggcgctttttgaactttttgattccgggcaaaaacatcgcccccttgtgtgccaatgtttccataaatagacaaaagttcaccgcgggaatcacgaagtgagtttttgccacgaacgcacgcaccacacttcaatatgtccgaaaattttgttttggcgttttttgaactttttgattccggtcaaaaacatcgcaccctcgtatgccaacattggcattaattgacaaaagttcgccgcgcgaatcaagaagtgagtttttgccacgaacggaccttttacactccaatatgtccaaaaatcttgttttgctgctttttgaactttttcattccagtcaaaaacatagtacccgtttgggccaaaatatgccaatattagcattaattgaaaaaagttcgccgcgcaaatcacgaattgagtttttgccatgaacgcacgcaatacactccaatatgtccaaaaatcatgttttggcgttttttgtgctttttgatttcggtcaaaa

SEQ ID NO: 100925 - DNA, 702 bp, Oryza sativa
attcctgcagcccaacatgatttttggacatattggagtgtattgggagcgttcttggcaaaaattcacttcgtaattcgcgcggcgaacttttgtcaattaatgccaatgttggcacacgagggtgcgatgtttttgaccggaatgaaaatgttcaaaaagcagcaaaacaagattttttgatagattggagtgtaaagggtccgttcgtgccaaaaactcacttcttaattcgcgcggcgaacttttgtcaattaatggcaacattggcacacgagggtgcgatgtttttgaccggaattagaaagttcaaagaaagccaaaacatgatttttggacatattggagtgtattgggtgcgttcgtggcaaaaactcacttcgtgattcgcacggtgaacttttctcaataaatgcgaatattggcacacgagggtgcgatgtttttgaccggaatcaaaaagttcaaaaaacgccaaaacatgatttttggacatattggagttattgggtgcgttcgtggcaaaaactcacttcgtgattcgcacggcgaacttttttcaattaatgcgaatattggcacacgagggtgcgatggttttgaccggaatcaaaaagctcaaaaaatgccaaaacatgatttttggacatattggagtatgttgcgtgcgttcgtggcaaaagctcacttcgtgattcgcgc

SEQ ID NO: 100926 - DNA, 681 bp, Oryza sativa
ttcctgcagcccttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtaca

SEQ ID NO: 100927 - DNA, 743 bp, Oryza sativa
ataattttgacaacgtctcataatagttcaacccaaaataatgccattaatcttcttattaactactttcttaattcaggacattaagcatgtccctattttttgcaaagaacttacacaagaaaatttcaagagtagcatacataggacatagaggcaatttgatttccccttgcgaggaatatgagctttattatcattaaatttggaagttgcaacactcccccttagtgagcttcatctttgccatcaaatgacaagattaacaagatcttacttagtttgtctcttagtcttcaatatttcttattgatttgaagagtgatgaaccaagtcaattatggtccattttgtcttagtattacaactccgaaaatgaccgtagtctaatgggagaagaatcatatgaaatggacaagtggcgcatatgaaatgtgcgatgtccatcccactaagtttgcacgccaattatggcggcaaatgtgcataggcactaaatttgtactaagcattagtcttgacaaacttctaaagttcatctcaacatttgctagatacagtttcgcaatgtcatgctcaaaattctcccctaacactaacagggatgataatcttaatatttatgagtgacatgcgaaacataacattatattggccttctcccaggctaaagatgcctctagagtttaggaaaaattagtgacattagctgcgggagacacaaggaatccttttttaatgct

SEQ ID NO: 100928 - DNA, 540 bp, Oryza sativa
ctatatagtgccttttttttaattacatggaagctgtgcacaaatacctgtgagtatacctcttataacacatgataatggaagagatgaagtctagtgacaaattcctcgtcttaataaattcctgttaatcagacatatacgtgtaacacttgttggaaccaggatttaaatcctattaagtgacaatttggcatagtgcctctcttgtcctctctcatgttcctcttccaggcctgccactaaagctaaagcactgatgatggcccttggtcatataaattttacacgcacgatgttttcttcatggtttcttcatgctaaagacatttaaaagtctattgttgctggtatgttttcttaatcaaacaagtatggttattttgtcctatgcattcatgcagcgcaattcgtaactcaatttgcaacttctgttttgtttcatgtcaattttacaaactgaattacactttggggcatcttttattgccatagtttcactttgaaccaccccaaatccaattttgaccggtatactcc

SEQ ID NO: 100929 - DNA, 539 bp, Oryza sativa
taattagagaataaccaatgggggtttatcctatacatatagagaaggcatatgtagtaatgatgtagaccaacataaaacatataccttcatgatctccatgttctcaatgtaaataagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtaggcaacttatgcaaaagagaggttaatcccataaacatcggtttatcatctattaccaaagtaacaattacacaaattgtttaatccaagatctttcaatcttttctctctttggtgatggataataacccgatataaacaatatagagagatgagatgaaaaatgatttcaaatcaagatagaaatcttataataaacaaaatatagaata

SEQ ID NO: 100930 - DNA, 635 bp, Oryza sativa
aaggcaagtcccacctccctctctttgatcactttgaacctatgttttggaggttattgaaaatgtttgcaaatcctgcatgtcgattgtatactaacaaattaaaatggtgttaaacttgttagacaaattcctattatttgcattatcaccttaaccccacatatatccatatccatcattcctaaccttaggaacaatatgactataccactttttatatgagttttggtgacactaggttactataaagcttagccatgcttagaatggtcttccttgtcattatgggctcattacaaacatgaaaattgatttataattaatctgggcagaactttaatacttgtgattttgataaataaaatggtggaaaacatggattttaggtttaggcctcaagtggtgcacatatggtgattagttgtgtaccgatagggggagagtgtgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtt

SEQ ID NO: 100931 - DNA, 657 bp, Oryza sativa
tgagaatcaaacatgcatgtcttaggaggcttacccaccgggccattctttcaccaaatgcccaacctcacgacacttggagcaatacttaccattactcttgacaaaacgagtggcacggtgagaaggtttcttacccttctttggaatgaatccaagtccctccttgttaagatgcaccgttgctcactcaaaatcttgtcaagagtgttcttacccttgaagcacctctccaagctttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcattataagcatggagctcctcaaacatactcacaagctcatcataggaaacat

SEQ ID NO: 100932 - DNA, 591 bp, Oryza sativa
tcttagttttgggaaatatgattaatcataacacgctttaaaatctaacttcatcgtcgactatgcagtaagagattatttttggagcttttacatggttattgctcccctatgtgtgaacatagcttaatctgaataatcttcataaatatccacacatctcataaaataagtgtccaaatatctttaaacttctgagatcaatggactttaggaaaaaagagcatgttacttaagattgtcttgcaaataatggaaaacattattataccagtggtttagtctggatttaattaaatactgccaagattcccagtaaaaaaaagtatgccaaatctgtatgcatccagatttgagctaatctcaagcttctgtcagctgaatcataaagattatctttgtaacttaatgtcagcttgactaactttaattgaattctctcaaattatttctttatgtcagtgtatgacttactgatataaacccagtactccttcggaccaaaataattcatggaaaaaaattccttagtttctaagagcaatatgcattgcttgacaataaaatgtcattagaatggagtaccggtga

SEQ ID NO: 100933 - DNA, 602 bp, Oryza sativa
ttgttctatttgatccatctatgcatctgtattgtattgtattttcacgcatgtatgtcttataatatcctcttatccggtcattggtcaaacagactcgcaccagctgctttcgctctcccttattaaatcttcaccggcgggtcggatcgcttttcccctttcttttggtttcaaatctacacccttggaaaaaaaattgatcccttggtaaaaaaaaattaaatcatagggacatatttagataagcactgtgtccagattaatctatgggattggtttttttttgaacggagagagttatttgattagcttggtattttctctcttcgcctcccctaaaaaagatctttcttctcctttttttctatctaaaaagaatatatcttgacaatttctgctgtttttgttttgtttgtgttcaacgatatgtatgtttgatttttattttgttaacttttgatatactaatgatctgttccgtaggcagatttattggtcgaacaaaacttccaaatctgtttatcgaacaaatcatgaatataccaagcgtagaaaaaaaaaaccatcaaacacaagtaactcagattgaagttataaaa

SEQ ID NO: 100934 - DNA, 910 bp, Oryza sativa
gttgagtagtaaggggatctaaggggtagaagtagaagggatgatccaatcttatctaaatatcttggtgaggaatttctcgtgtgggacttggccaattagagatgggagagaaatatttactcccggttgaagtttctaaccgggactaaagatggatttttagtccaggttggtaataccaaccggaattaaagatctaaataaactttactcccggttggtactaccaaccgggactgaggtggtgatttttagccccgtctggtagtatcaactaggactaaagatccttggccccctgacatgcctctgacaggggatgaaccgagactaaaaatgatctttagtctcggttggtaacaccaaccgggactaaagataaaaaatctttagtcccggttggaacgggactattgtgaaaatcggccgacccagcaaagatcacttctccagtagagaccatttatctgctttaggatccatgttactgatcaaaacagcgtattagatatgttagcgggttaaacccgattagagatggatgatatgtcatcccaagatccagctttccatttttactatactagctgtttccatataagcttgcatgcatcaactttccaaatgaatatttgtcacgtcccgataaatttatcccgaaataaaattcattctctaaaacgaaaaatagaattaattaaaattcgaatgtggcccggagaatttttgttaaattctccttggtctaaaatgagcccttaaattttacttgaattttcagagcaccagaaataattattaagcaacaaaaacaattatcagagtttattaaaaagaaaaactaaaaataaaccctctcctccctttgggccaagcgtccctctctctccctcggcccgcggccgaa

SEQ ID NO: 100935 - DNA, 1208 bp, Oryza sativa
agccataaaacttatgcgagcactgaagatgtatttttgatatttcattcctttgttttcatctgtgtcgattctctagattggcaagtaaatttatagggtgcacaagatcgaggagagatggtgatatatttttatactgattaagaccttggaagagataacaccctacttcagttgtttgtagattagatctgtatcaaagtgtgcgcaacacggtgtgtgaatagcacgtaacacgtgtatgatcaccctaattgtttccggcctaccgttatatagacataaggaggccggctacggtaggtagcgtaccccatataatccgggtacctaccacctatttatatcggataagatttatattcttatctttgatcccttttactccctctgttttgtattgtaagacttttacatctatatgaatatgaacaatgcttgaaagtcttacattatgaaacggaggaagtattggattacaatgtgccatatgggcttagacttcttagcccaccttatgtaatatagcccaaaggcctaacctcggctactcgggtaccgtgtcccctacaatctgcaatccacattacgtttgtttgttgacgaaactatattgcaagactgccacgtctttggtttttaatcatcaaaatattgtaccatttttttctctaatacgtacataacctgatacagtgaaagagtgattccaaagtcatatatatgacaaatttgcaacacattacgtctgtttgttgacgaaactatgttgcaagactgccacgtcttgggtttttaatcatcaaacgatcgtactactatttttttctctaatacgtacatagcctgatacagtgaacgagtgaatccaaagtcatatatatggcaaatttgcaacaagttgccaaaatgtctgaagatgttttaccagttaaaaaacttcattgactttttctacaacaatttttcatcccagatagaataccaacagatattaataaataatggaacacatttcattactaaaaccatttgatcccataaccaccgtagtaagtatttagctgccaattaattgatataatcaagtatttactcttatgagaaaaaaaacaaacaacaatctccagctcaaaagcaccataaacaaaattaaaagctactgatcttatagtcttattcaaacaaaacctttatgtttagca

SEQ ID NO: 100936 - DNA, 762 bp, Oryza sativa
atcctccacttggaaccactggaccgtatggaccgccagagtatgttcaatggtatggtcgagtcttcaagctgaggatgagagattaatcaatagtcctatctaacctctactgccacggtagtatgacttaaggacaagcttaaggaatagtctaggtatgtggtggcccattttggaagaaaatcgtggtatgtaatatatgtaatatggctgccatgtactccatttatgtaagacttgttggatggatgtaatagtaactaagaactcgtttgtccttaatttagaaacctctgtgcttgctgtccagaactttggaaaatctgtaaacataagttcatctaagttagaaatctgttataagctcctgttaatatgaccgacatttatcttgtggaactaaccttctctagtgtcaatttaaactaactatctaagcttccataaacccacaactgagtagaacttgccactcacccgcgaaaataaaagtttccaaattgtttatggtagcaagtctgtcatacaacttaaaaaaaaatattatctgctgtcaatgtcaatcctctggagatagtcataacttaagccaaccctacccaaatctcggggacgagatttattttaagggggatagactggaccatacccgaaattttaggacttaaaatttcttgtcaaaatagttagaggttaacttctccaaatttcgagagccaaaaatttccgttttaatttaggtgatgatcaacttaaacc

SEQ ID NO: 100937 - DNA, 2887 bp, Oryza sativa
ttcctagaaaactcaagggcctttgtgcatattggtccctcacagccatgtggacccatcctttaaaatctgaagaaaaattaggaaaatgcccaaacaattatatgtttagcagaaaaatgcacaagttgtaaaatctatataaaatcaaatatagctcattttgaagtgattccagtttctgtagattcttgaagttatgaactttattccaggaatataaaacttgacactcactgtacaaataatgtctctaagattatttaagataagtcatgcataaaacatgtacaaacttataaaatacaaagaaaattcatttcaactcattttgaaacaaactcaaaaacttcagattcatcatcagacactctctgattaggaaaataaaagtaatgacttactttgcatcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttgtaacttgtaaatgcataaagaattcattataaatccaaaaattgtgaaaccaaatgtgttagtcttagaaaacacatctccacaccctgtgaagtctaatctagtaaaaatcactttacaaaagtattccataacactacctaagactatactactataaaccgataaaacttctaaaaattcataactccctaatggaataagataaagataaaataaaaattctttcacctaaatttattttagatcagtaccaacccactgtgcataaatcatgcattttagagcattttggattttcaactctttcggtgtttaattgcatatcgtgtcctttatctagataattgcgtaatcggtgaagaagtggattaggtgctaacaattctctgatcaaggaaagttttctcctcccatcctttgaacacattgaatcccatgatttgaggaatgaaaatatttgtttacaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaactacttgcttagccatgcttagaaatatgcaaatactcattccatctataattaaaatgtggtttgatacttgaacctttgctggaataaaatgaatatgatgagtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtcaatacaacggtattgtgccacgtgggtgggttcccgttgtgtccgccaccacggcgttaagtttaaggcgtgggcccgccacttaacggttctagacatatttccaagtatgcctaggatggagaacacgtatcgtgctggtgcaaggctagattctaagtagtgtaaaggcttcgttatgacctctagatcacattcaacatgaagagtgtgatggagtcttgcaaactcaaaacaaactagagagtcatatcatgtgggtaaagctgtacaaactctgcagagttctttaaactaattgattagccgtgctcacggtcatgagtgctttggtgatgtgtcatgagtatagactatgttttaaaaatgtaatcatgtgacattggtttgaaattgataaatgtgttgagttgtgtatgtggtgatacattatgacttattattaagtatggcaataagagattgtttatgacggaattatgaagaagctaataatgaaacttaaaacttgtctttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaac

SEQ ID NO: 100938 - DNA, 833 bp, Oryza sativa
caaagaataagtgcatcttcctcttcacatgcaactcatttatgtcattggacgaagctctaatcttgaccacccagcgaagtcaagagctctctttgttgaccgtattcccccaccctcttcctattaccattgtgaaagagcgaagtgtcaaactaatagatatatagtacacatgtactaaactaaggccatatatatgccacaagtcatcagttaggaaaagcacgtcgtattaatacataggctaacaagagcattgttatggcatataggcattagagcacacctataaggagttaatgttggctgattgatccatcacaatgtgctctaatgttgtgttaccacaataccatagaaataggcaaattgaccatattatcacaacaatcataggtgattgtagaccaatgctaaatatggattaaatgatagtgcaaatgatcatgcaataattctcattgattgaggaaataatacataaagctaatccgctttccttatccctagtcctaactaataacaacaaaattatgcgagattagaagggcaataatgggagtggacgtatggtgctaggtcgacggagaaggcccatccagtctaagactaaatacgagtgtatgcattacgagaagactactttcttcctaaccattacaattaattgtgcatgggtcccatgctagattgaaaagggaattaatatatggtgggtcccctttcatttgatagattgaatcaccactaggatgccctaactattataggtttaaatgcaattagagtatgctagagttctttgaaacaaatttctatcattatgttga

SEQ ID NO: 100939 - DNA, 1935 bp, Oryza sativa
gccccgagattgtattgaacgtgtgttagtttgataacatggggctcggggtctatttatacccgagattacaaaagatgtccatgtcagacatgactcttatctctaacaaactctaagataccataagtctttgcggcagacttttgcccaaacatatctctaaggaaatttcatgaaatatcctaattaatagatacaattgccttatcaggactctatccgtgcgtggcaatcctcatgaagtagattgatccaacccaacaacgcatgccgtgccatattgtcggattcggcttgattggctaaccctgtccaactcggactctgccgatcccgatcgtagccgatttggacttcagttgatccttactctgtttccaaaacaatcttggacttggatttcgcttcgatctgatcttcatcttcgatactttaggttaccaaatttcgtcgttaacacatgccccccaagtccggaatattggataatgtttcgaatttgctatacgtcgactccgagagaaatccgcgctggtcgttttccgaccgttacactgttctttaaatactaaccgttgtccccgagaaacttcacctcgttacttccgttttcaccgcttaagccatctttgtcccttctctctccggcgatctcctcggtgcgcaaggcgatctccaggtgatctcctctctgtccaagtttccacccacgacgatgccgacctccgtcagcccatctgccgtgccatcaaccgagtacgctgaggtaagttcccatccgctagatctcttttctctacgcaatagatcgattttcttaatctcatctcgttttcttcttctctattccttctggattcatagcatcgttccaattagtcgcaattccaagcctgtcgcatgagaatcattattttcttcgtccgattggtgatcttgaccccactgaattcattgttgccgaaaccaacagaatcccctttagattagccaaccctaatctacgccattggaagaacacttttaagtcttggccatccttggaaaaaaacttccactgagaaaagctagactacatggtacaagcgcatatcggctagtaagcaaacacactgggatgaaattggaatcggccaagcacttgccctcaccatagacaattcggccaaagatgaacccttgatggctgccgctacttatttctggtccaatgccatcaacgcttttctattcaatcaagggccgatgaccccaactctgatagatatcaccatgatcactggtctggatgtaacctcatcggctaaccccatgagagtgaacaccaaaaatcaatatgattttaggacaaaaagcataggtggctggtctggttatgtggcagcatatatgggccaaggatctgtcactcctcgggaacatgtagcttttctgctcatgtggctaaaaaaattcctcttctgcggatccagttgtggtcctacaaccaattggcagttcgtagccgatgccttggaatcaaaacgacaattccccttaggcaaaatcctcctcagctatctgtaccaaacattagataatgcatcggccaagatagctgtcggctcagtggttggagcaggtggaccaggtggctgctgcaaacttggttgaatctggtagccatgaaagctgtcaatcggccatccgtgacagaagccgaatttccaaggttaaagccgattacggatgacgatggagaagaatgcacccatcgaagatgcatgtcttatggggaatatgcatccacaccagccaatgccggagcaaagttatcggctgagccgctcaaggactggttctgcatcttttatgaaggctttcagaaagatgcccatgtttggttcttttatgagaattcagccgacttggatctcccatcggatttcagat

SEQ ID NO: 100940 - DNA, 601 bp, Oryza sativa
gcttgacggcaggcacgagctagacaccaaagccttcatcttccagggactcctcttctgggtttgaaaaattgagcaagactgagtacaaccactgtactcaacaagacacacccacaagtgcaggataaatgtaaaggagtacaagggggttatgatataaagggttagggtttgcagtaaacagcattaaaagacacttagttgctcaaagctattttgtaaacacgtttccagagctatataatattattaatcaaggccgtgaacccacacgagcctgccttaacccaaggcctacgatgattcagaccgaactggcaacccgaccctgggtcccagctcgtcccaagccaacccaggccatccgttccacattttagttgttaagcaggttttaagaattaaaacactaacttgggtacattgctcggcttgcccataaccgagggcgcgactattcgaatagattatactctgattagaggtgtacatctttacccacaagacacatcttcctcacgtgtaaccacgtgccacataccaccacgatatacggacggaagacgtgacatagtttccaaccatcctagccatagac

SEQ ID NO: 100941 - DNA, 895 bp, Oryza sativa
atctgaaaaactcacaacaccaatgtggatcaaaaccaccattatcttgctcataacatcctacatgctgttgcttgtcatattttttctggtacttgtcaaaaatcctaccgaattcatctgaaaattcctatttttccctccatcagctattctcccagatgtgtgcaccatattaacagggaaaggtttactatcaaccttcatcggcttttttgagtcatcaaatttaatcttccccccttcaatggcaacctggatttggtgtctaaacactttgcaatcattagtagaatgagaaccagaattgtgccatttacagtaactcctcttgcccagttcttcagccgatggtatgatgtaaccagcaggaatttgaatctgcttctcccgaagtaacaagtcaaaaatcttatcatcctttgtaatgtcaaagttatacctctcttcttttccagaatttttcacccattggcatggtataaccttcttgcttctaacccattcagctgctgctatttcagaatcatcatcatcatcattagatccatacatgtaaggacagacgtgattgattttcttgaaattcttcctagcttctgcaaatctctgttcatgcaaggtcaccttttgtgcaagatgtcataaactatcaaagtcctgagatgagaacttctccctgatcggagctatcagaccttgaaaggctaaatcggctagctgaacatcggtcaaactcaagctgtagcacctgttcctcatctccctaaacctatgaatataatcttgcacgggttcatcatgcctttgtttgattgctgtcggtcggacaatttcatctcatgaatcccactataaatgtaactatggaattgcttttccaaatcggcccatg

SEQ ID NO: 100942 - DNA, 690 bp, Oryza sativa
accggagggctaccgtgtaggggttttttctgcttcgtctcgtctgcaatgggggtggtcatcacaaggtgggggtggtcatcacaaggacacagggggcccgggctgtcggtgtaaagatgctttacctggtgaaaccttttccctttcatttttttacctattgttaattttgttctattaaagcttggtttagttcctaaattttttttaaaaaaacatcacatcaaatctttaaacacatgcatgaagcattaaatatacgtaaaatctatttggagaggcctctcgtttttgccttaaccagcgacacctgaacgtgtggagaaatctactatagcgtactacatgcatgcattttttagaagtctactacatcacatgtatgttattttcctcttcaaacaaagttttctctcaaattacttatccgacctacaatccgattacaccattgtgttcgttacaattaaatcttcacagtaagatcttacatgattatattacgatgaaaaaatatttatatttgtaaattacttttattatatatgtaagttactttttatcatatatataagttacttttaaatttgactaaattacttcttagatatataaaagtaaattcaatagagtctaaaagtaatttacatatattataaaagtaacttaaaacaaaacggaagtaac

SEQ ID NO: 100943 - DNA, 573 bp, Oryza sativa
gagaatgggacatcatctaaaataacaaatctggatagggggttgattttttatgggacgaagggagtgttaggatacgataggcaaataaacgatgaagaacaatagatcaatcacagaagacacgaggttttaacatggaaaaccctcctaagatatgatagaaaaaaaaaacacgagcgccagccagcaaaactgcactatatcagatgaggttacaaaacgcccaacggctgcttcgctctggcccaagcctctagcgatgggcctccacttcgctcagtccgaaattggcctttatatatatgtgtgtgcaaatgaatttggatcacaaataaattatgaacatataaatacaaatcaaaacaagacaggtgctaagtatgtcaatgagaagaaatgtaaaccaccaacaggtgataggatggatattgatgtacttcagaagaattctactttcgcaggcacaatgacatcaaccaatggtcacatgtcatttgatcaaggtttcagcttaatgaataatgcctgttcctcaactgcaactattcttcctgtcggtactcaaagggt

SEQ ID NO: 100944 - DNA, 718 bp, Oryza sativa
caccttctccttcaaccttgtcttttgacttgggcttgggcttgacctcgggatctcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtg

SEQ ID NO: 100945 - DNA, 537 bp, Oryza sativa
cccttccttgtgttctacttccttctttccaaaaaaaaagaccaacccttaggttttgggcccaccaataaatggtccgtcttatacggaatttttttataattagtattttcattgttgttagatgataaacatgattaatactttatgcgtgacttatcttttaatttttttcataattttttcaataagacggacggtcaaacgttggacacggaaatcagggtttgtctttttttgaacggaaggagtaaaccatttggcagtccctcttttggcaccacctgcagctccatttatgattagggtgcacatcgaaccaaacaaaaaatgtatgattaggatggctcatacgataattattgtattaaattaaatgtatttaatattttatactccctccgtttcaggttataagatgttttgactttggttaaaatcaaaatactttaagtttgacaaaatttataaaaaacagtaatatttttgacacaagatactttattataaaagtatataattattaattaaataaaa

SEQ ID NO: 100946 - DNA, 962 bp, Oryza sativa
tgattgagctatcatatagccaagactcaaaatgctccgggatggattgtcccaccagatatatggaacttgtcaatcacacgtgtcatgtctagataccattgaccaaataaccatctgacctgaccctgttagagactatattctccccttgattttgccattttgggttcatgttcatataaaacgtttgtcatgtggttttcagataatgaataccataataatattcttcagttcaggtcttatttcttgatagcaagaacatagtaatgctttctctttgggtcaattatgtagaaatatgaaaatatgaggaaacattttaagatcagagagaaaggggaagggggggaggggggcttacactgtttgaaggaaactggagccagacaagaatagcaaacttcacgtgataatagaaaggaacactgcagaatatcaccagagtataaatgttcgaaaagtttacaaggacatcaaactttacaagattagaaacatcaagttaataaaggcaatgtaaatttaaacccatgcccggcgaaactttcaaccaaatattcctagtaatgcaatttctttcagttcatgctacattccgcacatatactgtccccatgcactgtcaactattgtaagggtctctttcacacatcctctccactggaatgtttgatttattccatggtttatataaacataccagaaaggcagttagaagctgatcaataaagatcagcaactccgcagggtatacaggaaaattccctggtagattaaatggtgtgtcttaatgcaccatggtcgctttttttaacttgaacattgacaagctgattgaccacgaccacccagtagtgagaatggtgatgaacagcaaggattacttctttgggttccgaagtactcggcattgtcttggccgatttatatagtttttggtcagaaaaaagaaatga

SEQ ID NO: 100947 - DNA, 612 bp, Oryza sativa
  unsure (1)..(612): unsure at all n locations
gacggccagtgagcgcgcgtaatacgactcactatagggcgaattnnnnnnnnnnnnnnnnnnnnnnnnnnnnnnnnnnnnnnnnnnnnnnnnnnnnnnnnnnnnnnnntgaaggcgcgggtagccgccgtgctgcgtcgccacgggggaacgcgtcccgcgcagcatgaggtgcagactttcaacgacctcagcttcgacgatgccgagctgaccgtgacccgggccggcgcgccgatcagcctgaccgagcgcgaataccgcctggcccgctgcctgttcgccaacctgggacgaccgttatcgcgggaatatctctacgagcgcttctggccccacgaggaagtgttgtcctcgcggccgctggatacccacatctatcgcctgcgcaacaagcttggcctgaccgccgagcgcggttggcagttgctgaccatctacggctacggatatcggttggagagcgtggcgacggtcgactgagcggcgcggggtggcgagaccgaccttggcggtcggcgagggagaatgaaaaagccccgcggctgcggggcttcttttcggcgaggcgcgcttacttctggaacgcggccacggccttggtgatctcgg

SEQ ID NO: 100948 - DNA, 503 bp, Oryza sativa
cgggggctacacctaattaggtgcatctaatcgatgcacctaacttttttgtttttccgcccttcatagtctttgattttggtactcggagatctatacagaagaaattgaagcactcggattattactttatgttccaagagaaggctatttcatcgactgtaaaggtctcgggggctactgtggagattatggataccccatatctacacggcatgtatagtccgactgggtacagggtaccatatatagatagaatatctttacgaggactcgggttaggtttagacttgtatgtcaaggaaatatccgagatcctagtcggttacgattgtattttatctataattacatattccgttagggatatggactgtatcttgtaatacggaccccttcccctatataaggaggggtccgggttcctctaggggcacgatttttctcccaggtcatacgatcgataatacactcggcggatcaatccccggacaggagtaggg

SEQ ID NO: 100949 - DNA, 666 bp, Oryza sativa
tcctgcagcccgattacaacaattgaaagattgggtgtgcatttaaaatggtggtgatagccaagggcccaaggcttaacatatttcatagtaaaatagttaggttaaatctaaccagcaaactgaagaggaggttttgatgcttaaagttacaatgtcactcaccccgtcctattttaagtgcagttctaattttctgtgtctaacttgtgaccgttcgtcttatttgaatttttttatgattaatattttttattattattggatgataaaatatggataatacctcatgtgcgatttttttttaatttttttcataatttttttaaatatgacggatggttaaatgttggataccgaaacccacgataacacttcaatgggacagagggagtatcttggaatggcaagtccaaagtaaagggacaaagttcattcaaaagttaattttaagtgtttatctgcatgatcatctgtacaactgccttgagaaagtttaagcatcaacctcacatttatcatatagtatttatttatcatacaatattatcttatagtaatgcaataatagaaactaattctcatgttgaaaattggaactcattccatagcccaagactaatttctaaagtgagtttggatttgtctactccacccgtaatcatg

SEQ ID NO: 100950 - DNA, 3741 bp, Oryza sativa
gggggcagcggatccggcggcgcgcggcccctcccctccctccccttgcagatccagcggaggggaggcatgggggcccggtggagcggcggcatgcgtcagcggctggcgtggaggtggggcgacggcgtcggcgaccggcggatctatctcccccttccttccctctttgttatttgtgattctttgtaatttgtgagatacgttcttggagttcatttgttgctgcgagatgtgttcttgtgatgtgagagttcatttgttgatgtgagatgtgttcttgtaatgtgagatcattgtttgtcgatgtgcgactacggatccggcgccggcgacgggagcgagcaacggatccatagccagcgacgggagcaggcagcagatccgtagccagtgacggcggtgggcctaggttaggtggcggtggcggattagggttaggttttttttctttttttttgtttcgattttttgtttttccgtgcgggcggcgtaaactcccgcacgcgaaaatcacgattttcccagacgactgggtgcgtgcgggccgccctcccgcacgcaaaaatcgtttagcccgcacgggataattggtatttgtcggtaatacgggcccgggggtacgcacaataaagggaaagaatcttcctatctgaccacgtggcagcgcggcttacttttctcccccctcccccggggggtgggggggggggtcggcggttatgaagtggccggggggcctcggggtgccccggtgcacccctcgggcccttggagcacgatgccacgaggccctcacccggctaccacgtggcggctgagtgagcagagcaggaggcgctgcccagcgctttaaatgagcagcgccgcaaccgtccctcgccgcatttaatgcggcgtgggcaggcatgcggcgccgccctattgacgcacgtcaatcggccttgactggtctgcgaccggtcacaggcggatgggatgggtggcagtgcacccatgtcccgccctatgtcaggcggagtgggggcaggtatgccccgtcccatcggcacgcagccaagtgcgcccttgtacatgatgaatccaccaaagtctccatggaattaagagggaatgacagggatgtcccccgtgtcaggcggggaacagcactgggccccacctaggggcggtcgaccgccttgcttccggttgaaggtatggacggtagcttgccccaggctatgtgggtcccctccaatagggaaataggtaaagacggtgcatgtggtatccccttgaactataaaaggaagaccttacccaccgagaaaggggacgactcttgatagcttgggctctagggtttcccaggaactcaagatctcttgtaagaactcaaccataattccacacacaggagtagggtgttacgcttcccagcggcccgaacctgtataatccctcgcttctcgcacttgttggcaaacgagctagttagccagatcctaggtgaagatacgctcttgatcatcgcgccttatcccccggccgaactcacagaagggggtctaacgacctcccgctagagaggatcactcctcgacagtattgtaatagtgttcgatatgaaaaccggggtcaaatacacaaaatattaaaaaaataggacaaagttggtagttaactaccaccatccttgtccctatgcgtttatatatgcacaagaatgatatgcataccaccatccttgcacttatacatgtacttccttaattataaacattatcttgtgaaagtgctccgattggaaattagtcccaacctatttaatatgttccggcatagtacaccaagattatcaccaagtaactagatattcatgtatgtaatgcacaaacccactacgaggcttttaagttgagatgttttacaatagtctctacagtagtataattaatatagccgttcatcttttctaatctaatgaattatatatatttgcaccaccatatcaattagtatttatagaattgtttttttgccggtagtactcgtaactaaaaaataattagttgagagattgcccctactagtaataatacttggtggtaaaataataccaatagagatcaccgtaaaaacacccttttaattatttagtccttgcactcttaggagtttgcacctgatatggtttccatgtgtgaacgacatttgcatcaggcgtgcgtttgtactactgtgtgtgttgagagtgtacatctgtttttttttttccggggggagattgtaatcgatcggttaattgtatttactgtcaatagatgtatagatgcagtggcggacgcagctttaaaatataaaatatagatggagcggagaacggagatgttcactcgataagagcaatcgaacataacacatatcatattaataacatatcatattaatagttcattcgtataagtatctcaatctattgggtgtttataccttgttatacctaattttgatggtccatgactactataaagggataagggggtcttgagagtgtagggcgatacgagtcgtagctgagtcggtcgacccaacctgcctaatgggtagatccgcctctttaatagacgtacataggataggaggacaaggaagtgacaagtggtaaaatgttccaatataatacaggtacgcatttgggagtgcatggatgcagcaacagcggccagcggcgcggtcgactgacagtcaccggccgggggacaattccatgtatcatcttcctggacttgtctttgagttttgcatgctagatgattgttacaagctgcgagagagtaaaaaacacattacatatatatatcccctcttctctcccaatcctaccgttcatcttctacatggactactcaagagacaggatcatgtacttatcggtataggatattagtttttcactgctacagaatcggtcatcggtgaccaggcatcactaatgggtgaacgtgaccagtcctagatgatcttatctttgccaaggctaataaatacccgtttaaaatgaggcaatgagggataacccatcatagatgtggtgtcatttgtgatgtgtcgtagatagtagtgatccgtcatagaaaattcactacgataaaattcatttgtgatgtgtcaatgagggcactcatttttatcggatgataaatacaacatgtcaaagataaaaaaaatgagaaaccatatctagcgggtcctttttttacccgttactgtaacaaccgagaccaccgtacctcttcttttctgattcccaccgtgatcggtaccaattgaccaagacgatgagaccacaaaaatcttgtcctcttatatctctatctctccctcccccttcatcgattcagacttccactagtcggtaagccccgagtgctcatcgcccgcagcctccgcctccgtccccgagtaccctccctccattggtgcctctattcccgagtggcaactgccgttgccactgagccccaaagacacgagatccgggcttcctgaggtctggttacgctagatctagccaccccgcccccgacctcatgtagctcaatttggcacttgccattgtcccccctcccccaagaacaacgatgacaaattaacaaaaagtccatgctattatatttgcatttcaagctactttcttatattattttgaaacgacctacaccagaaagtgcaaagtttcatattgatatagaagaa

SEQ ID NO: 100951 - DNA, 511 bp, Oryza sativa
aaaaaatatcactagaaattgagtgagatgtcgtgatgatgtgttccgtctgcaataatgcaggaggccaccacctgcaataatgcatgaggttctgtacaacaagttggatcacagcatggctccaagttggcaggcagttagtgattgtttttagtgggcccaaccctagccgtagctcaagtgctcaaccagctaagaaggccggggacccagccggccagtcatgcaaagacaaccaccccaaccgggcaggacagccaggcagcctgccaagctcagtcgaaggggacgtacggccagccaaacacaacgcccggcgactcgccccgccttcccttccacttgcaggatccagactcacatcggctctactgtatttaagggtgtaaggagctaatccataaaattaacttataagctaaagctgcaaacttgtttatcttgatttataagtgggtgcgcggatcagccatctgcacacctgttaacatcaaaattcggtaagccc

SEQ ID NO: 100952 - DNA, 586 bp, Oryza sativa
ataggaatgatctcacaccttaaagtaaggatcccatctaggatttcctgctattttagttggagtgtccaatgaggggggtctgataagttcatctcgtagctcaccaattgcatgaaggactttgttaaaataacgacttactgtttctccagacctaccataattagcgcggactaacctatttctaaggggtatgtcccaccgtatgcagaaacatagccacttgttcctcaatacacatgtggatggtatcttcaagtaaaccacgatccctaaatagcttacaaaaacgaataaaacttccttttctaagtctaagcatgctgcaatacaagttgtatcattgaaccaaatcttcgtttctaggtactcaattcttatcctatccctttcagccattgggccatatctaataccttctgtccttgaacctctcgttctttcctagaccgaataatcatggcgcatcattgataacaataaattgtagcagcaatacaaactaaaagctggtcctctcatccatctacaatacaacaacaaaaataacacatgaccatcatctactgtcaagaaatttacc

SEQ ID NO: 100953 - DNA, 737 bp, Oryza sativa
  unsure (1)..(737): unsure at all n locations
atgtgggtcccacgtgtcagtgactcaatgtcaccgagaatgtcacggggaatgtcactgaatgtgcgtccgatccgacgtcccctccctcccacgcgggtcttggcgtcttgctcgggtgaaggcaggcgcgctgtggctcggtggctcaagatccccatggagctccatcactgccgcccgacctcatctcgcctagcatttgtgtgtgcgcacctgcttttgggcggttagcgaaacgaaagtaaagacactaatgtaagacagctcaagcgagtctagcctgagatataaaatcacactagccctgccctctctccaccgctgtttgtggtgcgccgcccggggtcgtcggggtcgtggccgtccgcctccagtccagtctcgctgctagctccgcgccactacgaccgcgccccttggtttgtcacccccccccttcnatcannnttnttatcctaatttgcancatctttatccccacctatttttgcttcaacaaataccccaaagccccctttcattatttgttcatacagttgggggtgcacgcgccctttttatatatatacacgccgctgtcgggaacaaagtgtctctctactgaggccgaagcctccggttatttcttcctcctgaatcctgtctggtatggtgcccccggctccttaatgcactttcgttcacagagagtggtcgtattgtacagggttttcctttccttgtgctcaaagcac

SEQ ID NO: 100954 - DNA, 797 bp, Oryza sativa
  unsure (1)..(797): unsure at all n locations
cccgcgccattggttgactcggcttcgactgcaattagttcatcagaagattgttggctatggaaaatttagtcctcgcactcgtgcgaagataatcgtttgcatagaattattatggcttatatttatctctcatctcatcctcgcggtcccgcggtacccatgtgtcgcgcgctcgtttgccccccttggtaacgaaaagtttgtattcgctttatccatccaaacgattttttgctaaaagtgtggtggctacgattcctagctctatcctagccctgcatcgagctttgggtaccgtcgacgcccggggccccctgtgctagctcttccgtagcagctggctttggccccgtcgactcgctacggcgccgagcttagcttgatcgcgggtgaagattgctggctatggaaagttcagtcctcacactcacgcgaaaacaatcggttggatagatgaagtagaacacgaacagaggttaacaaaaggcatgggcaagcgaggtacgcgacgtgaggtcgcgggcccgagagaatctacaacgttttgctgatgtatacagaaaataagtttacagcctaagtaccggcttgcgaggtcgcctcagcttgggccgaaaaagcgcatggtnctaatgctagcaaagaaagaagaagatccggcccacatatcatagactagagagtggctcaccttgaccactggggaaagtttggtagggctacgccggggctactgccgtgaatggccccgggtttcaggttaaaggaggaagctcccccaggggggagtcagg

SEQ ID NO: 100955 - DNA, 1576 bp, Oryza sativa
aaggtccttctaaagttgttagagaaatgggaagaatatgaaaaaaaagaggttgaaatgtttgttctagaatattagaggaatgggtgctatagaaaaggaatattagagaaatggtgctatagaatagaaaaggttggaatgttacaaaatctgattagagaaaataatgtgattttgttggtataatggaaacagtgaaacaagactttttccctacaatgctgaggggattagtggtcatgaatctttgtgctggaactggatgccagcttctggcaaatctggaggtattcagttcgcattaatactaaaacatttgatatcttggaagttactaaaaaaaatttgtttcaaagtaaagctgatgaatattactaccaagtttaaatgggatttgatggtaatttatggagcagcctagaaagaggaaaagagtagtttctaaactcatttggcaaatcttttacaacaaccaaaaaatggaagtaaagaaagtgaaaaaaaacaaagctagtggctataacaaatggagtttcattttcaatgcgattattgaacaagctagtctaagagaactttgtttgggaggaaggcaatttacttggagtaatagccaggacagcccaaccctagaaaaattggacagagtttttataagcaatgaatgggaggttcaattcccactcactgctgttagatctttgccaaggggcttgtctgatcataaccctctgatagttaccactggagaaaacacagtcagtcaatccatttttcattttgaacagagctcattccttagggaagacttaaataaagtagtggaggaggtctggaacaagaattattctgggaccagtatagaaaaatggcaattgaggcttaaagcccttaggaaaaaactaaataggtggaacaaaaactgggaaagcttatataagggagaaaagaaggacattctagaaagaattgatgccattgacattagagtagaaagcatgggtatgagtggttctgatagagaggagagaaaggaacttgaaaatagactcaaatttgttattagggaagagaaactgaagtggattcaaagaagtaaaggaagtattacaaggggattgtaatactatgttcttctatgctaaggcaaatgggaggaagaggaagagtcagattcatagtttggtgcatgaaggagaggtgattgaaggataagataagtttgttgcttcatattagaaatttttacaaagatctctttggacattcaaaggaaaacatgttttcaattgatatggcaaatgtatctaaggtggcaaaggaagatatgaagatgttaaccattcctatcactttagagaactcaaaacaatgatttttgaactaaaaaagaacaaagccccaggtcccgatgaataacaggagaattttacatgcatttttgggacttggtcaaacatgacatgattgacttgataaatgattttatcaagggtttaataaatattgatagattgaactttggagtgattacattgattcccaaaacaaaagatgcctctcaaatacaaaa

SEQ ID NO: 100956 - DNA, 686 bp, Oryza sativa
cctgcacccctattttgctcttttttgtgcatttaaaatacgaaaatcaagatgttccatcgattcttttttttttttgttactagtgactgtacattgtgaattgttaccatttacaagcggtaagttagggaccgtcgagtaatcagtggaagatgactcatttgtgatgagtcagtatatatgaggatttctgatcactgacgagtcgcttatccgacagaaatgaagcttatgaacaatcacaggtgacatgttcccttgtagttttcacatcattgagaatcgaatatattatgcttttggaaaagactgcactttgccaaacttaaacccacagtgttatgtaatctgcaactttgcatcattataactataactttgttgttatatttggtttactttattttatccaatactcaataatttcacatcaaacttctaagtgtaatgattgatgggactgatacaatctactgtttaattatatgagcaatttgatgcaagactcattaattaacagctaacaattgttctgaggatacgaaggattttctaagagcaagttcaatagtatagccaactactatctccaatttatctatagccaatctaatagctcattcatacaatagttacatactaaagtattaatacctggtcccacttgttatacacacagtgtc

SEQ ID NO: 100957 - DNA, 612 bp, Oryza sativa
atatataaacctttccctgtctccaagggctgaaacattaaataaccaacacatttgagcaattataagtaacagttctagagaaaaaccagtactgtatgtgctgattttttctaaaaaaaggaacctttaatttatcataggtaccatttcattaaaaaaatcaacatctataatatattataggtgatggttttttaataaaccgacgcccgtaaaaccgagccgagccgaaccggtgggtgggagggagatactttttgccgaacccatgagtacttgtactcggccttatcctctcctctctctctctctctatctctgtctcttccttcccttccccaccctcccattctcctccaccaacacccgccgccgatcaccaccgggatccacgaggcgatctgacgtgcattggattgggatctcctacatccttcctttcccctatccttcgagctgatcaagccgccttttttttttatttctggaacctcaaagctaccggttcctaaactggcacctttgactacctcaaaggtgccccctgttatgttatgtgtcatttgggaaatttagcatccatggggttttcccaaccggtacacattg

SEQ ID NO: 100958 - DNA, 641 bp, Oryza sativa
catttttctgttcatcttggcaggcccttcctgtatgatgatttagagccaagaaaattataccaaatggtcagtcaatgatatttgactcctttttttcctttggttgactcaggcaaattctaataattcagtacagctgtatgcttatgattatgactgtttccacttatgattatgactgtttccatgcttttgaccaaagaactatgacatggatttctacattgcccgtccttggggttaggtccttttcaaatatatttttgacggttgcatatgattggtttgaaaacggaatttgttctttttatatttaagcaaataaccacaaattaaatagccttttttttaggaaattaaatatcctctgtttagagtcacaatgatatttcgaatgggttttccccctgacattgattaaccggagacatcgatattttggaactaccaaaaacatgtggggaactggaaggctaaaaaattcacattgcaccatgatacaacacagagacgacatacatactcatctacatccataacgcattaggtagatcatttgccctttttgctaaaaagaaaaaaaacagtgacttgattttaaacctagtttttttagcaaattaaatttttagagttgg

SEQ ID NO: 100959 - DNA, 611 bp, Oryza sativa
tttcaatgataaaatggtagaacttcagaacctaccaccgtccctcacgtcactagaatttcattcttgtccgaagcttcagtctctatcagggcagctgcatgccctgaagtttttggatattaggtgctgcaataaactggagtcactgaattgtttgggagacctgccatcattagaaagactttgtcttgtgagctgcaaacgtctagcatccttagcatgtggtccagagagctactcatctctttcaactattgctattcgatattgcccagccatgaatatgaagccgctatatgaacgccttaggccacggttggatattcttaaggaaagagatttgtcacatgcccatgcaaaatgtccttatggaggtacctttccattgcttattccttcctttttgtttttttttccctacatactagtattgcatatccatatgttgcagagtatgcacttaaaaatttcaatcacctccccctctgttttatagtcaataatacaattacaaggttgtcaacagaatttccttatgtttcaacaaacacaggagccatggttaaatgttttcttcttctgttttcagatgcatgagcattatttcc

SEQ ID NO: 100960 - DNA, 2529 bp, Oryza sativa
ctcctccctagggcggcgccagccatgttggcgccctcctcctgccacgtcggcgcgcgtgtgccacggtggcaggaggacggcgccagagaggctgacgctgtctcgttggacgacagcgccagccactctggcgccccaaaaaggaccatttctgggataagttttttcaggggtctatttgcgagataagtttttcaaaaggaccaaaatgtgaaaaatctagtcttctggagagtctagtatagcccttgtacctttcccttttcagtaagattctactttatttaatatactattcttttctctactttacttagtctttgtgcaacattatctttgtcattgtgctgttgtggtttctcttagttcatatagttgtatgccacacgaggatacaaacgcatgcctgcaacacttcatggaggggtatctcttagttcatatagttgtatgccacacggggatacaaacgcatgcctgcaacacttcatggaggtctgtggcaccttcaccatcaagggaatcatattggacgccatccgtcttcgccttttgccattctctttgctcaggagggcaaagcaattgttttgtgccaaccgtgaacctgtcaccacctaggatagctatggcaagtccttactcaagttcttctcgataggcaaaaccaatgcccttcgtggaaagatttcaagcttccaacaacacgcgaatgagttgattccggaagcatgagaacgtctcgctccaatagtacatccgagcgtgccctaaccatggcatcaagattggctcttgatccaaggtttctaccatgggctcaccaataccacctgtagtctaacgttggaagagctttcttctcactcaatgtgagggaagagacgaaactcatcaaaaatatggtctccaacccaagaagcaagggatgcacaccatcaatgaggtggacatgccctccgccaggatggacctctagatgaagatgatagaagaaagatccaacttcaagaaggaccatgaagccatccagcactatgccaccacgcaggccattgaaactgatccttggtgcgatgtttgtggaggagatgaccactcgggcaaccattgtcctgaaacaaaggaggatgtgaacttcatcatcatcgtcatcaacaacaatgggtatcgatcccaacaacaacaaggatggaattcacaccccttctgccaaggtaacggaggtaataacttcaataatttcaataatcaacctttattaaaggatcttgtgttaggccaagctaaaattaataaaaatataaataaaaagttgtttgctaatgacaagatcttagacaatttaaatgccaaaatggacagtttttcttctgctctcaaaactcaatcaagctctaataaaatgttagaaacataattagctcaattagcaattgttgtcccatccttcgaacaaggtaagatccctagtaaacccaaggaacctatcaaatctgtaaatctagtcacaacgaggtttggtaagcctccactaagatcgaggtatggtcatccaagaagggagacaatggtcatccaacaatcacgtgctctgttggatctcaagaattctacaatgccacctgggaccttggctcaagtgtcggcatcatgtccaaggtaacatatgataatttgttatgtggtcctttgtccactacttgtataggcctacagctggtcaaccagaccatcccctatcccaaggggattgccaaggatattatggtgaaacttcatgaggactatgtccccacggatttcatagtgcttgacatggggaacaatagtgacacacctcccattcttgggaggccctttctcaacacaatgaacgcatgcatctatgtgggtctagacaaattcacttccactttgttggaaggaaagaaagtttcctttcacctcttctactccaacgaatcatactaacgagcaggttaagaaaactggtcaaaaaaagaagccatgatccacaccaaggagagaaagacaaaaccaccaagacacaaccaaaactgaaattggtttggtggaaaaaggaggtgcaaccatctataagaccaaccgatgcacctgaacaatgggcccaaaggaggagtcctactctacggacttcaaacattgaggccttgccgaaaggtaattcggtttgtatctcatatttaatttccaattgtattcttcctttgcattttttttgaatttttcatatttcattttgcaacaaaccttttttgctttttgcatttcaacttgagacgagtcttcataaagatttgaaaacttttaggggaaattgggggttcggccaacccccctatgacctctagtttcgctttttgtgagtaggaaacattgatttaactggtgggacaaagcacaaaagataagtagaacaaggtggtcggacagccacccccttttgcctttctcttttcagctttgccttttttttctgtctggaatctcatgaagtttgaa

SEQ ID NO: 100961 - DNA, 695 bp, Oryza sativa
aatagtattgccaagagcctttacaaaaagtttaatttatttggacataacacgcttatttataagggaaataaagcatattttgcactagaaacaaaaagcaaatatacccagtttatactacaaggcaaagaaacggtgcaaaaaaataaaaacaacacaaacaaaaaagtagtactaatacaggaatggataagctggtgacctcattgcaaaaatagaggggcgtatttgcaaaacgtgaagactttctagatgtcttcctcgataaggttccagataagtccaataacttccatctttttatttttttcttttgaaaaagctcacctatgcactttcatcaagctaacatgtcattttaaactaaccaccaaactgttttgtgagctctgggcaaaagaaaaaaaaagacataaacaaaaacaaaatgtcaaccaaacatctacaggtactgtagatgataataattataggttttttactagacaacatatctgtctgaaatgagttaattaatgtaatagcagagcataaatgcaaaaaaacctctacaattctagatttatagagggataaataaaacagaataatccaacaataaatgtgctttttaaagctaaataaatctaatttaacacacttaagcaaagcagctgagaagaaaaaggtaggaaaaaaaaaaaccccggcgt

SEQ ID NO: 100962 - DNA, 620 bp, Oryza sativa
atgtcaatacaagttgtatcattgaaccaaattttcgtttctaggtactcaattcttatcctatccctttcagccattgggccatatctaataccttctctccttgaacctctcgttcttttcctagaccgaataatcatggccatcattgataacaataaatttgtagcagcaatacaaactaaaagcttggtcctcttatccatctacaatacaacaacaaaaataacacatgaccatcatctactgtcaagaaatttaccaaaaaaattaacacattgttgaaataattatactacaacattcttaaaaaaaacagacatgcacagatctatataaaagaaatccccattcagtgtttagggtatttttaccttgtacaatggaaactgagctctgcagtttgtggatggggatggagaagatgaggatgagcagcaactggcaatggaggctcgcgcgccgctggcttgcccctactcccacagctgcctcgcccttatcgcgccgccgcgtcacctgctcgtgccgccgcgtcgccctgctcgcgccggcgccgcgccctgctcgcgtgccgccgcgtagaccctgcgcgagctgcccccgtgccccgatcgcgc

SEQ ID NO: 100963 - DNA, 647 bp, Oryza sativa
ttagtcattttagtggtaaaattttgaattctgaatagcttatgttccctttccaagcatctcactggctgaaaatgcataaattccatgcatatattgaaatcaatgtcccagaaaatgctatattatgatataaattttaaatcttaaacatacttatattttgaaacatagggaatatcgtaaatataatcagaaaaagatactatatatacatactaatttattcttatagaacttttacaaacactaatgtgtatatagtgttgcaagtacatctaattaaattctctataactctcatattttatatagtaaaattaaatggttgagattattgtttggaagagttcttttagtttcgtgtagaaaaccatgacgactttcattaatagtagttttgatacgattaatatatagtcaaccgtgacaaatacatattaggatatactagtaacaattgtacaatgattttacatttaattagcatattgacttcttgattttaattaaccgcggctgttacttgctcctgcatcttcttcttcaccaagacaacaacacacctctgaattaattatacagtagattctgccatattcactgcatctcgttgtgtgatgaaggtattgcatgcattgcatgga

SEQ ID NO: 100964 - DNA, 685 bp, Oryza sativa
attcgatgtgatgggtgaaaagtttttgttttgggaactaaaccaggccttacccacatgtcaactactcccaccaactacttttgtgggaggaaaaaactgtggagctaacaaggttcacatgtaagtaacaaatgtttacaacaattaagatatgataataattttcttaaattaaaacccggttgcaacgtaagtgcaataagctagtaaatacaaaaatcataagatgaagttggataagaaatgcttatatttgtgtacaaacttcaaatgttgaaaatgacatactagtccctccatttcaggttatatgacgtttttgactttggtcaaagtcaaactactctaggtttgattaattttatagaaaaaagtagtaatatttttaacctaagacaaatctctacaattataaaaattgaagatgtttttgccagtatttttttacgtcatccgtgtatgagtcggtttttaagttcgtttgcttttgaaaatacatatccatatttgagtcagttctatcgttcacttttgataattcagaaggaatcatataagaaatatgtttaaaaaaaacgtgcatgctaacttgagacgatcggactcctaactgattttcttaaaatatatatatccaagcgaactcccacagtgaatttcatcttaactaaaccatataaca

SEQ ID NO: 100965 - DNA, 1305 bp, Oryza sativa
aactcatacctcaagcatcagtgagaaagcaaatattgtcattaacaaaaccaaatcccagtccgatggacaactaaagctcgtgacatagtgcagaatgtatctgattacgtagagcacttaaggcataatgacgtgcgttgtcattgaattatgccagattccgtccttgaaagacatggtttttgtctttacaaactgaagccgcaattgaaatgcaggataaaaggcaagtacatttattacattttggcataatacataatgaaaagttttatatatatatgacggtacggcgatataatagaactgcaattttaagattcagaaagcaacatagttagggcctgattcaaatgcaccgtggttctttacaactcataagaacgtgcaagtgcaatattaggctactggtattaattattgaaaaaacaatggagaattccatgacctacaattgctagtgctcaattatctcgaatctagtaatatagaactcatgaacaaatgcacgccgtccatatctatactattcaaaaaatgaaaacttttattgagaatcttcaggtgttcgctcgggaacattggatggtacatttgatcaaaagatattaaaatacgctactagatccaaaacactaactaccttaatcattacattcctatcagcataacgaattacggcgcggaaagcaccaggagtgttcaagcactgaacccccaacccgttacaacaaaacgttcaaacctcccttgccacagagccccgatcttcgactacgcggggcaattacaacctcgacgcatctcaaactattcccaaaacagttcatcaccacccactgcgcacatccacgccgccgctcgcgaaccacgaccgcatcgacatcgcatcccccacgcaatgcaatggaaaataatttacatccgcaacgaaggctctctgatccagatcggagggggaggctcacctcgcagtgcagcggggttagcacggccggggaccgaccgggatctggcgccgccgcgccgacgacgacaaccgctaccccgaccgtacgagggacacctgggatgggaagacgatgcgccgacctggaccctggagctcgataacgacgagcggaaaaaggaaacccaaaaaaaaaaaaaaagcggcgcggcttcgaaccagaccacgacacggccgcgcgtcgagcaggcaggcggcggcggcgcgacagcagagagagagagacggcggggtagtataccgcggatacgcggtggtggtgaccgggacgagttgatgacggcggcggcgtc

SEQ ID NO: 100966 - DNA, 562 bp, Oryza sativa
agggtatggggaattttttaaaattttgaatgtttctaaataaattaatgattactcctacttactaacttcctgctatttctgaacgttggcacgccagtgtgagtgacaatcacgacaataatgccgcggctatgatggtttggccacaaaactgtgggcagctcccaccatggcgaggcaacatggtgtgtatttcaaagtaatttcgaagtaagtttcgtgtgtgtgttttctttaaaaagcttaaaaaaattcctaagctatgtatgcacatgtatagctagttgatgccacttactctcttctcttctggcgatacatatttaggcccactttgattcaaaggaaatttataggaattttaaaggatttcattcctataggaatttttcctatatatccctttgaatcaaaggaatgaatcctatgggatcctatgaaattcctatggaatgcctcttcccatgcaaattttggaggaaatttaacatgagtttctacctcattttaagaatcctttgagtctttctctctcctcaaattcctgtgttttttctac

SEQ ID NO: 100967 - DNA, 679 bp, Oryza sativa
ctttctctctttctccctcatgtgttatactgttctctcatatctatcttctttgaggtagtaatatacttgagcaaattaagctgcttaattatttgtgtatgatgatcagctgctgatccggcctcatttcttgcatatatgaccacaaccacatacatgcttgttcattttttttcacaaagaaagagaacagtttaatttaatttcttggggttttggatcagttaatttgtcttgagaggggaagagatctctatgggttttggaggtctgacagaagagagtgagcacacacggtgctttcttagcatgcaagagccatgctgggagctgtgcgtgctcactctctatctgtcagccgttcaccatgcccaatatgattaatctccttctctcagttgacagtaatttctttgccagatctcctgttaaattttctgcctagctagctattatgcacatgcttattatgatgagcctgccaatatcatctccacggcaaaacacaaactagctatgatttgattcattatatttcttttcgctgtttaattaattatatgcaggcatacactagctagtttccagctagtacaaagacgagacgaggtcgttctgacgattttcatagtcgtcagaagaaggtgtgcattggtttaatttttgttcttggctg

SEQ ID NO: 100968 - DNA, 649 bp, Oryza sativa
atacccatagcactaaatgtaggcaatggaatttattaggatttaattgggcctagcctattaatctaacagttatggcatatcaatctctcgtctagattcacttatgtacatatgaattttaacacatcaaatacacataaatccgcatgaacctatccaagacccaaaacttcttataagtaaaacagaggaagtaaaaattaaggcatgctaaaaacggatgaagcctcgattgatagcgatcagtatacatatattctacaatttccttcatttcaaattataagacatttcagattttgaatagattcatgcgcggatcaatatatgtgctccatatatatgtaaattcatatgtatgttaatgaatgtagacaaggattaagaggctaaaacgttttataatatgaaattgaggctgcatttttatttgttctagtcccatattttggttttgtggtttaagtaaaaaaaattatacttaatcatcaaattttaattttaaaaatttatatagtgtaacattgtaagatttaggtttttggattaaaaaaaaacttctatactagcagtaattgctagcataggatttttttgacacaagtagtaatactgccatttttaagtgtaactgtgcctttttttt

SEQ ID NO: 100969 - DNA, 559 bp, Oryza sativa
attgacacttctatctggggattcgatcagtagctgtcgtagttatttcattgatgtacacttctatttgggaattcgatcagtagctgtcgtggttatttcattgatgtgctgcaaatcgtactgatcatgcaaacggctcgttgcttcaaaggataaggatgttcaattttgattagttatatctctctttctgttaggtgccttaataaatgcttctggtggtagcagaaatcaaacaggtcagggaagggcttttgctgttggggaaaataggagatttgcggcccattacaatggggactaaaactatgtgcttattgcactcattataatcgatctaaagaatgacaaacactggtggtacacatggagattgcttccataatgttacaactgatgatttatatagacagataaaatgccttgcagcagcagcaacggcgacaatggcaacacaacatagcagtatctctactgcattggagacgagcgaacggagaaggctgcgccgtcgttgagaggcagcaagctataataggcgccatctttgtcgatg

SEQ ID NO: 100970 - DNA, 963 bp, Oryza sativa
gtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtctttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaa

SEQ ID NO: 100971 - DNA, 640 bp, Oryza sativa
cattttcaataggtcaaatccaatgttcttttccatccgattgattttccttgccaaggaggtcagcccagccgccctttcggctaggatgacaaaaggatgatctatgaaagggacgtatgcaaattatgataaacatatatataaaaaatggagcttgtagttttttcaacccgaattctacatgaatgacgggggatcgaaatgacaatgatggagggcgtggccaaggtagatagtgttttaaatatgctgagctattatttttcttcaagtaaaaggtacacgcttttatccgaggccagaaaagtctaccaaaaagtttttaaaaagatcatttggcgaggaggggaaaaaagtgtttgatacatgttaggtgattcgcaaccataaaaagcacgcaattccatgattataactttggtacgtagtgttgtacttaagagggtgaacactctctctattttatatcataataagttgatttgacttttttcttaatcaaacaaagcaacattttctacacaaaacaaaaatgttatcaaagttacatgtaatgacgaagctaatttaacgttgtgaatattgctaatattttctataaatttatcaaataaaaaattcaaaaacaaaatgactt

SEQ ID NO: 100972 - DNA, 748 bp, Oryza sativa
gtattcccacatgaaaatcgatcctccattttctcacctaagccaactaggctggattttacatcaacacttttctttttttattacacgggtagtgtattaacgtacacgcacacagaccacactcacacatccacgagtgcaccctctaacacacactcacatatccatagtcccattgaattcctattgaaaacgtactttacgtgtgcatagtattcgtggatagcagaatttaaattatgatggataaagtcatgcatacacccacaactccaccatcacacctccgatccattgtaatgtgcaaaaaaaaattactagtctttgtaaaaagacaaagtcgattgcacaaatatactacaaatatatcataatcgaatcgtaccattaattcatcaaagttactacatttcccttcatggtcaaccaagatctttaatataaccttcgagaaacaaaatctttcgatgcacaaacctactgcatatatatgttgccatgttggaggatgctgatcccaccaacatgagaaacaactaagatctatgaccacagaatcaatccaccatctcggctaggaggacacgcacgttaggcagaagatgactgaaaacttcaggcacaagagatgactgaaatacggcagaagatgacctaaaaaaacttcatgggtgacacacgtacggttggttacctagcattgtatgtagctagcttacattggcagatgcatacatgcatgtac

SEQ ID NO: 100973 - DNA, 553 bp, Oryza sativa
agtttagaacagtaattaatctcgattccctagctacttgctcgatcgagatcgatctgagcctttttgcgtctcaatgattagcatttgtttactactagcttgcaaactgtcaattttaactaggaacgaacacctgtgcagagaagataagataaaataaatgacagacgcagcatgcaggcactttgcgtagtgcatacagagttcagattatacatgagatccaaaataaaagatagaagattatgaaaacgacatggacgtctggagtgagcaagtgagttgctatcctagatgctccaaagttgcagagaggttcctgacctactttggagactttggagctagctagctctttcagacagataccgaaagtttcttgccccctttttatctgaagaaaaataaataattcagagtcaaaagtatgcaagaacatgtttatgctcttgagctaacacttatatatctgaatttgcagtacacacgcagagagataaatcggtaatttatacctgttttatctgaagaattggggtgtgtggagccg

SEQ ID NO: 100974 - DNA, 1704 bp, Oryza sativa
caattaaatttagtaggcactgattagcctagcttaattatctcttagtagttcgtcatcatgggagatacagatgaaggcgtatctttggagccagtcaagagacttcgatacctcagcgaatctcccaaatgacgacattggacggctacgtgtaattatacacgtgtcacaacaatggaggtcctcaattaagtatagttgaaaaatcaagcgaagttaagtttaaaacgcctcagtcgttttaatttacaagtcacaggcttgcatgtggatctgaatggtagatgccaaaaatcatttttacatactctgcagagaaaagtaattgcttcaatagtttctccctatcttacatactctgcattaattttttacttgttcagaacatatataaggtttccagcgagaatgattgatcattggttcattgttttcctattcatatattcataaaaaaaaataaaagtacaagtaaatcaaagatttttttttgacaaatctactaacattgttttcaaatctctcaaaaaaattcagtatattagcgactttgcatgcatcctaaaatgatctatccaacaataaatgttatatccatttcttctacctggtttcactctggatctatggtgttattacagggttgcaggatactttatgcagtggtgcaataaatctatgatcaagagtctttcgtcctactttaggtggtgtacgtagctagttcctataaacttctgttatagaaatttatgtgatgtctttttattagttcaactcatttctttgaagggagatggggtttgtcacatggaagtatatgtattatgtgtacacaagcttcttatgcatattgcatagcaactaacaaatatcacaataaattaaaaaaaatatgtatatactttcaatagtattacatctatgtgtaaagttttaaccttaagttcattatattccagcctaaaaaaggaattttgacagttttaagactataaatatgtcagaattctttctctctctgtgtataatgaatttgaagatgtgacactatacgcatatgtagtactattgaaagtatatgtatattttttaagaatattttatgatatttattagttgatgtgcacgatatatacatgagaaagcttatgtgcatataggatgctttcccttgtcacataacctcgtatcttttaaatattttaaattaaagtccgaactaaattgattgcctaacgatagaggctggaaacacaaatcattttctttgacttttttaaaaaagaaaagctaagaacaaagggagcatattttttaagttttgaacaacctttacctccaaggcactttaacttacaaatagagtagctatacaatatccgttagttttttaaagctttcacatgtaactatagaattagaatgcaacttatatgtattttgtataccagctggctagcgaagcaagctctcgtatgcccaaatctcgagacaatcaaatagccataaattaagttttgagtaaaaagaactgatttggtcctactccatcttttttcctggagtgcgcccaagatttcaagacaagtattccagaggattttgaagaaaaaaaactttatttctttttttattgaaagtttggtataaaacatatgcattagatgcagtggcggaggcagcgtgggggctgggggg

SEQ ID NO: 100975 - DNA, 884 bp, Oryza sativa
attgttttttttttaatcacaggatgctctaatctatccatcttttcgctccattttttaatagataacacgccgttaacttttagacacatgtttgatctttcgttttattaacttttttatgcaaatgcataagatataaattgtgtttaaaatacttttagtgataaaacaactcacagcaaaataaatgatagtaattagtaagtgtaggtgtagtatgtgggtgagggcacgagcgtctaatattgtactcaacagcctaagatagtttaacaaggaagatgtttttttttctcatttggtgcccccctcattcggttacattatggagtcattctatggttacattgtggtgccccctctctatttaagagatttgctaggttacaaagtccgattctaactctaaccctaaccatctattacaactccaaatccatccgtaactaaataggactaatatattcgacacatattataacaataaatttaatactgaattacacattctatttaaatttaaatttattattttatctttctaattgtataagttgaatttgaacctgcgtgtttatgaattgatatattaattatgttttagattataagtcattttgactttagttaaagttaaattactttgacaaattttgtagacaaatatattaatatatacaacaccaaattagtttcattaaatctatgattgaatatgtttttatagtatatttgtcttgtgttgaatatattactattctttcctacaaatttgattaaacttgaaacaatttaactttgatcaaagtcaaaacgattatagtctgaaagagagagtaccatatattgatatatcttttttttttcaaaatttcacagta

SEQ ID NO: 100976 - DNA, 1160 bp, Oryza sativa
tttgaagctgatccaaagaagctagatagccaagcgacgacgaagggcccgcccgaccaatgcctagctagggtggctgcgaattgaacctgtgattgccaattgggcgagagacaaaactgggccgagtcacacaagcagctaggatggagcatgcatggaggaaagaagacgcggtcgtccaagatgtagcgatagtagacactagacacttagagcaagtttatagtatagacactggctctaaatcatctatagttaatgttatagccaatttatacaatagttgctgactataatattaatacctggtctcacctgtcatacacatatttctcttggagtccgcgctgcagctggctacaaatctgtagcccactgctcttctctcttcttttatctctttaaaatatgtttatagctggcttatagtctgctcttacagtgtgttctttccttcaagttcccaacccttctccctcgttttccgcgcgcacgcttttcaaactgctaaacgatgtgttttttgcaaaaagtttttatacaaaagttgcttaaaaaatcaaattaatccatttttgaaaaaaaaaagctaatacttaattaatcatgcaataatgcgtgctccgttttgcgtgccagggaggaggggttctcccgaacgcagctggcagggttgtaactgcaaaatctgcaacttagtactccctcattccctaaatatttgtcgccgttgacgtttttaaatatatatttgaccgttcgtcttattcgaaaacttttatggaatatgtaaaactatatatatgcataaaagtatatttaataataaatcaaatgataggaaaggaattaataattacttagattttttaataagacgaacgatcaaacgtatttaaagaaattcgacggcatcaaatatttttggatggagggagtaagcactaaacagggtccttttcgcaagagttccgaatcgcatgggccgtattatgggcaggagagttagctgggctgctgggctttaattgggcatagtgagtcggacgtaatcacgtaataggctggaccgatggaacctcaagtgaaagcatttcatgctggctcgtggttagtaaaaggaataagttcatctaaggtcccttaacttatgaacg

SEQ ID NO: 100977 - DNA, 524 bp, Oryza sativa
tatacaacccctgcattaagggaaaattgcgtctgctgctgtgacaaccgacaactgccgttcaaaccttacatcttgatccaaatagagtttaataatttgtttcctatacttcctaccaaatgttctgattttactgaacccggcgttggtgagctgttccattgtgtctataggcatcaagcttcagtggtgcacaggccagcatcactgcatctgccacgctataaaatgtctaaacaatacattaaactttttacactatattcaaagaaatgggcaccgtctagtgccaatttgttcaaaaaatacgtgctgattcgttcaaaaatacgtcttaaccatacattatgttctgatcttactaagcctgacccgtctaatccttttggacattacgtggctgctatctgaaccacgtcaggctcaacactgtcctccaagattagccttgtccccggtgcgacggccgacgggggaggaagaagcagcagctccatgcacggcttcctctggcctcacgg

SEQ ID NO: 100978 - DNA, 882 bp, Oryza sativa
aacgattgaattaaatagcataaagttgaaaagttaggaaacatgcaaacgaaaatcccaaatccagaataagaaaagaacgtggctttaaaactagcattggattcatgagaaacttatttgtgtatttgtttagaaaataatattgttatattaccaagttaataaaataattatgttacggtaattccttcgttccaaaatttgactcagtcacgtaaccattttttaattttaagttcgaccaaatttatagaaaaagcataaaaacatttaggggttgtttatattgcagccaaaataaaccttaccaaattttggtaatgccaaaattttggtaatttggctattatgtatttactaaagtttgataataaactaaatgaacgcatatatttggcaactctatcaacaaatgttatgatttaaaatggcatcaatctgaacaagcccttaagcccttagaacatcaaacagattatatacatatatttagcggtggatttaataaaaccaacttggtattgtatatgttgctatattttctaaacttaaagatgtttgacttagcacaaaaccaaaacatgttatattttaaaaaggaaggagcagaaattagttgttaaaattatattttcaagactgtattgatacccaaaagacacatttctaaggatagatggagtaatacactaggtttacatataattagaataaccactaacacagtaagtttatatgtaattagaatatcaattaattaaatgagaacatgcactggcccaaaattctgtattagacttggactataatttaatatgacgtatattaatttacataaatatgattttccatctctgtataaattaagttggttattca

SEQ ID NO: 100979 - DNA, 509 bp, Oryza sativa
gcccgttcagtttctcccactattcctggaccgactgcgtaggctcccatgccctggttcaagaagatgattctcccaatgatcgaatgtcttccgcattgactagtcagccgaatcgttgctagatactacctccgtcccaaaataagtgcagccatggatatccgtgcccaacgtttgaccatccgtcttatttgaaaatttgtgaaaaatttaaaaatatttagtcacacataaagtactactcatgttttatcatctaatagcattaaaaatattaatcataaaaaaaatttaaataagacgaacggtcaaacgttaaacgtgaatagggtaaaactacacttcttttaggatggagggagtatgttaatcaatggccagggttctgatgcaattaaaagccgttcctttatttcagttagtacaatcagagccatttatgacaaaggtttaagagcagggataacagtgaagcttacttcctactattagcctatcttaaagcc

SEQ ID NO: 100980 - DNA, 702 bp, Oryza sativa
tcctagtatgtgtgtgaacaagattggttggctagcatcgtgtggttcatgtgtaactgttgacatcaaaatttaaaacctgacatcctgttgttatcgggtggagttatccatctacaactccaccaccatacatcatctttttcggttttcattgtaatagtatgtttatcaggttttatttgtttcgcagtaatggttaaattgtatttcaaataccatgtattatattccaaataaggcgtttttaatccggtgaccgggggcggacatcaggggaagaaattttcaaggaactagcttggaggtcattctttcaagatgtcaaacaaactcctcttgtgtgcagtaataatggagacagggtgcaactccgatacaccaccacatgcaagatacatgatcttatgcatgacattgctctatatgttatggggaaagaatgcgtaactattacggataggtcctatcgcaaagagttgttgtcaaatcgttcgacttaccacttgctcgtgtcaaggcatagaactggagatcatttcgatgattttctgaggaaacaatctacaactctccggacattattgtatccaacatggaatacttatggatcgatacatcatttatcgaagtgcatttctctacgtggactgcagctatatgaaatcaaagaacttccaattagaccgataaagttaaagc

SEQ ID NO: 100981 - DNA, 1236 bp, Oryza sativa
gtgtatgagtcggttttaagtttgtttgcttttggaaatacatatccgtatttcagttggtttttaagatagttcacttttggtaatacaaaaggaatcatataaaaaatctgtttaaaaaactcacatgttaacttgagacaatcggactcctatctgtagctcatgattttctaaaagaatatatatgcacgcaaacttccacagtaaatttcatcttaaataaaccatataacaataataagattaaaatagacttcacccgttacaacgcacgtgcattttttttctagtaccataaaaattctcagtcatccgagtaaacatatctaatttttactactactaaattggttgtactagatggttgaacgtcggggattttattggcttgaattcctgcacgcatacattttctaagtttccgataattagttgacaacccattttccaggcaaacgttaaatcactagtgctggaatctgaggatacatttttggagaagtcaagggacatgtttgctacacgcgctgagtcaccgaccaatgggacccacccctagcccggcacggtaacatgcatgcataagcttgtatttcaaattaatttgatagttttttattgcaacctgatttaagtttagtgtggatttttacatgtacggattcacctaaatgtattttaatttttatgaatgcctttgcacattagcttttttatatctatactagcttgtagatatttgccaaattacaatactttgttttaagttggaataactttttttctctttcacctggcaaagcatgagtgagtgctgctacacatcgatactttctatatagtcttctatatagtcggtacccactaacaattattaaaagttaaaactcaacatgcaagtatgccacatcatcacccactagcaattactattctagcccatttaaaatcctatacaagcatgcaacatcttcactcactagaaagtactattctagcctattttaaatctcatgtaagtataacacatcatcaacaagcatgtgtcaaatcatcttactcacattattttttcaacatttcaactttcatcatttcgacaatatttaatatatacttatccataaatctcgcagcaaagcgcggggtatcacctagttaatatgttggttgacaaggcaatggcatatcatgtagataagaaaaaagtaagaagttacccacctaaatttc

SEQ ID NO: 100982 - DNA, 1043 bp, Oryza sativa
caaccgctacctgtccattgataggaagatgtttgcttcgggttcagctcgattcgcatcatttgacgctacgaaagggcatttgcaaacgatgccttcgcttccggggtagtttggctgtgcaatggctattgtttttatgacctcagggggatgtcatgcttgtgttgaaggcatcaagcaacgattggcaagataaggatatggagatgctccgtaaactatacccatctgtacagatatcagaattcagagatcatgcagtgatgatatgggaaaacgtatatgatcttgagtggcagtaacataattgtactaaacttgcttatggaatataaaagctatggaggctgcgcttatcatagtccacctggagcttccaatcagagaatagctgttattggtggtgttgccggaggatctttggcatgcacttttgcacttggatttttcttcgtttgtttcaacaaacgtgaaaagaatcctcagaaaaaagactgctcttctacaagaagtacgcacccttctacacaagtttgttcccttatgcttaatttagatagtactcactctgtcccaaaatatagcaaactagtactggattagacacaacctattaatacatatccagattcgtggtactaggttatatcaaatccgatactaagttcatatattttgggacagaggtagtaggtgttttacactcttgcaagtctctttttgctgtttcatttgcatttatgtgtccgtatgtgcatttcgtgtgcatgcgataagaagccttcatttggtagatgaagccgctcttatatatgtctcacactttgttagatgaacatgcatggtagtaggccttgaaatttgagagccgtgtagtaaacaggtttatccaatttttgctctttgatggaggctcatcaacagaagtaggagctgcattcatcagttcatcgtgtcctataaaataaaatacacctcataatcacttattgtctaaatactcaaaacaccaataaattctttctataatgttgtatgca

SEQ ID NO: 100983 - DNA, 696 bp, Oryza sativa
cctatgaacagatcctaaactcgaattaatgttgaaggagatagtactagcactctctggattggattagtcagagggtcagacagcggcagccagtctttgcgatttctgttgctccgtgggaaatagaaacaacagatggactgaacctacagagaaaattcggataatttgatatttcagaaaaattcaggattcgacacttacccattgagcagggaatcgtagtatacaagtgggaactagaagtagaataaaagcaagtactacctctgtcccaaaataagtgcagctgtagatatttatgtccaacatttgaccgtccgttttatttaaacaatttataaagaaattaaaaaataatcacatataaagtaatattcatgtttatcatctaatagcaataaaaatactaatcataacaattttttaaataaaacgaatgatcaaacattaaatataaatagtgaaaaactgcacttattttggaacggaggaagtatggattaattatatcagatattaattaatgcaacagtttcctgtttcctgtttcctatatctttcttcgatttgctctgctcagtttgattattgtgtgtagatagccaataaccgtgtacaagtggctggactgccggaggaacgggagctttgtctgagccacatcagattgtaattgtcagagcgagcatg

SEQ ID NO: 100984 - DNA, 814 bp, Oryza sativa
ttttaaatgtatttctaagttaactcttaacttatctttcaatattctttaatttttgatttcaaaatctagttactattcctatattgattttaaactcttcttcccatgtttttttattttgaattttatttatttgtaaattgcatttttatacggactctaaactctacttttaattttattatgtttattatgaattttagttagttttatattcctatatgtactctatactctacttctaatattcattatttttaattccgaatttctattatttcttaattgtatttctatatggactctatactcttcttctaatattctttttttttaattccgaatttcagttatttctaaattgtatttctatatggactgtagtcacctcttccaatattctttattttttaattccgaatttcaactatttctaaattgtatttctatatggactctatttttctttttttccgattaatatgataatttctaggccgtgagagcgaacgtagaggctcatttttctattcctttaataagttaatagatatctactctcacctgtcatatacacattgcatcttggagtccgtgctacagctggctacaaatttgtagctcgctcgctgctcttcactcttttcttttatctcctcgaaatttatttatagatggcttatagtctgctattgtacctactgtaaatagggctagattttttttattttttttgccatccgatatgctttgaaattcgtgctatcagggaagagacctgctgtcagccgattgcagcactgaccgcttg

SEQ ID NO: 100985 - DNA, 753 bp, Oryza sativa
ttcgtcctaaaataaaagtatctttgaataatgctaagtcaactattttcaaatttaactattaatagcaaaaaaattaaaaagatcaatcatgtaaaattgatgttactagatttattatttcacaaactatcataatatgtaactctttttatctactgttactatccttggctttattatatccacaactaattacctaccccgagaaggtaaccatgttttttactcgaccctctccttaatacctgtgtcaaagactaaaacttgctgcgttttaagataaacggagtaggatttttttttttttgcatacctccacttcgtaaaccatgtgacttacataactcctcagcttggtcggcttcattgtatcaccaaagaaccggaactgctcttactgcgtggcataacccgcatccagggctggtcctggggttttggggcccagggcaaaaacttatatggaggtccttattgacatgagtgtggctactggcgagctacgatttgctgtgtccacttgccgtttccatttacgcgaccgagaagttgccgcgagcgcaatagcagcgagtagcgtgatgtgatcaaggcggcgcgacgcgactggcgtgatgtgatcaggcgaagcgacgggagtcagatgaatatcgcttcggcttcgctgaaacatgcctggcgatagactaaaattcattttctgaattgggttattcagctgtctaacttaatataagcctatggtctatg

SEQ ID NO: 100986 - DNA, 567 bp, Oryza sativa
caacatgaatgaaacattggaagttttaccaaaaatgaagcagatgtaagacattgaacgaaaaatcttatagttaacacaaagaatttctcatatagattgtgaggtataaagtaaaaaaatgtacaggtatctaataaattgacatcaaattccagtgatccaccattagcagaattattttcaaggaagggaaacaaatatattgaaccagcaagcaacagaatccaagcctaaaagaaatgttgaaagccaaaaacatagaaaaaaacatgctaagtcgaccatttctttagaatagcaatttagttaggtgaatctgaaatttaatccaaccatcctcccaacagttgaactaaaaaataataaggcataggttctcaaataccagaagctcaatatgaatgcctttctggagctagatgagcccttataaatgtagaattacttgtttacactagctaatgaacaaaaaggattcaaacttacaaagaaatggcttattatgaacaattgtccacggtgcccttattgcacttaaacacgattcatcagtttttattggcc

SEQ ID NO: 100987 - DNA, 630 bp, Oryza sativa
aaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttcttaattcatatattaatttgtggtgcagataaattcatgtagattttactggagttaggtgattatacctagatttcatttttttttacacttaaaaattatgtgcagtttgctctcagaaaaatggataagatgggctcaccaaaattttgtttgaattgttagaaggcctaaacagaagaattaaattctggaaaattatacttactcttaataatcaacctagtatttgaataaattatttcccttatacacttcccacttc

SEQ ID NO: 100988 - DNA, 566 bp, Oryza sativa
atagtcaacttataataaggtgtaatcaaatgttgatgacttatcatagttatattatagtgctaaatacattacaacacatggagccgacataataatttaatataaaaatactttttcaaataatttgtgtgacatataataattaatgttatgataatctttgaaataatttcatattatattttatggtcaaatatcacttgataattatataacactaactgaaatctacgtgcatgaaaatgaaacaacgttatgttttgtcaattatatctgactttattttaatttttgtgagattaagattcttaattgtttattgtatttttcagagttatttgataggtatgcctaggcaatgatgttgctacaatacaactccttaatccatcacaaaaattatggtcatttacatttgttattttgtgaaataggtttggtaacaaatgaacaatcttataacatgtacataaacctactcatgatatattttcttacaatgagaaattataatatgttgggcataagtgataattgataaatgtacgtcaaacatcccactg

SEQ ID NO: 100989 - DNA, 1480 bp, Oryza sativa
aagtcgttcctaatattttcttaatagggtactccttcgtcacaaaatggagctacctagcacaggatgtgacattatttgctgtccagaatcgtagtaacagataatgtcacatcatgtactaggtagctacgttttgggacggaagtatatatgatagtgttatgtgactgtgttatatgtatgtaatatactgcatgtatatgtatttttgtttgattgtttttttgaaacatacatcgtacaaattggaatgctttaatatttgtgctgcatcttttatttggatcgcatgatcataacgtcataatccttcgtggtaaagggcaaaaaaatgacagtcgctaccgtaagttgtagccgggtggcttatagctgtaatctcgttggtttgacagggattcccaaaagaattcagcacggtacgcggttgttaggttgtattttacatgggaccatacatatgaaattttgaatttgtagtcctcgataattttgggaaaagaaaaaggatagatcgctcgtagtcatagatagatgggtggcataaatagagtgagtactatgattgacgaattgtgaagcatcataattgcaaatccacaggtgaaccagctagccaatttttttttaagactaccaactagccaatttaattcctatagaatttccgcggtccaaacaagggcctaaaaaaacttaactgtacctgcaatcagtaatgcagcagctaagcaaaaattgcaatgctgtaaatctaccgtaaaattgcatcttgcagctgcctaacatatattagtggcattgtcaacaaaaaatgaagaatcaagaaatttcaaggattatgaagagaggaccgagggaggattcaactggagacatggaggaagaaaattgaccaagattggagtagtgaaggaactaaacagcaaattgttcaagccatcgccccctttgaaaaggctgagtgctttcttaccaacaagatgttgaaagagacgagggaaatggggaatacctttttctagcactgttcatgtcacgacattaacaagcaatatccagtgccatcacatggaatattatcaatgctatacagtactagagtgtgatttatcttccagaaaaaaaagggaataaatgatatgttaaagaaaccgggaccaaagcctcaatgccacagaatgtagcagtaacaaacgatagttttcctctaattgccagttcatgtgaaactgatggtcagctaaatctgttggcaattcatttgactggattattaacatgtaaatggttactactacatatgaatgaaatgataatcgtaagcgtaaaaatttgaccccgagtctcaattcacctaaaacaacccaagtttgaaccagatcataatttttgacatgtgcagactgatattatgaactaaggtaggcaacataccacgctggctgctaccaggaaggagatatacctactgggc

SEQ ID NO: 100990 - DNA, 2062 bp, Oryza sativa
attcctgcagccctgatgcactagatggatcagctacgtgagctgtaggaagtttgaatctgttggaattcagtgctgtcatgtactaaaggtacttgatctcaagaatataaaggaactcccagaacaatacattttgaggagatggagaaaagacgctcgttctgtcagaataggggaagaaccttctggtggatctagcagtatgcgttcagcctcagaagtccgcttcagtactatgtgccgttttcttagcttgatagcttcaagggctgccagatctgaggaggcaacgtcttatatcgaaagtcaatcaagtgttcttctgaagcatctagatgatattttacaaacaggttatcctgatataggaaatcatgttgttgcttcaagtagtcaaccaatttcttttgtgggaaaccaacttcctgaccatacatcacaagcaagaggagttccacagaccacaaatggtataaatttgaacatttctgccaaaatcatttattactgatttcaagtttttaacggaagtgatgaccttgtaggcctgatgggggtttgacagagcaattgcagtccagaccatactggctactatggtacgtatgatgtagctattttcgattactttttacatgccagaaatgtactgtactttgtggtatgtagcaatttgtacatgacttgaaccataacttgacatgttaagtagtactcgtggttctgaagggcataattatggagttgggggttcaagcattaaaattctttttttttttaatctactgatctagtcccatactcccatgccatgtgtccaatcaatagtaagtcttggtaattctctatttcaggaaaatgatttggtaacagcataacacagatgctatttgtacttgatgcctccaaccactgacatatatgccagtatatatgggtttatggtgggcactcagatgtttgatgcgtataggaatgatgctatattactatttgagaagtttttccttttaattgggcataattgtccaaaaactcttctcaacaagaaaatttaactctattagttttagtatttttgtgctttctggctaactcctttttgtactttctgttatatcggattaacattgttgcttgtttgcacttctgaaactactgagtgtttcggctattacacttgacttttgcatgttagagcttatgttaagtttccatgtgtcaatttcttattgttgatgagtacttctttggaagtactgataattggcttgtttcttaacttttaggtctgacatcattgttggggatttcaacggttgatgagtttgtaaaatccagcagacaattgggattgaccagtgggttctttgtagtgttagtcaaatgcaggagtatggctaggctatgtacagtatttatctggtaccatgttgatgcaagcaagtgtattctgtagatcctgtctttctcaaattatactttggtagctgttctgctaaatataaccaatcctgatgtctctgtgctttagcattttgccatggccttttatgattgttcaattatctggattagaaaaaagagcagtagtgttttttttatgaccgttgcaattgaaagggacaagggatgataaatttctcatgacaacttatccttccgtgttcaaatttattgatatatctgcaggcagtcacagcctcacaaattacaacaaatactttgaatatacattaccagaaaacaagggaataatgaaatattatgaatacatttgcattggtagaatttttcttttaattttatatagctactgcagctgtacttggaccccagaatcatatgtggcccctgccgtccagttctggggtactatgttcgtcggaactagccatgtgtcaccaccacggggagctccgctactaaataacatccttatagacagaggcccacttggtggagagacagcagcccacactgcaccatgagtccggctcataagttggcatgtcaaattcacagtctgcatcaagtcatgaacaggtatttagtacta

SEQ ID NO: 100991 - DNA, 679 bp, Oryza sativa
aatattttttgtgtatcaaagaatcaaatgaattatctgaatagagagattccataatatgtggttactttagtgaaaaataattcttctattcgatgcaacattagatctatacatagtgaaacattgtaagtattctaggtgaaacatttttagtgatacattgtaaatccttatttaatcactcactccatacatatgcaacgttttcatataacctagtgaaacgctatgaactacttacgataacatacatatagcgccatgagatacattaaagaaaagatatatccattgtgacaataataaatgtgtgcagcataatagattttaagctgagacatatgattctcacatatcaaacattaagtttaattggttgaaacatatgtgtgtgtttttattataaaatagttatgtgaggtcttgtgtgtaaagatttaattataacgaagacaatggtgtaatcgtattgtagattggatgagtaatctagaagaaaaatcgttttcatatttgctaaaagggtgttatgcacatgcaaataacctcgtgtcatctctcctttatgcatattaatgctcagaaaggaagcatatgtagcagatagaggatctgacaaaggctgtatgcggcaaaatcataataagaggtgtccgatttttttctcaagatcgaa

SEQ ID NO: 100992 - DNA, 664 bp, Oryza sativa
tttcactggaattcggcttgatgagactattttgcccctccttgtcggttgaaaggggatcgagatcgagcatggcgaggtggtcaccgttgctgacaagggcgtctacggtggtgtgagatggggcaagaccgagcttgccggccgagcaacgcgagcgcccccatggccgttttcatgggcgctgggacaccgccgcgccgtgtggagcaccgcctacttgcgcgccgcctctgccttcgtgaccacccagcaccttcacctctgcctcctttaaccggtgccgtcccggcaccttctcgccggaccggccttcttttcccatccacccgacgccgcctggccgcccttaggctcgcgccgcgctgggccaaccgccatcgtcttggtcgggtcgtccgccgtgccgccgcacccagtcttggcactgcaccagctgcgccttctcgcttgcttagaaggaagagagaaaaggggaacatgaagagaaaccccggggaagaggagaagataagagaaacccctccgtggcgaccgcaatgtgggtgttcagccacgtatgacgagacacaacttgtcctcccggacgttgctgatgctgaactcgccgccgcttgccgcaagtcccggcgcgacctacgaccaagacagttggtggcagttg

SEQ ID NO: 100993 - DNA, 705 bp, Oryza sativa
tggaatagacaacccgtcaatgcccactaaatttgcaggtatcgagtcgagcgtgtcgacggggaaaagaaggtgcccacgcccgcgcccgtcgggtatccgtggatactcgaacccacgggcaatactgccatccctaaattggagctctaccaaataagctcttatttctaaaatctaaaccatttggccacgccaggcgggatggcgtggcaaaacaaaattcacacgtcacctacacgtcacaccaacgagagcggcgtggtcaaataacgttgccacgccactcgtcagtgaaaccagcgtagccaaataacattgtcacgctaacaagatcagcataacaatagttttgccacgtcagtttggctgcgtgtggttaaaatattcagatcttaaaaataagttttaaaagtgtttatttttaaaattaaaaattgaaaaggttcagaaaaaataaaaaaaaaataccgcaccttgatcgcccctgcttggcagcgacgcttccgtaccccgactccgactacgagtccaactcgcctccccgataaatccagcccgcctcgcctgctgataaatccagccctaaccctaaccccaacccaagcccacccgccggccccattcgcctcgcactcgccctcgcctcacgccgcccgatcccccagcgcgcacgcgcgcgcgccgagacgacggccgcggcgg

SEQ ID NO: 100994 - DNA, 655 bp, Oryza sativa
gactctagacttgtcttttaatatattttttaattctgaatttttattatttctaattgtatttctatgtggactctaaactcatctttcaatattctttaatttttaatttcaaattttatttacttctaaattgtattcctatattgactttaaactcttcttcctatgtttttcttaatttcgaattttagttatttgttaattgtatttttatacggctaaacactacttttcattttattatgtttcttctaaattttacctagttttaaatttctatatagactctatactctacttctaatattccttattttttaattcttaatttctattttttttcttaattgtatttctatatggactctatactctacttctaattttccttatttttaattccgaatttctattacttcctaattgtatttctatatgaactatatactctaattctaatattttttatttttaattccaaatttcaggtattttctaattgtatttctatatggactctagtctcctcttctaatattccttattttttaattccgaatttcaactatttctaaattgtatttctatatggactctagactcctcttctaatatttcttattttttaattctgaatttcagctatttcaaa

SEQ ID NO: 100995 - DNA, 575 bp, Oryza sativa
aaattcctttgttgcatgagtacaagggccctgttaaaaaaacttgaaacacactggaggtttgttcaaattttttttctttccctgaggtggttttctgtatgtattctgcaacttggttgtaattacaggaggagagaaggctattctatgttgcaatgacacgagctcgaaagaaactgtacatcttacatgtcacggttgactctaatcgccaggcaggtgattttatattgtattcatccttataaagtatctagatttcactgacttaaactattactggcgtctagctgctgcaaccttcacgcttcctcagggagattcctgctcaccttcttgaggtacaggtgagcactattttgagatcctgttttgaatggtatcgagacctgaagaatggtatctctatcccatattgttgtgtattccaccatacaatctgcttggagcattttaaaaaattgtaaattttagatggtatacagctatatatcaatctagaaagtcatttatatgagtaatataatctattatagcaatagtagcttaacataattttctcttttcaataa

SEQ ID NO: 100996 - DNA, 590 bp, Oryza sativa
gctcttttttttttataagggacatgagatatttgtggtctcctattaaggtattcatattaatttatttctatggggtttttttagttgtcaattatactatcgatattatctatcgagaataaattgctctgttgcaatttgcaaactgctttatttataatttatcatgttagaaatgtttatctgtgtcactctatgataaatcaatgtgctttatatagagtatatatattagaagtaaaaaaaatcattaatttcttaagggctcatagtgtaagttcgcagttcgcctagggcctccaaaatgtcaggaccggccctagcaatggtgtcatcgtaaggatagcaaattattatgtgtataattacaaatttacaatcaggaccatcatccctccacatatggaaatgaactttggaaactcttttaaggcaaaacctttcaaaagatttttttaccccagacacacttccacctggagcccacaaggccacaagagaggttaaaactggaaattttcacaaatacataaatacaagaaacacgtccttccaaaggcccacaaggacctgcatgcactggagca

SEQ ID NO: 100997 - DNA, 709 bp, Oryza sativa
tagagttcatatagaaatccaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaataaggaatataagaagtagagtatagaatccatatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaacta

SEQ ID NO: 100998 - DNA, 675 bp, Oryza sativa
cattatcacaggttgtattttcttttctgctgtattcagtatacatctatcactgtctcagtatagactattatatatattggtagctccaatttgcaggttctggtgatgggactattggtctttttgatatccgtgcttgttctgcattaatcatttgtcagtgggacctggtgtaatagtctctttactgctttctgtgggttaccagatatatactagtgggttgtatcctattttgagtaatttctcttgaatatttgctttgatttacgggtgagtgtgatgtttgttgtttgcacttttactaaaagctgatattgccgtagcatataattgattgattgctgagtggcttgaataattatctgattattctgcactatctgagtcctcatttatccttgcaatttttgtgcctcagtccctttgggatccccattcaatgtagtgaaagaaaattatcgcaacttcaattgtgttgtttgggaattccttttcgctcaaccagcacaggccacaactctaagcattgaatttttcttgttgtttagtacatggattacttcacacatcccatggatttggtacatttgcacataagttgtatttgttggatgttggtgcatggatcatctgcacctatcattggctcattcctgaaagtgtgtcttt

SEQ ID NO: 100999 - DNA, 533 bp, Oryza sativa
gaagatccaattgtaagtttctactgctgcaaatgacaggttgtgatctcaaaaatgaaaaaagaaaaaagatagtcaatctactggacaaaaacaaaagaaactaaatgtagatgataattgcacgtaagttggattctgagtatctttgttcaaaaagttactgtacggcgtaccacaaatatgaacaggaaccacactggaatgtcttttgcaccactagcaaccaacatgccaaaatatattacctacaagccaaagtaactgtaaatgttaatgccataataatttaaaaccacaggagctcttttagtagctcagtgccctactgcatcaactgtcaagtcaaaaagcaccaattgtgctacacggaaacatatgtgctgtcatgttagaatcatctagttacttcacgcaagtgagataatatgaaaactcaaaagatattatccagttttatcatctttaagccatgcaaagaatgttcgcatatgtcagtacgggggggatcctctagagtcgacctgcaggca

SEQ ID NO: 101000 - DNA, 622 bp, Oryza sativa
tcgttttatttaaagtttagtataaatatgcaaaagtgtaaattaagattataatttctttgataataaaacaaaccacaataaaataaatgatatttatatcaattttttaatatgatgaatggtcaaacgttatatgaaaaaacgtcactgtcatacaaattttgggatggagggagtatccttttagttttgttacaagtaataatactcataaatacaccactgataataatcatctgccttcgaggtgaacagatcgaatagtaggcccgttgcaggactgtaacatacctaaattctagggtttaaaattccttgtcaaaattgttggaagataaattttttatttttgcgagcttaaaattttcattttaaacctaggtaggtcaacccaacttttgcatatagggaattttggggctagttaaaacttttcctttccaaaccaaaatggaatttgagtaacaaagtgtaagcatgcatatgcatatagatcatggttaggtttgagtccttgtgtgcatgttgggtatgaaactaagtttaataatatcaccttaggtaaagaagtgttcaaatataaaatctataaatgctcaaatgcatttcgagatgaaaa

SEQ ID NO: 101001 - DNA, 581 bp, Oryza sativa
aattatgaccaaataaccaacaattggttggaacttgttgtaaatttaaatcgtttttctaaaagatgctgcaagatctggcattctaactagatctcagcatctcggaggttcctggaatttatgcggatggagagcctggacaaaagcagcatggcttaatcgtatacacagtagacagccaaagaacattccatccaaaagatttacattgcaatgttcatcggtaactagcatttctgtaatcgagacacacttggtgatgcgtggatttgttgttggctacaaaaattggtcacaccattgagagatcccaagctgccacacgagttcccaaccaagagacacacgatgaagtgttcaagggtaggaatttcatggtagtagaagaatccgttgataatgagttggatgatgatgttggggtgacgatggtcatcacacaattgatgatgtcgatgatggtcatgtcacggtagatgatgccgatggaagagatattgcgtcatgctgaacctgaagttgtggctgggtctgctcgtggtttggataatttcaatgtattacaaaaggcagcaaag

SEQ ID NO: 101002 - DNA, 672 bp, Oryza sativa
agtattaaatataaacgaaaaaaataactaattatgcatattgcgtataaattgcgagacaaatcttttaagcctaactagcatgatggcccgcgcagattgcgcggctaacatcattatattttctctcatataatagcatatatatttttttattatattattaaaatatattataatgacaatataattttaaattttacaataactttacgaaactactaatgtataatattcatattatattttatatacgtattagttattaattatttttaatatcaaattttagttatttgtaaattatatatatttctatatggactctagacttgtcttttaatatattttttaattctgaatttttattatttctaattgtatttctatgtggactctaaactcatctttcaatattctttaatttttaatttcaaattttatttacttctaaattgtattcctatattgactttaaactcttcttcctatgtttttcttaatttcgaattttagttatttgttaattgtatttttatacggctaaacactacttttcattttattatgtttcttctaaattttacctagttttaaatttctatatagactctatactctacttctaatattccttattttttaattcttaatttctattttttttcttaa

SEQ ID NO: 101003 - DNA, 582 bp, Oryza sativa
accccatttccatagattatgaattcagatgtgcggcctagcctttaaaggatttattagaacatcagaatcatacaataaaacaataaataagataagattccaatcatctaaaatgattcctacacttgctaagatgtaggaaataagagcgcactgaaagcagggaaaatgtgctcatcatactagcaaatatgatacaccataacaaattgtcagtcggtgaatttagagacattaaactacaattgaagatgatgactgctttgatgtactaaatcagattaagcagggaaaatgtgctcatcctactagcaaatatgatacaccataacaaattgtcagtcagtgaatttagaaacattaaactacaattgaagatgatgactgatttgatgtactaaatcagattgtgctggtatctctatgtaatgggtattttaatgcatttctgacttttatcacaatgaatagcgtgatcataaaaatcataagttaaaatagaaaacaagaatttattttcagcttcattcttttccaggctgcatcttattcagatattactttctcagaaccaaatgg

SEQ ID NO: 101004 - DNA, 667 bp, Oryza sativa
cattcgttgcacaattggacagctacaaaatccccagagtcatagatactgtgctcatttgactttaccatgcaagtaagaggatccaaaatccaatcattagagtttgttacgtaaggctacaagcctacgactgagacaaagcacgttttactagctggtttgtccatcacatgcatcttattttctagccaatttgctatacttttttttaaaataatagaataaacaatccgacctttgctcaataagctataatcaattattacaaaatccacagataaacacacatagcacgcactgacataacataaaataaacacaaactataaacaccaacacaagataaaagaatccacaattactgaattatagtatttgagaatctccctccgaagttggtaaaaaggtgcataatcgtcgattcaagtttacgacatgcatcatttattagctttatatcatcatcatgtctttgtagttgagcccaaccctggagccaatatgttgtcttgaaaagtacctacaaataagtttttgagagtgtttttatcaaaaaaatcatatcatttctactaagccaaagagcccaatatatagtggacgcccctaaaaaatagttccttaattttttttattaacacgcataaccaattcccaaacatat

SEQ ID NO: 101005 - DNA, 764 bp, Oryza sativa
tagtctattgtattagttgtttgtaatattagctataaaatgacatggagataatggagccagcagcagactatactattaaccttgctcttactccagtatatactcgctggcgttgtcagaataaagaacaccggaacgagttgcatgtgtatcatgtgcccagccgtccaagaacgattcggctcttcaaattggccactatcaagccagcacgctctcgaagggacagcataaatgaatcgatctagcgaaatctaaagttgaattcttttcccagttcaagcaagcgcaagagcgaacaaacggaagtggctctcgtcggtgatccacgcgcgttaagggtggggagaggaagagagtacacgcgcgaatgaagaatcaacaccgtaccagcggggattccgatgcgattgacgatttttgttgatatatgttcccatacatgttttctccgtgggaatcaatgtttatatcctattcgatactcccatttcttttacttcgcgggacaagaacccaaggccgtaatagttgtaactttgtttagtgggttttctttgctagaaattctagtcataaatcggtatattttaatccaatagcataacataataaacatgatatatacaataaagaatggtttttccacggtgataaacataaatatgctagcaagaacagtagcaactaaaaatatgtttaacactgaaataagaaaaacataacagagaaagctccggatatagaagaggaattgttgg

SEQ ID NO: 101006 - DNA, 745 bp, Oryza sativa
accggagaagagaaagaaactgtaggagagaggggcatttggtcagttgaagtgcaaaaaatggtaaaaatcttgtgaaatggcgaatatggcaaagcaacggtttggcataggttgaaagtggcattttaacgacgccattccgcggaatggcattgtggcaaaacccaatcttagaagtggtagaatgtccaatttctcggtgttgatggtgttattttgacctttgcgatagtgtgtagatgtgtgcaaaatacactcattcctatattttttaataatgatgaaatgaatttattcgttacaaaatattttttaaagagcttatagagtagtacatatacaattactcgcctatgaggctatgattttcatctttcaagattggcgctccgtgtgctcttcattgcactcgtcatatgcatgtttattctacctggtgaaggtaaaacaaaagcaggtcatgccgcacaaggggactgataaaatgatcgttctagaactttatccctgctggtttcagaatcgagttttcctttggacaaattttgaactagtcaaagagcacgcagctgtgtttgttgttcaggagacagtggtccatccttcttccgtagaaaagacaccggtttcagagtattcagggtatgcataaatccgcaagttgcacatataaaattcgcaagttgagatcgaatttggaccgggtgtaaactcatcatgagatgaaaatgacgtcgagaat

SEQ ID NO: 101007 - DNA, 1139 bp, Oryza sativa
gtggcgcccatcaaggagatcgccggcgagcaacgacggtgcggcgaggaggccgacgacgacgatgaggcggagagcccttcaccggccaagaagccacgacgccggccaggatgagatcctccacgttagtatatatgaagtactaaccatccaattatatacatatagctcgttgagcatgtatgtatacaaccggtagagaaagcagaggctgctcacgtcgtcacgcgtgtgctccgatcgataactttagggtgtgcaattgtaaataaaaaaagggagattcggagggaaagacgtcctccagacagagattaaacacgggctcgatgttaaaattacacatctcttttcactgcatctcgtgtgcaattgcaaatcactaaataagtccatttcttgcttgaggagagacgctgtgtgccatctttcttttcctgaaagtgcaatactcaacccatttttttttcttgtgaatcatttgaactttcaccattagatttgcaccggattcatgctcctgcacaagatccgtctgtttttgcaagccccggtggagtttaacgctgccatctgtttctttcatttttaacacaatataatttatttcggtttttctttaaagaaactacaatcaattgtcataaaaattacagggcaaatgactacaaatgaaaaaaaaattcccagtttgattaaaaaatgaatatcactttaaagattaaagaatacttctatctgcataaccattgttttgcccaacagtgtacaagttatatgtagtccttagtttttcccaacgtcaattatttctataatcgaatttggcatacatcaccatgagtgactaacgttaaaccaaagcagaaaataacattgaaggtaactaagtaaatcagtcatttacccaacgtcatagccatcaaagccaatccgatgccaataatgcctcaccagcacactatctccaatgtatgtttccaagaagatcacgacattgtagatattgccatcattgttctgaacatttataactagattttcacttagagagtcaaccccgagatacgaagttggggaagaaggcatcagctaacatcgtctccaaaaagatgtgtgacgcccataagcatcac

SEQ ID NO: 101008 - DNA, 758 bp, Oryza sativa
gattctgcgtctctagttcagtacgcgatccatggctagctatgcgtgctcgaaagtcgaaaccagctgaatcaggccctgtttttttcagtttgggattattataatctagattattgagtcagattactataagctagattgtaataatctgtagtagaataagcagttagttgtttcttttctagattattagagtctagattattgggtttgcaagtctaaagaggaagtggggtggcatggtgggtaatttttcactcaataatctggaaaaagctcacctaaatgagcttatcagattataataagttagctccagattataataagctacttcaataagttgtctgtttctttcattttactcccaataatctggattataataatcccaagctaaaagaaacaaggcctcggtgactttattttcaccatatttattcagttttctctccaagtagtacttctcttcaatttctacctacattatattgacacactagctagtttatgcgcggatattctcgatcggttggcaacatatttaaaatggatatttgtttttccacattatcgtatcttggattaattttggtagttcaacacacaccatacatcaactataacatacaccctttgtccggctggttgttcatagagtatcaattacacagtagcaaaccgaaaaaaaaaatcgtttagtttacaggaaactttgtaaatcttgaaagagaaacacttatatgtatctgttt

SEQ ID NO: 101009 - DNA, 605 bp, Oryza sativa
agaggttcattaaaaaaatcatatcgatggtgttcagatccatacaaagattattacaaatttggtcattgactcattgctacatttcatcaaagctacttggaaaaaaatatcatcttctaggaatcaagacagggatgaacgatttcatatcactggaactataagcccatgtctcacccttttgccatttcttcatttcactcttcacaacatagcacactgcattttagctaaaaagactttctcagccacttcacaagttcacatgaacagaacaccatgttataacgaagtagccatttaaaaaaacaccttgtaaatgttataaccagaaattattgatcaatttgtaatatatactacaggaaactctggtatggtgttaaaaaaatggaaaaagtacgaattacccatccgaactatcgcggtcgtccaaattacccccctgaaccacaaaaccggacattcttcacccctaactatgcaaaccggacgaattacccccctcgatccaatccgcggtggttttggtctacttagcgtacacgtggcagtccagttaacattttatttatttaaaaaatgtgggacccacctgttat

SEQ ID NO: 101010 - DNA, 1125 bp, Oryza sativa
atttctctcttttctcattaagccatatcacctcaaattgtttctagccatcaaattattaatctatggtcgcaattatctccctcattatcttctctcataaagccacatcatattacttttacatttggatcatcattctatatactatttaaattatgataaaccacatcaccttatgtaagtttatatcgtcgtctagctatcttacacattatttctaactagcaatagtgcccgtgcgttgctacaggaaaaacaccgtttgatagtgtgacaccttgaaaacctcaattctgtaaaaatcaagtctaatttgatatattaacaaataggtagaaccgagtctaattttatcaattagcatggatttaggatttagttttagatttatttttcgagcctacttaagagtttatccaatggactttaatttgaaaaatgtgagccacattgtttgatcaaatttgctttcggcccaggtcttcccaagccggcccaaacttgggctagcccatctttggtgagttgagtcaattcgacggcccgcaagctgagcaactgagcgcggcccacatatgcggggacggaccgatacacttctgcggcccattgggcgcagcgtaatcaacggcggcgacggcctaatgctgggcgaatctgagccgtccaatctaatggacggctccaatcatccccgcgacgaatgaagcatcgaccggggagaggggcaaaaccctaggtcccaaatccatctctcttgatcccatttctctccggcgacgagtgagcggaacgacggtggtccggcaagctggtgcgcgcgtgcagcgacgaccactgagcggctcctgcttcgccggctaggaggcgcacccaagggcggcgcaaagccgtgccacgacgtcggcggtccggctaggtgggcgtgcaaacggcgacgagcgccaagcggcctggacctgtcggcggtaggggcgatgccaagccgacgcttcccgtcttcggcaaaggacggtggaggggtgctccaggacagcgcgcgcgcagggaacccgacacgactgcgaggaggtgaaggtgcggcgatgccgcttcccagaaagctccggtgagctcacgggc

SEQ ID NO: 101011 - DNA, 1263 bp, Oryza sativa
taaaacatcaacacaagtgagaccacatgaatcctacaaccaagtaaaggaaatgcagtactaacattaacagtttcacacgctagaatgtaaagcatactaatattaatcagtaaataaagaatgcatagttaatctttcctgaacagaaccaagtgcatctgccgtgatgtatcatcgagctaaaatcctgccgttggaaaaattaaccaaaaatccacaccgccccattccaacagataagaaaaatgtagattttgtagattgctgtagtgcaaatcccaatttacaagtaaacaacaggaaaatttagtttttttttatcatgcactcaacattttctacaggtggctgaatcatctgaaatgagtagcatgaggaattcaattgcactcctgccagatccaatgcacgacgtctaggcgttaatcctttgcaaagcacaagcaagcaagcatcaggcaggacacaggaatccagaagcagccatttgcaagaagaagagtagagcagagagggaggagggtgctagtgattccttgttccacaaccaggaggcctcagattcgaagtacctggggaacatgaagtggcctgcgccattctgccgctggtgcgggggacgccgggggcggtgaggcgcgggcgacgcgacggcgtgcatcggggcggcggatggggaagtggtgcggcgaggggggggggatggggacaccggggagggaggcgtcgtaatggcgcggggacgcggcgtgcatcggggcggccgatggggaagtggcgcggcgagggggcgatggggacgatggggagggaggagccgtagtggcgcggtggaacgacagaggtggtgaggcacgggcggcgtcagcggagaggtgaagggcgaggctgcgagggagcggcggcgccgagggcggcccaataagccaaattttaaattttcaaacttaattttaagattgattttaagatattttctacgtagtttctttttcagcattggcttttaagttacaaagaacatatatatatatatatatatatatatatatatatatatatatatagttttatatataaatttatttttattccctaataaaccgtttggcttattaccgttttgacttatattagaaaaaaagcgaactgataggggccggattttttcgcgatctagaatcgatcgggatgaaaaaagggcgaaattttggggcgcatgggcgagattacgcgggagctattccggccgtcagatct

SEQ ID NO: 101012 - DNA, 567 bp, Oryza sativa
cgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcag

SEQ ID NO: 101013 - DNA, 595 bp, Oryza sativa
cctgctgtcttgagggagcttggcatactgaaatatggctccaacttatcttgctcaattgattcgagcagtgagattgtgcctggaagtgaagaggaagtggagattcgtgcttgttctgtatatgccgtggaaaaaatgagagagctcatcaacaagaagtttggaaagcaggtaggcacatctgaatcactatcacctaatactttcataccatttcttggtagatacaaagagggggtgttgggtccatggccacactttgccacaccacattttttgtctgccgcagtttgttaggcatgtgtttggtttactgccacagttgtggtttgccacactttttaatacatatgccccacatgtcagagactaacaatttgtccaccacacttttgtggctatcacaatttgcctaacgttagttgtggtaaagtgtggccagcaacaaacacacccctagtcactgcacgctccgctacattgatgagcaatcagaaaaggttatattatatttactcttaagtattgaaaaagagcaaaattgaccattctgctttagtttacggtcaaaacattcatctagtaagagttt

SEQ ID NO: 101014 - DNA, 1189 bp, Oryza sativa
gttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctagcgggaaaattatctcttaaaaaccctaattgcgaaatttatttctttgcttgttgtctagtgtccatgccatctcaagatctcaaatccccgatctatcgtcgagttcaatt

SEQ ID NO: 101015 - DNA, 837 bp, Oryza sativa
ctcaaataaccaatttacgaacccactacttatatcaagtaataactcataataattttttatgttatggttagatttatcgtatctatagatacatgtgagacgattcataaacctatttacagattaaattgataggtaacttatgaatcaatctgctaattacctatttattttacatgtaagcgagttctcataggttgatccgcttgcattcctatcgcgagtggagacggggacagccacgcgtgcacagcgtaacgtacaattacgtggtgttgccgcctaccaccgagcacacggcagcagcgagcagccgaaccgaacgcgtggttccaccgcgcgtcgccggaatttgcgtgccgacggcgaccgcccgcgggtcggtgcggtgcagcagaatccgctctcccgacggcgacgtacacacggcgtccatccctttcccaaaatctcacctggaacgcgaaaaaacaaaacgagaaaaaggccactgtagctggctggctggagctcatgtgcaacgcatgcattgtctcgccggttggttcgtgctgcactgcgtattcactcttcagatacttgtggttttttttgttcctttttcctgcgtagatcgagattaggtgaggtgagcgtgagcgattcttggagcggttcgtgagcttttctttcgacgattaggattagctcatccaacctcacctaatctcatatccttttgcacggcattttgggtcgctactttctgaaaaaaaggttgttgttgccacatactacagcttggtggtcgatctcatggcttgcttgccggatccaaactttagtggaaagaga

SEQ ID NO: 101016 - DNA, 725 bp, Oryza sativa
atattccagtacaaattccaatgctagaagtgcttacattttgaaatagagagaatactattttgtctgcttgaagtcattgagtgtctttttctggaagatagttggggtggaccttaccaaggggtgaggattgtattattataatatttaatgataccgaggagtgtattttgtagctagggcaggaggaaaggctttaagtctttgagtctgtttcattaaggagagtcatgtctgaaactctgaaagcagcatcctcttccatctgtatttgtttaatggtactattgtcaaatagcagacaaatatttcaacaacacaaggtagaggtcttttttggtcatttttaatcttgtattttgaatggagtgacaagtgccatgggatgtcacggaacacaacaggtagcactcaagttgtgagagaagaacggatggtcttagttttctaacatcattatttctctatagagcacactgatcggatgttacatgttattttttttcattcacatgattgcatcacaagatacacacaccctataggaagaaacttttattgattgacttcaatatcattccggaattcatttccttgcatgaacaaaaccagggcaaacattgtgaagtttcaagtttatttatgacaactttgatactggttatgttgacacaggcaaaaatccaaaggactcaagggtcattatctttgcacattaccga

SEQ ID NO: 101017 - DNA, 1040 bp, Oryza sativa
ttcacaaatagatttcaataattgtttactcctatgtttggctttattatctaagttattttgttgcctgaatgtttgctctttttgagagaatataattggttgtagtttctttgaagcaatggccagatttaatcctattattttaaagaaaagtattcaagaatactagaaagatatgagttaattaaatcttttacctttaacggcaatataatactaaaagaaatagcagaaatgtataggaagaccggccattatctttagtcccagtgaaataactgggattaaaaattcatctttactcccggttggactgaagatggacaggggccacgtcttttttcttttatttattgtttttttgctgcatgtatctattcccccatccaaatcaacacaaatcatccacaacaaaattatccacaaatcatgcacaacaaaatcatccacaatacatacacatccacaatataccaatcaatcacaaatcatccccaaatcaaaaaaaaatctcctgcaaaatatacaaatcattccctacaaataattcacaaaaaaaaatccatagtcgccctttgcgcccgccgccgccggggcggccctccgcacgcgatggccaccgctgcacggctgcatcccctcccagatccggcggaggggaggccgctgcccttcacgcctgccgccatggggggtagcccaccacaccggccgccgcttggcgcggccccgcacgccacagccgccgtcaggcgcagccccatcggctcttcgtgacttagaggcagagaggggaggagcaggaggaggaggagggagaggggtagaggaggagtggaggagggaggaggaggagatgagataaggaggggagagaggggcgctgcgcgtgaggagataagggagagagagaacgcgcgtcgtgtgggccgagagagatatttagtcccggtttgtattatcaaccaggattaaagttctatatttagtcccggctggtagcaccaactaggattaaagttcattgggggccttcc

SEQ ID NO: 101018 - DNA, 1942 bp, Oryza sativa
atctgatcatcaggaagctgctgggctagaacaaatgtacagatgtatggctgccggccatggacgcgtccaatcttgctaaagaggggagaagctgggacacatagcccatgctcaacgtactgctgcttactacagtagtagctttaattttgatctcgcctgatctcgatggatcatctgaacaagctgtcatgcatatccatcagctaaatagctttaattagttcattattacaccagttaattatttggttaagtcagaatgaaatgtttatggtaactcgatcttctattaataaatcatatatattactctctacaggggaacatattagatttgattctaagccctgttgtagaagtgtgaagagtacagatacaacacgcatgcaagtcgttgtcctttatggctgtgtattatagaagttggagacgatataatccattttcattattaagaaaataaaagtggtctttgaaacaatggtcacgaaacattttacgaatgaagatttggcaatattatttattttaataatgtcttgtcattcgaattattcgaattatgctggacttaatttgttttagtgatgtagacgaaagttttgctaactttgaaataatttggctataatttctgatgaagtaaatgctagaaaccctttcccattatcttaaaaaaaagttacaccaattatcttttatgtctcgatgatctttatcgatactagtactagctagctaaatgcacgcaaaaattaaaagatgcgcagctagcttttgtgttcgatgatctttatctagatctcgatcgatcgaaaatgcatgcactgatgatatgcacgcaacaacaaattcccaattagtagtacccaagttcatgcatgaatgagctacatagctacatgccgacagatcgatctagcttgatttagtgttcctccttttttttaatggtgccatgaaaatgcaaagattaaggagactgaatctgatcaccttccaacccaagcacagagaaagagagggacaaagttcagaaatgaaaaaggaagtgatgtacatgtactccatgcagggaagaaagcataacaatgtcactgcaactacgctgacaccttagctgaaacaatgaactggaacgaatcgacagaacacgatagatatccatgtcaaaatactttagcacgcaagaagtcaagacgaaaaacaactgctgctttgtgattaccttaagaagtcgcctctagaagtttattttaatttgcatacaagttttgttttccaccattgaaaatagaacattttcagtcatttcggttacaggcagttgcaaatacgcctgcgcgaatgcccttttagtcacgcgtacaaattttaattaccacactacgttagatcgatccgtacttaatgacaatgaacaagcattaatagaaatatattctctccgtccctcctataaaaattcaatctaaaacgagtaacgacgttttccagtacaacgaatatctcgtcttaggttgaatttttatgggacggagggagtgtgactgtacgaggcaacaacctatatgatgtaagtgcaagcgatttgcttgccgaccatatggagaatcgacatatacacatgaaagatgatgtggccagctcgtgtggggaaggatgaccaccggttcccagttcctccttcgctcctttgtctacatcgtgaagggacaatgtctaagagcccacaatatattgatatgagattctagctagggtattagtatcttcgacttttctcatcaaatatatagttcagattctcaaatgtagctacagaatctagaaaaaaattcgtagccaaaaactaaaaaatcaggcttatctagattcttgcccaaaacttcttagaattctcgtatctcccagtgacgaaggcagcgtgggggct

SEQ ID NO: 101019 - DNA, 3288 bp, Oryza sativa
gctagagctagctgtctcggttatatcagagttaagattccatggtctcggttataattaaaagaaatatttaggaggcttttcaatggagggagctatatattcccacccatagacgaccataaggagcttggtcagagtatatattatatatgagcattatctgaattgaaatcaacattatatgaaatccaaatataaatctaacaatacctatttatatcactaaacctataaatatgttttgactaattattgttattcgagattaatgaagtttgaattttaaaatgtgtgcatgcctttataatttgagacattgggaataattaagaaggaaagtatgagagaaaacagcaacaaacctattgtcaatgctagtcacaatgaatatccgatcgacatctcatcttccaaatttcgatgcgtgccattgatggagttggacagttcgttttcaaaagttcacacagtatgatgacgcccatctagcctcaatgtcgatcggtcgccttcttctgccatgcattttatcattttgctgtgaactatatgatgcaaagcttattaattgcttcattttaaaataaaaggtcgtacaattattgaagttcttttatactttaatatattagttgtactatgcttttatactattataatataaatgcggtatgtattgtattcagttatattttatcttatcatacgagcagctccgtcccatctatattttaaagacacgtgccagctaatgctcctgccattctgccactgcacacccgcactattcttgatatggtacgcagttcctaaaattccgtataaatataatcgtcaacattcaacaataactatagtacattgtacaagctacatgtgattgtacaagctactcatacacatgagacaagtgaaagagaaatcaaattaatgggtgtacgtacctatcagtgcaagaacgtgcgcctctagcttgatcagtgcatgtctcacagtccaccataaaaaaaaatgcccacccaacagaaggctggaaggaacgaggatgagcactcaatgagagtggatatctgctcgttatttgcatgtcactcaaatagttataaataatttttttaaaaatttttttttaaacatgtcagttaaaatttagcttctacatgtcacaacgaaaaaaaaataaatttgactttgaataactaactgtagttaaatttgtttttttttcattgcgatatgtagaaattgaattttaacttgtatgttaatttgtagagtgatatagcacatattaatacatcttcttgatgatttttaaaaaaattataaccatttaagtgacatgcaaacaacgaggaaatatcccctcaagagtttagaatagtttcccgcactcaatttcatgtctgctgcagcggctgacatgcaccggcgccggcaggccggccggcctcctctccatcatcgagatggatagcgtgaaagaactcattgctgctgccattatagttcagatagtgctatctatatagtggatgagcctttcctcagtaaggctgaacaccattagccgtgtgttcatctgttcgtacaaaccatagatatagctgctagcttaagctaggacccagcctagcttggtatattaattatctgttcaaatacacgctcttttgccaaaataatgatcggtcatcattaattatttttttaagttaaagagagagctttattaaccaaggaaaatagagattacattcctgatttagcaaatctaggatatatacttgctggagcacacaacatccactcctcacaagatctcgaattcatagccactttaacaagagtatgagctactctattagcttgtctttttatcttatgcacttgcatactttggaacattgcatcactcttatagtgaaactttcttatactcgacaatatatattaataattccacattaaccaaaagaattgtactactacaaagttttaattcctggaacctcgttttcattaaaaataaattaataaaccatggaccccaagatttcgtgtgttcaaccttcaacatgctactatctcttaattattcggcatcagattcctcatagaaaggtctgatggattcatcgtttgctgttttttacatcacaagtgaacacacgggcaatcaattatactctctccttccctaaatgtttgatgccgttgacttttctaaatatgtttgaccgttcgtcttattcaaaaacttttgtgaaatatgtaaaactatatgtatacataaaagtatatatataataaatcaaatgataggaaaaaaaataataataacttttttttaataagacaaacggtcaaacatatttaaaaaaatcaacggcgtcaaacatttagagatagagggagtagaaacaaattgataatatatattgctcatcaatatgcttcatggcacattctgcaattttctacgttactgtaaccacattcccccctctatctctctatgcttagccttgattgtgacaaggctatcatttccaccattatttcactaacccatttgttatttgcatcatgtgtggaccagctaattaaagtacgatcatcatgcgagtagctgggaagtttctgattataatgcattattagttagttagtttctatgtctgactcagagatgcaccaattaagaaactacacatgaatgcacatgcgtgttggatcaaatcatttggtacttactaccaagattagccaaattaagtggtctatttttgttacacacgctgttgtatatatatcccacttacgaccagtcaaaaagggaggcaaattcgtttgttagcacacaacgcatctagaagttagatccacggtaaatttaaaatctgtatgttaaattacatagcgtttaaaaaaattaaattatttcatttaaaatgggtataaaattatttatcaaaatattatcgacgtaatcacacatcaaaattcacaaatgttatgtaactagggatggcccagctctaaaaaaaaacatcgggaaccatgtcaaccttattctccgttcgtaattggcttaactaaatttaattagcacccattatcctagcttgcatgtatgtgctatatacccttcgtctttccatcttaaaagaatcatatataaaagctaattaattttctttatttaaatgagtatgcaaactgtgaattagtgtacacattacaatcccgtatatgagtgtagcctccacgtttaatataatt

SEQ ID NO: 101020 - DNA, 953 bp, Oryza sativa
ttatacgacggacctaacaagtatcaggcattggcaggaccgagctacgaatgctgcatcgtcaaaacaccagaatccatcaaccgaaaaaggcagatcgatttcagagattaggttgatgatgacttaaacaacatcaaaattatggtcacatcagaacaacagcttgtgatccatggcatcccaaatgtcccggtcaaacgtggcaaaagttgggtcctgctgttccttcttggacttaaccaaatgcaagtatatatgcttgctgcaatgaccactactacacagtcccagaaaaggcgattgaaacaatcttgattttgcacgcatggaaaggtgaccaactttgtcagtagaagaatctgatggaaagcacatagggcgaagaagatagggttaagcatgtctattatactagtccccattatgatcagccactaactaaacaggattttgtttaaggctacaagggcaagatgacaagtagctaggctaaggcacttcagctttttctcaaggggcaattctccttgtcattctgttacagaagactgcaagagactggctctgtggcaacaggtcttttatatttggcagagaaggattactgcaattgttttagctcaactagaggataaaagggcaaggggacaagcaactaggctaaggcatttgaacttttctagggaaattctctttagctactgaatccccatggatttttgcaaaaggacatggcaagaaacaagatgtgctagtgctgtgaaagcaatgcaagaagagtgtgcatgtgctcgagggcttggagagacactttcctatctgtggatatgccccagacatgaggagtccaaaagagtgaggacaaatgcttgggattctgagctgatgcaaaaggagttgcagatgcatagtttagttgtcagtgtgtttgtgtgtctgtgtgtttttct

SEQ ID NO: 101021 - DNA, 540 bp, Oryza sativa
ccaaattaacgtccaaacatttgatgtgacatggactaaaaagtagttttagccccatctaaacacccactaagccacctcttgtcatgctttctccttcttggaagcataacacaggtacttggggtaaggctggatctctgctcgtggacctgtggtaacaattttattggaaaaagtatacccaaggtccctcaacttgtcattggtttatcgtatacgaggtcatccgaggtccctaggtggttttgaccccggttttgatctacgtggcggctgagtcagcgtgggacccacatgggccccacctgtcagctggccacgtcatcactctctcccctcctctcctcctctctcactcttctcctgtttgggtaggcagctggggaggacgtcggtgggttgctgccttctgtggggagaggagggagaggactagggcgtcggcggccggcgacgggcgacacgacgactgcggctggcgactggcgaccccccgccgccattgctctcgtccgccattgcagaagccacaggcac

SEQ ID NO: 101022 - DNA, 1309 bp, Oryza sativa
  unsure (1)..(1309): unsure at all n locations
tttaatgcattagtccttattttcaaatagacattaaaaaggaaataatcataatcatgataaaccggccaggtaatataaacataaatcttcaattctactcaagcttctgcaccaagcgaaatgaaccaagaatcaaggaatcaatgagcaaattactcaaataagttctaaccacttgctggaacaatttcattttaaagattccaatcatcaggcattcaagtaaactaataaaaaagaatgtcaagaacaaaatggctgtagtcagaacaaagatttgcttgacgagggacttttctaaaagggaaatcaaaatgacttttaaaacaatcaattggacatggcatcagatgacatgtttgaaacacagcctatgcaggggtgcatggcccacacaagattaagctacatgcctggaatgctgcaagtgcaacctgaccacaccaactcattactgtgtcctcccagatccacagtagcgggccaaatctggatgcacaaccagtggttgtacggccatttctctagtcctgtttcactaccnatacatcntcattggncccattggacaaatggcccatctacagaacaatgctataatcctctcagtaaatacagctcccctcgtcagcgatatggtgtcttcaggggcatctaaaagcctacaagaagttctcaaaaaccaagcttgcaacagtttagatcagacagatcaattggggtcagatagtatcttcaatttttgttttctctctctgtaatatagctggacaaatcctggttgggactcttggactagttaaaactagtgctaccaagtagaggataagtgtaacggaagatttaccaggaaaatgacgggtaataagttcgattagagtagcagcagagtttccagcagacttcactagatttgcagcttcacctccaaagcttctttcaagttccataccaacctaaatgcatccaccagaataagagataatttacaaataagagattcttggatgtagccatgtagcctatgcaattgcttggcaacaaacctatggcaaaaataataactattataggagcataattagatcctatcaacaatctcaagatgattccagaaacaactagatgactaaattcatcataatagagatggtgagtgtctttatgcttttaggtgatgacactgacaaatttcaaaatgcatgaagcagaatacagggttctagagatcaacttttcaatgaaccaattaagtgcgacagaacagtacctcatgaagaagccgtactctttcctcctcaattgg

SEQ ID NO: 101023 - DNA, 583 bp, Oryza sativa
ccggacttccaagcaggccctaacctggggaaatctctgagctatgatacaagcatatagatgtaattcttcatttgtttaagatatgccgcaaagaggagcttaaatatatccatctacgaacaactgtaatcttgaaattgataacctatgatgcaaaacataggaataggccttgctagtataacctacctgttttttgaacagaagtataacctaccttacacttcactaatagcaacaagaaaacgtagctgatggcctttgaaaatctttacctcattctgctgtacctccaaaccacgcaattctaagacaccatcgcatttgaactttgtgatcttaacactgaattttccataatccctttcttctccttcgttcgttggaagatacctgtcacactgccattttttcaaagttaataatttaataaaattttattaaagtaattagttgaaaatagtcggaaattcaagttgtatgtctacatcaatgaacttaatacattttttggtatcatccagtaatagacaaatactccctacattcctaaatgtttgacaccgttgacttttttaaa

SEQ ID NO: 101024 - DNA, 812 bp, Oryza sativa
tctgttgtctgttttggtggcgttagcagcgaagaatcaaaggaaaaaagaatgaggtgcttgtgaggcaatggatggatggatcgatagagattagcaagaaggagaaggataagaagttttggaaggggaggtagatgaactctagggcgggattttggatcctgttgtgaagaaggaggctttgaaagccaccgaggccggagcccccgccatgccgctccagctatccccgcagacaacccaagggggagagagagaaagagagactgatgtgtgggtcctataatatttcttttgtgaatggtaaatgggtcctacgtatttttttaattctaatgtaacataagcgccagtagaacgaaaaccaggtcaacaccactatgtagagcgtcacgttagcgaaaccatcctctaaaaccaccaaaggagttaaattgtattggttttaatagatggagggtcgaccccatattgaaaaatgcttgtaatcggccgtccgaacaagacaagaaaatcggacaccacgccgatgcttcccacgttggagtatctactgctaatttcaaccatgcatatgcatgtgtcaattttttaaattttttttctcctaaactacttatccaatctaaaatccgattgcaccgttatattcattagaattaaatctttataacaagatatcacatgattatattccgattaaagaaaaacatatgtttcaaaccattaatactttatgtttcatacgttatagcaatatgtttcagcatatgtttttattgtgtttcataaaattcacggaaatactt

SEQ ID NO: 101025 - DNA, 7250 bp, Oryza sativa
tacatgcatacatgtatgcatttttgcgagctttaaaatgatttttctcataaactaattatccaatctataatctgatcacaccggtgtattcgttgtaattaaatctttataacaagatatcatatgattatattttgataaaagaaaaacatatgtttcaatccgttaacactagttgtttcatatgtggtagcgacatgtttcaacgtgtatcttcatcatgtttcataaaatttttaaatgtctcagttgctgattttttgtttcaccatatataatttgatgtttcactcaatggtcaactaggaacatttgaccaaccaatttttgttgggacatgagacgtcagatggaaagattcctcatgattgtggagtgaaaaataaagtgcagcaacatgcacatgcacatacgctcagagctgggctgggcgtccgatatttggtaggatatcagacgtacgagccgtaccgctctcattgtagtcgtcgggccaacgaagactttcggaaaacgcttcgtcccggacgtccgatcctatgatttgcgtcggacgctcaggacacagagaatgccagccgccagggcccaccacgtctctcccacacgcgtcctcgtgctgccacgtgtccccactacatattccgttacaacaaatcacccacatattatggaaaccctctattaagggaatccgtttaatgttttgttccactaaaaatatttcacctaatgtactcacaatgtttcactgtgtatagatctaatgttgcagtgaattaaaatattcttttgcaataaatcacccacatattatggacaccctctattaagggaattcgttttattttttgtaccaccaaaaatgtttcgcctagtgtacttataatgtttcactttgtatggatcaaatgttgcaatgacttaaaacattctttcactattttctgaaacattgtttttatataaagtgaaacagcacccgatttaaacgattgaaatattttctatctacctagtgaaacaatttcgatatatttggtggaacagcgtgcaacatttaaaaataattcaataataagctaaaaaaatttcatcggaatatatccatgtgtggtcttattttaaatatttaattgtaacgaatttgatggtgtaattggatcatgatttggatacataatataatttaagagaaaaaatagtctaaaatttgttttacatgcatgtattcttgatgacatcaaatcggttgacggcgagcgcgcggatcggatggctcatggatgcgtccaatttttcgtctcgcgccgtacgtccgacacgtagtgctctcccgacatattcggtgtggttccgggatacgaattagattctgccaataattaagggactcacagtgaactattccaactacaaataggctggctggctgatacggcgtgtgccgtcagcgcgattttgggccgtgtcgctttcataggaacgctttgccttgggctgggctgcgcatgtccgctcctcgtccggttttctccttttcgtcgccgtcgccgtcgtcgtcttcctcgccgccggcgccgacgcgagttccctcggtcgggcagggcagatcgagggattgatctgaggtatttcccgtctcgatctggagacgaaccaccgtggtggtatcaattatgatcaacatcatcaatggggatgctatcgctgaagcggctcatggctaggcagcggcagcgggagtggcgccgacgtcgtcagaaggcgcaaaaaccccgcggtaagcctccttccctgttcgatcctctccgctatcgatcgatctatctatctctgccttgcacaccagactcttcactcgaaatatctccttaaactttgtgtttctgctgttcaagatccccccccccccccccccgctattttactacctcttcactcgaaattctgttaaaaccgtgtttcctgctgttaaagacctgctaatatctgtattgttcataacaatacttgatttgcagcagatggatcgattgcttctgaaagaaagggtaataattatcaatgtggtaaaagattaagatattcatggccaaactttccagaggtatgtgttgcaaactattgattacggaagatttatatcacaagtggaatatctgtatgactgctgtaactgcacaatttggtcgacctatagatagctaaaccgaaatttaagaacagaccttctactttgctattatgacattaaggagtaagtctatagctttcttgagtttaattacatggcctattaccaaccataatagaagagttcatttagaaggtccagtttttaaaaacctggagagctttgatcgccccagttaaaagcctggaaatacaaatggacaaatttcatcctgtcataatccatcttttaagggaatgtgcaaaagaattgcacacctttgtattaagtaggagaaaaaaaactacagaatcaacacgccagagcggcggaataaaccactcctttgcgccgcgccctccgtggacacggtctaccgtgggccgatccctcccggtgccactgacagtgggccccacgaggggtttattccaaaatattcctttttcccataaagaaactcttttttcctttgtccataaaatcatataatcttccaaaaatcatatctcctaaaccgtcactccgattgactccgttcaacttccatattttttcctaaaatgagatttattggatggcagtattaaatcttactgtttgagctattttattagcccttgtgttgattttctctttttcgcatatagttgccaatcccgcggtcgattcggaagctgttctcgacgaggaagaaccaccataggaccaaggcaagctacctttgaccatactatttcctatatgtgcaaaattatgttgtttgtaaatgtgcatgcttaagttacacgtgaaactgtttggcctcggtttgtgaatgcatccgatggacctaccgattagtcgcatttatactctgtaggatattgaataccatgtccttgatagctccacatattacgcgccgatgtcttaccctacaggtctggacgtcgaggtagttgggcttagccctgccactattgtattgtcgtgtgggaaacctggatttccaatcaactattcaaaacctgatgttcagtgtcggtgtgtttgcaaagtaaaactagtttgcgaaccctgatgttatgtaggctgagcctgtgtggctggttatgtattgtcgttaaggaccgattcctttgggaattccatccaagcatcttacagtgcgaccacacgggtattatgggatatccatggagaagtacttagttagtccatgattatcttgtatgccaatagtagtgggacactggggatgaggagacgaagttgtgtgtgtttgatgagatctttggccatgtgtggcccgcctctattgtggcgatacggtaccaataggtgtaggatccctagtgtaccctaagtagacgagggctgagactgcctgatgcttgtcgtgcgaccaactatgtggcatgggattttttatggactagctttggaaaggccttgcaatgaacttccggtgccgacgggtgaccggtgtcagtttcgtgtcgtgtgggtaaagcgtacgacctctgcagagtttaaactgttcgaacagccgtgcccacggttaagagcaaatatgaggttattctcttagcgtagtgttgtttgtaaatgctttgtgaaattggtttgtgggatgggaactgttctagagccagcctgtgtggcagacgacaaacctgagtggtttggaacaggtatgtgtgatctgggatgtcgattgttatcatagtgtgtgtaggagctggactgtttggttgagaggtgatttgagctaagatggctcgtggtgctttgagctgagatggctcgtggtgttttgagctgagacggctcggggagaagtacagtggagataagtgcaagagttggagaaaattttatgagaactaaggtgttggtagaagtatacatattcactaattacctgtgacacgttgttgcaaagcaacttgtggaatggattgaagcgtgagcctctttccgataactaaaacttgacacactagagttttgcaaaagaaacctttagagaaatggctggttttcgcaaatgaaaacttctgcctcctttggtagccgcacatgtcatcttccctatggcttgctgagtacgaaagtactcacccttgctctatatataattataataggctttgaagacgaagaaggaggatatgatccaaccgcagaggagtatctttaggagcacgccaactatgaagacttttagggtttcgggcctagttcccaaaccgtgcctgtggaataagttaatcacttaggtgtctagcctagcgcttagtcgttaagtcgccttccgttgttcgcttccgctctgtttttgtcacttttgttattgtctttggtgtcgtattgatgtccatctggggtctatccatgatggcaacttacgtaaggaccatcctagtaatgtaatattattagattgctttggatcaccgatgttccgtgtgtatcagcttgtgtatcctgggactggtacatgttacacaggtacagtatcgtggcctcgggacccgcgaggtttggggacgccacacattcgaaatggagatttcatggataatatatacgatgatagctataactatttggaggataatatatatgtagtttatgccttcacatcacacgcattaatttgttttctctgcagtccccagggtatcctatcctcagagtgagcattgtcggaaatttcagttcctgatggtgtcaacctatatggctaaaactttttagttcatgtcatatcggatgtttggacgttaatttggagtattaaatatatactaataaaaaaactaatttcataaatgagagctaatctgcgagacgaattttttaagcctaattaatctataattatgaaaagtttaccgtagcatcacattgtcaaatcatgacataattagacttaaaagattcgtctcgcaaattagtccaaggttatggaataggttttgtatttagtgtatgtttaaaactctaaattagtgtccaaacatccgatgtgacagggacttgaaataaatccctgtttcccaaacaggccatccaaaagaaaaaatggaactgacaaagcagctgaaggtgccatttttgtaggttgtaataataaaaaaacataaattagctataacgcatgattccagtcagttcaaagcttcaaattcatattccattcaaagctctaactcattttttttccctacaaagcagcacagtacagttaaaatttttgacatatcctattgagctgatgtcgaggactttgcttaaactccctttacgtctagctattgtcatccaatttttgtatgtaaaaatatagaataccgtctgcctcctctctccccaaaaacaagatgtattatctatccacccatttaaaccggtacatgtaatttttacctaataaacaaaattcaagcatccaatatttggctatagattggcatgaatatataaatgattatatttctatatccattcaatcatcgcctccacacattaaagaaagcccggtgcaagaaattcaagaaacttgtagactgaaacgaatggaataacagtacgcatgcatgcccattcaaaagaaatgcagagaggttgaaacaatatggaattaaacctgcagtttacatgacaaaagtacaaagacagctttgacctcacggtactgaatgtctgaatctcttcttcatctgcaccacatctttcatagtactgagatacttgtgaggaaaaatagcatatactccctccgtcccaaaataagtgcagttttagcgctattcatgttcaacgtttgactgttcgtcttatttaaaaaaagaggtatttttattgttattagataataaaacatgaatagtactttatgtgtgactaatttttttaatatttttcataaattttttaaataagacggatggtcaaagcgctaaacacggatatttatggctgcatttattttaggacggatttagtattcaggatagtacaaaagcaaactgatacagaacctaacagtcgccattattcctgggagttttagaggttacaatttatttaataatcgctggttttccaaagtcagaagaatctattagctctgtctctatttggcttgccttggtgacgtttggcagcctggctttacattcttttggcataactcacgtacatactcctaagtggaatcctggagaagaaagtaagaagattggtgaatagatgccgtggcatagaactgcatattcaaatagctgaagttaagatgccaatcaacaaatgttacttcacagaaagaaacatgaaattaggattatatcaacctgtcactctattaggaccagcattctacaatggctgcagcgacaccgatatgaattcaaatagttatcaaaagaagaactgcagagcaaacaagttccttggctgcatacatccctttttggatgtagaggtcgggtttttatctattttctaagaaaatagcaaacaagttccatgtgtgttcttttttaaggcttcccactgtaatcctatccaaaccagaacaagagttagcagtgtacaatgtaagaatttttttatgaaaacagttccactacggaattgagtaacaactaacaactacattgttagctgcatatatggagtaacaacctatggtcaaatacaaacttcattccttcaaaacagctaccatctgagaattgctccagaatccagatatttctgagtgctggccactgccaccatataaccaatgcaagcacaacaagaatttgatgaccagttggtcctaatgaatgcacactacctaaacatgctcaactctatattttcctcaaaagcatcaaacaacaaataaaaagtgttgcaaacttgcaataccaaatacattctggaaaccttcaccttcagagagaacaaaagctgatgccgactcacattgtatacctccagcggcatgcctgaacatatgatcagtagtatggtcacatctcagatgacacagtctaattaatatactccctccgttttgaaatgtttgaca

SEQ ID NO: 101026 - DNA, 2135 bp, Oryza sativa
gatgctgtccaagaaacagagacaaagatgatagagatgtcagcacttaatcatctcatatcaacacatgttctacaacaagctcagcagatccagtatttatatgaccaggtagaaaatctatttaagccagtacaccatatctgttatttgtttcttgtagattgtcttcttatgtgaacatagatgtagatattagtggaaaaaatataaatggcactcttttgctgatgtactgttaaacatgatgtgtctgtcgtttgttatcatccactgatctttttattgggatctttggaacacgcatctccctcattaaattaaactttccttttctgaataactggcatggtctctaccttgcatttccctcataataccatctaacgaaataggttataagatctttaactgatgactcaggaggtccatggtgctatatatgaaaattggcaagtgatcatgtgcctttatctgtgtgttttcattcctgatttcttattatagcacaacgtatgccttcttctcaggcagttgaagctacaaacaatgtggaccgtgggaaagctgcgacggcggggagaggtgtcagggtggcggcagctgcgacgcctcggaaggaggagtacggcggcggcggcggctgcacggctcgctgctcctgccctcgcccgtcctgtcgtcgccgctcgttctcaccgcccgccgccagccgaaggggaagaagggggagagaaagagagagaagggagagagggaggaggaagaaggaagaggactgccatgtgggcccatatttctttttttaatgactaatgggtcccacacatattttttaattctaatgccacctaagtaccgcgtcaacaccacgtggaacgaagactcggtcaatatcgccacgtagacgccacgtggcgccacatcagcaaaaccgccctccaaaaccaccgagagtcaaattgcaccggttttaggagtttaggggtcgagatatccggttttgtggtttagggttatagattagatttcgatcacagttaaaggtcacgaagtgaacttattccttttcagattcttcctaaatttcttcggcccattgacgaacgtcaccttgcattgcaagcgatttttttattttttttatttactttttaaaagatttaaaaaaaatcatatttcaaagtagtttaacagaaatatactcctctcgctctatggtagggcgagacatataaataaccttatcatagagcgagacatataaataaccctacggtacgacaatcaatgtgacgtgacaacctataagagaaaaacgatccatcgctgggaaggggcagcctacaaaatcaccatcacgcgtcccatacatcaccaaactattgctaatgtcactaaaataaatcgtccaaaaagggtgagaaggggttgtctacaaaattaccatgacatgctcctcccaccttatgtcacctcacatagcccgctctaccatagggtaatttatgccccgccctacaacaaagcggccctacaacaaagcggttgtagtatatttttacaaaactttcaaatggtatatttttataaatattttttttaaaaaaagtaaatattaaaaaatatccattgcaaggtagctagccgccgtgtagtcggtagctggcagtgaaataatggcggatataacgagcgcacgtaattacgttggaggtgatttacctcaacgctgaagatgtattccagttatataatctagcatggagatgttacacatgttaactactactccctccgtcccataactactagagaagtggatttagttcatgtttgtaacctctttatttttaagttgcaaccggtcgggattaccaactatgaataaaaataataacgtcatgtggctgtcgtcttttcttttctttttttatttttttttgctacttgcatattgatttcgcaccaaactcaacgacaaaatcatctacacaaaacatcacaaaatcatccatgaattgacatcacaaattcatctacaacttcacataaacatctaaaaatcatccacaaatttacatcacaaaatcattaacaaattcacaaaaacatcaaaaaatcatccataaatt

SEQ ID NO: 101027 - DNA, 3039 bp, Oryza sativa
ggtatcatcaaccggaattaaagatctatctttactctagattggtgttagcaaccggaattaaagctcgttaggggcctagcaactagtgaaccgggactaaagatatttttactctcggtttctactcgaaccgggactaatgtgattttacctgacccagtaaagatcacttctccaatagtaaatacagcaacccagtaccgtatgagacattttataatgcaacgaattaatccggacataactataaagtgtctcattcggtactagattgctttgatatgcatgggacggagggagtagttgataccccgtgttatataccgaagcgcgctcagcccagcttgacaacgaccccacgcgcgcgatcttgcgatcgatcggattggctcggcgacggtggatcccggacgtacgtcacgatcgacgcacgggagcgcttgcgcttgcgcgcgcgcgcgcgttcgccgtcgtccgtccctcctacttgttggacccgttcgtcgatcggtcgccgcgcgcgcgcgtctcgtgttccacctccacacgcgcgtacgcacggcgctgaatcggccttctctctctcacacatacacacagttttttaagggaagaagataacgttcaatgcatgtgttcggccggggcaccgatagtggcctgcatacacgccaacgccaaatgcgctggttgaatggctactccctccgctccacagaaaaataaaactaagaccagacatacaaaagtgagtggatattcccttaaggaatgggttgagttctcctatattctaatctaatgtttgttttttttatggagagagtacgtttttgtgctggagggcacacttcacagctgcaacccacgtatggtccttcgtttaatttgtctctagattatttatttttcctattctcctatacgaagctatatacgagcacttctctgagactactcgtgccaagtttaatagttttgtagtttactttgaaccggtgcactggtttaaccacagagaaagaaatcgaccaattaaacggagcttacttcactgcttgcttctgtgattggagaaccatatatagtacccctccgtcctaaaatgtaaggatttttcaatctcgacacagtctttaagatgctactctgatcaacaatatctataaaaataaaatttagtaacatcaattttacatgattgatctttttttttgctattaatagttaaaattgaaaatgattgacttggcactatactaaaaatgcatatattttagtacagagagagtactattctatatactaatcttaataagttcatgacaagttgacaaccggtttcgtcgtaattttattaattttggatatccctgccatgcaaatccatcattcttccacgatgtccatcaagggggatacagccgtgagatgtcaacatagtagtattcttttgaaccacgcgatcaggttaaaccaatgatgtcgtcatcatctattcgtctccacgtacgtcgaccagacgcgcgccccaatcatcagacattttcttctccacgagtcgggcattcgggttagtttaacactcttaactgccaattgcctataccttggaaaagtctactcgtgcactgtttttccatatcactccaaaaaaatcacaaaaggatataaaatctataatattattataagataattttgaaagaatgtatcacgttcaagctagaaaatcccacaataatcagaaaaaaaagagaaatattttgatcgttagactctagccgtttagattttgagtgatttaatggtgcaaattaacacatcagaatatcggggttcaactagaaaacgactatatgaaattgagaccgtacggtaagttaattagacctttatgattaggagtcagatacatccacatggagagcctgtaattaaatacatagtacaaatctgatcgtgtaggacacgttaactaactgtacaaacaaacaaaaaaaatgtcaatcaaccaatacagaaggaacaaaacaacgtaggaataccatgtatgcatgagccaagtggccaggaacattaggccgggcgtgcaaacgcagaaacaaatgtagttactgtaaagcttgtccatccatcggaaaataggcaacctcttatttagattgattttttttattatattgtatagtgattgatcaagtcgtctccgccgtattgctgcgtgcgtgcacttcgccgctaccgtagtcgtcggccgccgaccgccgctaggtcgatctccaccttgctgtggctacatcgatctccatcgtgttgctgagctgcgtgcgcgcacatcgccgtcggccgtcgtttcctgccgcgtgccatcgtgccgcagctgccacaaccggccatccgtttagtgcgcgcgcgcggccgggtcgccggcgccgcccttctgcgctcgcgcgagtttagcgattactggctaaattagttttcttccctagtactacggttttgaaggtaaaattgctttaagatgtgtgcatatgtttggtggcaagatctgaagaggggtgccagggtcggccctgacttttttttttttgcccggtgtagaaaaaaaaataaagacccccattcaccataaaaatacaagataatatttaaaaactcaatttcattaacgaattacacacaaataagtttaaaataccaaaaagaaatactctagagtatttaaaacaatttattctaacagttctagatgcaaaatcagtgatgatagcgtcaataacaatctcatccagcagcctcttctcaatccacaaagtaacctatcaggcttggtaccatagtatacatattttgtaggcccctaatttttggaggcccagtgcggtcgcactgtccgtactggcccagggccggccatgaggggtgccagtgccacacatgcttttgtggcatgaggtgccatataattttttcgattttgctatatctcactcgaaagattttttcttatctctcacttgattttctcac

SEQ ID NO: 101028 - DNA, 1212 bp, Oryza sativa
tatatatatatatatatatatatatatatatatatatatatatatatatatatatatatatatatatatagttcctccgcccggaagttgaagatgaagaaaattgaagattagggtttcgtcctggttcccagccgtcgcctgtggtattgggtgttagaccgttggttccgctgctgctgctgttgctggtgtttcctcgtctgtgtcttcggttgtattctcaggctgtcctgagctgcaacctaagttaaggtaaataagtcctctatttattttaaggatttgcaatgattcatatttgtcaccgtgggtaccagcactatgtcctgggactggtactgtgatcgcggtttcgtaggaagcggttcgcgccgtttttcctacgacacgctcttgtcaggtgccgttgtacggcggtgccggattagggtgtgacaggatgctaagaaggaacttagcagtggcgtagctaggatttagactcagtgggaacttagcagtggcgtagctaggatttagagtaaaagtggcccatctatatgtaataggtcaattaaaaacttagcagtggcgtagctgggatttagagtaaaagtggtctatctatatgtaataggtcaattattaaaaacttagcaatggcgtagctaggatttagactcagtgggaacttagcagtggcatagctaggatttagagtaaaaatggtccatctatatgtaataggtcaattaggtcaattaaaaacttagcagtggcgtagctagtatttagagtaaaagtgatccatctatatgtaataggtcaattaaagtttagtattcacagttctgattttacataaaataaataaatattatacttgcgttgatttgattttgtacaataaaaaaaatgccttcgcgtatacaacggaatgagaggtaccgataaccgagatttttcatcacaggaatcgccgcgtgatctgttcgatcggttttttaaaaaaatattgatctattccatcaatctacaaccgatcgatacgatgattttcatcccggtccctaaacttgcagatcactcgtttaggtcttcgaacttgttcagttgtgtcaccccgatccctaaacaggatggtctaaagactttatatttaaaaataattcataactttttcatgtgaactctaatgaagacaaactttatatcaaaattgtagccctc

SEQ ID NO: 101029 - DNA, 529 bp, Oryza sativa
gaattcgagctcggtacccaaaaatgaataggggccaatttggccaagaatcaaaaaacaaagtgaaggcatgcaaaaaagttgaccggcatatatcggccgtccgatctgcgatgaacggttgttaagccgacctcgagccgtcagacccacattagggcgctctctgcagtttgaatcgcatggacgctcctattattccggggtgggcctggatgcagcctcaaaagcctgcgttggtcgtgcaggccgagcaaactgccacttacaagcgggcccatctcccccttcccggccaggcctgcacgtatctcttcctcctgccattcacgtaccggcttaaccctgacacgtgggcccgacaacatcgtgccacaaagtacacatcctgattcccttttaatggggcataatgttgcgtttaaactcgatcgatcgatcgatcgaccatgtatataactatatgtgtacggactcgagtatacattcatgcatgtacatgtgcgtttttgtacggggatcctctaga

SEQ ID NO: 101030 - DNA, 665 bp, Oryza sativa
ttattaaaatagaattttctgttgtataccacctcacatgctattaagatacatggtgatttacatagcaattatgtttctatgtgaaagaaactaaatatatatttggtcattttggtaactgttagtatctcaagcagtaccacccccattcacttccacagataatcactctccactgtgtactccatttccttctttttgatctgctctgctcgcttaacttgcatggcatgttggctaacccagaattggcaactggaggggggcagttgctgttcagtggctgacttggctgaccgtaggtacacgtatctatagtcaactaataaacggtatacatctcttcatgctaaatgtatatccttttcatgacagaatttattcaagaacgaaatgaaatctgcctatagtcagtagcaactaaatttacatttttagcatgtaattaataatgtattgtttacaggattcgctcgaatgctactctcaagttgtgggcattcgctacaatgccattttcgctgtctgttgcatttgcaaaatactatttttcatctaaataattatttcttggccctttttgcccctcactgccatctctctctctaaaccacgcactcacaactgagaccgagccgagtgagaggataaaagggcaaagg

SEQ ID NO: 101031 - DNA, 631 bp, Oryza sativa
attttcttgaacctgacactaatttcagggtacgtacattcttaatccaagccacaacaatgtctgagtggttttatatgtcgaccatctgtagtgtcttcttaactgttgattctgtctcaccaagactgaagaatgcatttctcttttacctatgtgtattcagtactatgaggtcagatatgcagatatacttcttctacttcataaatttgtggaatacagataagctagggcgaagataaatatggcaggttaaactatccgtggatataaaatatgtcatcaagccttagatttttcaagattatcaggaagtgtatatttcagactatgtatttactttattttgtttcaagtgatgcaaagccagatgatttttggtcttgtttacattgtatcggtccagaggttttgttccttagaatcatcttcaattgtatgagcaacatattccaagctgctcctttaaaggaatcactcgctttccatatatgcagtatatttttattacacgataacatcactattaattggtatctatatggaaattaaatcatgccaatatatccagtgaaaccaagtgctattggttgatagcagtaaacatgtgttttctctggcattttaa

SEQ ID NO: 101032 - DNA, 543 bp, Oryza sativa
gagctcggtaccacttagctctaacttcctttaaataattattgcaggtcctagccgatctttgctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagcc

SEQ ID NO: 101033 - DNA, 745 bp, Oryza sativa
cccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagcacgacgcgcctgcccttccctgccaggcgaggcgaggcgagcgcgtgtgttccccctcttctctccaccacacatgcttcaagtggctaggagggcatcctcccttttaaggaggtcctcctctcctagaataagcaaggtggtcctaaactccacatgcatgccatcccatgaggtgggcttttgtgattttccaaataattaatcttcgaatgggtcttagcccatctattaattccaacaatcccccaccaaatctcaaaatcccactgagatttgccttttcaaatgtactgtttatataccagcggttcgatggagaccgattaaggttgaacatccacctagaactccaaactacacttactcacaacttgaacaatggactacgccttgaattgcaagtctcgtgcaagcaagtttcactcaagtcttatctagtactataccgtctgtagactacccctcgggtggagcgtataagtcatactcctaggtctttagtaagcttcctagaagattcacccaaaatctccatagactgcgatcaatagtcaagcttacaa

SEQ ID NO: 101034 - DNA, 554 bp, Oryza sativa
atatgttatatctgccctttatgttaagatcttgttgcatttaggtatattaggcttttgtttgatatattctatttgctttgatatcttagtatagagttgtatcggagtattagtcgatacatgctagatctatctgatcggctatgctatgaatatatataatctcattattaatatatatttcgatctaagtgatttatactgtctcggcatggcgaccgatctatcccaatcacttggttttaagtatatatcgatataaggatcatatatcgttaatatctacagccgatcgagtagatttagttctgttttatttattgatacttgccgatcgatgcatatatgacatcggctcaaagataaataatatgtcatcggcacctagccgatcggctatcgtttatggatttaaccacggtttctttgtccttgtttcttgttgattgcaggatcaaatcaactggtacgctagcatacccgaaggcgagttttggacctgcactagagttaagcagatctcccaggcctcgtgttttacgtcaacacgc

SEQ ID NO: 101035 - DNA, 616 bp, Oryza sativa
  unsure (1)..(616): unsure at all n locations
atgcgtgttagtgttcttgtggctagtgcacccgtgcatgcacatttcagtactatagtatttcacacaacaatggaccggcgatgcaggtgacggtggtggcggcacttaccgacgggcagagaagccagcaactagctgaaatggctcaaccagctcgatgcacaacggttttcaacatccaaccgaaggggcaatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtc

SEQ ID NO: 101036 - DNA, 558 bp, Oryza sativa
ctgcagagcgacatttctgagaatgatgctgagaaacaagtatgctcttctcttttagtacatctgaatctctgaaggtgcccttatagttaagcagaattttgtccgatagaaagaggcgcctactggccaatgtattgtatcgaactcctttaccagtgttcaatggcgttatccaccacatatcgcggttcaagatgagtagatgactaggtggaactttgttgtgttgctagacagcaactacaatcatgagttttgcaaatgaggatactgtatacgtgcagtgtacatgtgactacagtgtacaatcatcttgatatactagcctagcctgtgcgttgcaatggaaaacaaattgaatttctagcttattaaatcaattaataagcacttatttagtatagtaataccatgatttttcttattgaacaagtaggtgattttgaaatttggggggagccaatagtagacttgttgaaaagtggtataacagtataaattgtggggcccagatgttagtgatagcgggggtgtggaaatggcaccaacactact

SEQ ID NO: 101037 - DNA, 743 bp, Oryza sativa
tcgcaagctgggccttgtgcaaatgatcctgcgtgaaatatgcacataatttgcttccccagacgagtttctgctaactattctatagatcatttgcataacccagcagccagctgtttctctcttcttccttttttcccctctgaacatgtttacttaggtcaatttccagacattgaaatgtcttgcaagattaaaattcaaggttactccgctcattctgttttgagagagttcaaggctagaagagtaaagttagtaagcaaataaaaatgatgcaaagaatatacttgatcagagctaagaatgctctcataagtcataagtctgaactcccagaaataaaacgtcaagctcttcgaaacatgatatatgccatttaaaccttaagtgcccctttcagttttaagagtagaagccatgtcttcttggatttcttttgattttctgccaaatggatcgtctcctttctagagatctaaaatagacttgcacaaaagcatgttgtgtatgctccccaattcttctccttcaactacacaaaaacacagaagataagcttattaatgaagagcggagtgtgcctgtttaaattttacctggaactaatatgaaatgaaataagcagcaataaaacgtgacagggatttatcattgcattgaaatgctacctcacagtgttacatgattatgatgtttctttcttctttcttttccttttggcatgataaaatgaaaacagg

SEQ ID NO: 101038 - DNA, 1804 bp, Oryza sativa
gaaggaatgggaattaattccccccaattaattttggaatccatggtttgatttgcgcggattagagggagcaagaaactagggttcacgggagagagaggagctgtgcgggaggaggacgatgacccaggtggtggggcccacgcaggcgcgccgtcagcgcacgcacgtgcgcggcacaggcgggagggcgccactcggcttgggcccggaggcggcccaggaggagaggagggagaggcagcccgggagggagagggagaaggagggagctgggccgaggggaaggagggagggcggcccaagagagagagagagggaaggaaaaagagagggaggagggaaggactttggccgcgggccgagagagagagggaggcttggggattatttttagctttttttttctttttaataaactttgttaattgttgttgttgcttaataaatatttttggtgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagggaatgatttttatttcgggatgaatttatcaggacgtgacacttcccaagcggatgggagtgtgcctcgccaccagaaaatatggttacatagccacctacgaaaatgggacaagttcgcctaggagaatattcgcgtcaaaatataaattttcccactacattttttaatattaatttttaatcaataatgttgcaattaattaattatctaatacataaatacatttagccactaacaaacattttattaggatataatacatatattgcatgtgttaaaagtgacgtgaatacatacaataatatttttttttgagggaaaacactgtaggggaagcccccacagttaatatattaaattaaaagaaggaatacaaaatatttacaaaaggtttatgcactgagataaagcttgtctctccgaatcttttaatctaaagactaaaagggaaagatcaatcttaaagagagctttccaggaaacaaccgaaggtggttcattctgaaaaattaaagcgtttcgttgcttccaaatgttccatgcagcatagagaatttttttcaacaatatgtgtggatctatatgagctctttgcctgcagcagcatatcatcaaaattgagagagaggttccagacaattcccagctgcgcccaacaatatgaactgaattggcattgaaagaaaagatggaaagaagtttcccttgcttgagctggacaaaggacacatgttagatctgaattttcaggagggtagtgccttctctgcagcatatcataggtgtttagtctatcaattaggagaagccaagcaaacaccttaactttcatagaacactagaaaaaacgcgtggcaaaagccacgcatggtataatgagcttaggccattgggcctagtggggtaacaaatgagtatatacttccacttaattatgggcttattttctctgatgttttgggttttaaataaatttctatttcacattataaaatgtttggattttgaataaatttatagatggatcaatgtatgtgtattaaatgtttgaggttttgaataaatttatgtttcatagtataagatgttttgggttttaaataaatttataaatggatcaatatatgtgtttcatatatatgtcgaaatttatatgaacattagtgaatctagatgggagattgaagag

SEQ ID NO: 101039 - DNA, 739 bp, Oryza sativa
aacaaattgatacaattttgagcctaaaaaaattgagattgcatgattttacgagagaagaaattaagaagagataatttgagccatagatctatcatccaaaggttagaaataattagggtgatgtggcttaacgagagaagagataaataatattaactacacttagtggggatgaactatataagtatatagggtttgtttttaactctttttatttatctaaaataagttcagttttagagtgatcattgcatcggagtttctaaaagtaaagaataattgtattgaaagtagataaagtgagaaatagttgtattaggatttgacaaagtatggatattatatttttaaaattttgtattgatgtttgtgagatgggtaattaacttattttgggacggatgaagtatactaatactctctccatctattttggatagtcatatttccaaacctaaaaattttctttttgataggcatatttcaatccgacaacctatcctcttaatggctttctcggatttaatgcatgtctctccattcttccacacaagattagctacatggacatcgagaaatgtaaatattaatgaatcgattgtttacgaggaatgactagtagcatgtttaaatggataataaatagaattacttatccttggtctatgtatcaagatgaaatataactatcaaaagtagatggagggagtatatcccttaggctaaggaatcagca

SEQ ID NO: 101040 - DNA, 2400 bp, Oryza sativa
tatagacatatattgttcttgataccataaatgacgtaacaccccaataataatagtagaacgaggaagaacagcagacatgcctttctagcaggatatttcatgataataagttctaacgaaataaaaatatgtcagttggctccctcaactacattgtcatttgatagttagcatcacaatatcgtcagttctttctaaatgaactctactacaataagtttcatatacgttgttgagcacctgagcatctgcaagctgtggttggtgagggagtagcgtcgcagtgtggatatatcgcacccctgacctatgcagcggtcagatctggctgaggggatggccaatgtggaggcgctgtgcaatgatgagtagaggagacggcgaccatcggtgtccactaccacaaaacacccaatacaagtcagcacagacaccacaaaacaccaaatataagtcggcactataggtgctaggagcggacatagtatagggacatgggggtacagctgtacccccaaattgttttgcaaaaaaaagggtatattacacacatgtaccaaaagtgggttaaaatgaatatatctgcacttaaattagtatttttagtccaattaatacctcaccctccctactccatcctgcacttaatcactggcacaaaccaatggccgtgacgactacaaggcaacaagaaattaataggctaaatgtgaatttaggttatagagcctttaaaattgctgaatatttcgatttatggagccctcaaagaatcaaattttctgagaaagtttgatatgttgaagcacaaaaattttattgttatgatttgcagggtttcaaattttgttttgaaatttccgaaattttggtaatttcaccccctcccccccaccagcaagctcagatatcgcctgaaatttttggttttttgcaaatttttctgaatttggtcaaaatttattcaaattcattcaaaatcagtcaaaatttcaaataatttcagtaatttctgtcaccccggcaaaaaaaaccaatttcaaaattgaaaaccctgatgatttgtccatgggcttttatattttgtacccagaatattgcaactgattctatataaaataaatcagaaatatcacttacataataaaatacttcaataattgattagttaaatgtaacatacccgaattctataccataaaaatttcttgtcaaaatagttggaagataaattttccatttttgagaagcaaaaatttttcatttttaacctaggtgtggtcaatctaactttatcataactaaaatttcaggacaaattaaaactttttcatctctaacctagctaggatatggatacaaacacaagtgtaaacatgcatactcacgtatgacatggtttatcttgagtctttcttgtgcatttggatctttgtttgtatgtcatactaggttccatgaacatgattaaaaagataacttcactaagaaaaacctaaaagcactcatgagtaataacattaaagacatgaaaataaagtcaaataatagtacctcaggtcaagagaaatctaaataaatttcttacaactacttagatgcatttataaattggaaatacacatataaagagaggtcttgctaattatctaaaataaattttatatctatgtgtgtgtgtctatatatataatatttctttgtgggaacttgaaaacattctgattacatgatctctcaatttctcattgcctttatttctgaaaatatattaatgttagtatttttgcatattttagtggtttaagattttgtgaattgattgcaattattataatatatactccctccgtcccaaaatataagcatttttagacttctacacagtctttgaccaataatatctataaaaataagatgttttaaataaaaagagttacattttatgatagtttgtttaatgataaacctagtaacatcaattttatatgattgatattttttaatttttttccattaatagtaaaatttaaaaatgtttgacttgacactatgataaaatgcttatattttgggacggggggagtttctatttgtagacagaaagagaacttagcttgtcaacccctccatttgactttttttttgtagaggtaaggttcttgtttctatccggtagtgcttaaatggacataacttctacttttctttcttaatccattatgtagcatctttggttatcaatgttgttcctgcaaagcgtttggttgccttttcttttcagttggtttgatttgttcagaagggctagagagatggtatcaggctatcagcatcagatgctaccatgtgtccatgtctgtgcagaaggcttgccacactcatgacataatgaat

SEQ ID NO: 101041 - DNA, 1325 bp, Oryza sativa
tatattcagacatttagagagatgaggaataagtgctacaacttgagtttgactgatgcccagttagccgatttggcttttcagggtatgattgctccaattagggaaaagttctcatctgaagactttgatagcttgtcgcatcttacgcagaaggtaaccttgcatgaacagaggtttgcagaggccagaaaaaactctagaaaggttaatcatgtttctccttacatatatggatcggatgatgaggatgaggatgactccgaaatagcagcagccgaatgggttagaagcaagaaagttataccatgccaatgggtaaagaattctggaaaggaggaaaggtatgactttgatgttactaaggctgataagatttttgatgtgccacttcgggagaaacagattcaacttcctgctagtcatacaatcccatcggctaaagaattgggcaagaagaggtattgcaagtggcataattctgggtctcatgctaccaatgattgcaaagtctttaggtagcagatccaggcagctattgagggaggcaaaatcaagtttgatgattctaagaggccgatgaaggttgatggcaatccttttcctgtcaatatggtgcatacagctggccgaacagccgatggaggacgtgcaaggggttttcaggtgaattcggctaaaattattaacaagtatcaaaagaaatataacaggcagtaggagaagcattatgaagaagatgataacggctttgatcctcattggggttgtgagttctttagattttgttggaatgagggtatgaggctgccatctattgaagactgtcctgagtgcggtgatattgcagaaagttcaagccgatcatataatagaggcaatcggcaaaggcaaacaagagttcttgttcatcaaaggttgggcccagtgaatcaagattggaaccaagaggacaatgaaggaaggaaaactcaatggtgtctgtcacaccccgaagttctcctcccaagccaaaaatttaatttataagcgaccctaagaaaataccggtgcaaagtaagagtaaaccctttttaatcaatgcaaataataatcggaagtggcatgtggaattttttcttgagttctacatgtcgaaattcactaacaggatttttagtggaattttcagagccctagaaataattttaaccaattaaaattgagcaagcaatattttaattccaggaaaatcattttctctttttctttttctttttcccttccccttccgaatgggccaccggcccattctcccctttttctccccctcctccctgctgggc

SEQ ID NO: 101042 - DNA, 787 bp, Oryza sativa
acctcaaagttctttagagatcggcttcctgaaaagaatttccaagccaagcacgcttaacctcatatggttatcataggtcatagacgaagaagttgcaatatgagtattgtacccccagcttttataggttatagacaacaccggcttcagccaataggatgtagggctattacctatcatatcactcatgcgcactcgggaagaatttttaggccaagcacgcttaacctcaaagttctttagagatcggcttcctgaaaagaatttccaagccaagcacgcttagcctcatatggttatcataggtcatagacgaagaagttgcaatatgagtattgtacccccagcttttataggttatagactgccctcataaaccaacacaagtcttttctgcacattttgtcctcactcgtacgcactcgggaagaattttccgatcggtcacgcatccctaaattgctctaggccaagcacgcttaaccttagagttatttagagattggcttccggaaaagaagttgcaacttgttgatatgagtattctattaattatattaagccctaggccgggatgttacaccctggtaccgatgatccccataccatccaaatactgtagtcacgatctcaaacgtcgacagtgacgcgccaggtagggggattttggtgcttcaaggtttcgatgagatgggtttaagagatggattctccaacaacaagctactcaatgacttcaactatagggagatctaacccgaccggagtatgtcttccgacgaga

SEQ ID NO: 101043 - DNA, 1410 bp, Oryza sativa
tactatagggcgaattcgagctcggtaccctattttatgggatgggggagggagccggccacgggaggagcgggaacggcggcgggaaccacggccggcggcaatggaaggcggccggagaaaacgcgggcgttcccgacgattgggggcgccattcaaggggggaaattggggggaattgaagaggattcaatggggattaaaaccccccaattaatttggaaagaacggttggaatcggggcggatttgggggagcaatggtgctaggttttcccggagagggagaggagactgagcgggaggaggaagaagacgacggccggcctggcgcgtgggccccgcgcggccaggcgcgcgctcagcgcgcgtgtgacgcgcgtgcacgcgggagggaggggcggctcgggcaggggcgcggcttgggccgagcggccggcccaggaggagaggagggaggaggaagctgggccgagggagaggggagcccaagaaaaggagggagagaaggagagggagagaaagagagggagagaaagagagggaggagagggagacttcggccgcgggccgagagagagagagagaggaatttgggccaaacttggcccaaagggaaagagagggttatttttaggtttttctttttaataaactttgataattgtttttgttgcttaataattattttcggtgctctgaaaattcaagtaaaatttgagggctctttttagaccaaggagaatttaacaaaaattctccgggccacatttgaatttttcttgtacgtattttagtgtttgccaatttcttttcgaattttaattaattctattattccttttagaaaatgaaattttatttcggaatgaatttatcaggacgtgacattatgttttgttattaatctagattatatcatgtatctaccatctcttgtaggttttcatcatcctgcctagatctcatacttgtctttatgcttaatgctgcatcggttgagttcgatctattaagtagtatttataattatgatatctggcttattttatgatcatcgagagagatagtatcggggttttagctgatcttacctgatttagctttatgttatatatacttaattgatatgctaaatctgtcatttatattaagatcttgttgcaataaagtgtattagacttctgtttgatatattctatcagttttaatatcttaatatagagtggtatcggagtacttgtcgcgaccgagaaaaatacattttcccgaacactagtgtattaatccccgtcccaggaaaagccggtgtacaccacagaaacatgatacaaaaggcacatctttattatatcgataatatttacattattacaaaggcacttaaggcctgacaatcaaaaataaatag

SEQ ID NO: 101044 - DNA, 629 bp, Oryza sativa
gtccaaaggtaggggagaagtaggtgcttgaagcacgggcatggcaacttggacggctccgcgcccgttgccaccaaatatcgaaggcaaacgaaccttttgcacgaccctgaagtgtcgttttggatgtcctttgttttatggacatcacccatatgggcccttgatgccactaaggtcggctctgccaccatgaagcatgggctcatagtggggaagtgctacatggtttatcttactttttacagtctgcacaatatacatgaagttgtgcccatgtatactcttcgttttgttttacatgcttactttgttgtttgcatgtctttcataacatttattttattgttatgaaattgatttcctagcatgattgataatagttaatcaagcaatatgtaatcctgaagattacttaagttaatttgctaggaaagattctatgggaaactgtgtgataatcctaaagattacacacactagtaatcctgaagattacgcatgaccaattcatgtcgaccctgcacatcgtatttaccagtcgtaaataccaaattatgttgcagaacatgtcggacataacaaagaaggaattcgccgagcttgccttggatggtagtaactacctc

SEQ ID NO: 101045 - DNA, 1373 bp, Oryza sativa
tatggatgctacatatctgccgacgaggcggacgcagatagaacacataggcaaccaaaacccttcctatccaagatccctaacgttatcatcagcaaactcctagattgcatccaagatcatttcgttatggaacccctatttagatacaacaaccatctttggatactgaatttatgggaatgggcttccataaagaaatgaccttgaaagcaatctaggatattggtaccgataacagatttctagaaatgttgtatttgaacgaaatgttcagtttaccaatttgtcttggtcggtaccgtgcaggcagtaacccgaccaaaccagatttggcaaccgggacacttcatattctcctaaatgccataatttcagtaacttcatttaataacagatttctatgcatatctatcccaattcccttaaaatgacccaaaatagcccatactacataagtcacatatatattatttttgtacctaaaaaaacacaagtcatgacatataataagtttggcctcagttttgctcagaaattatgcattaattaccatcatttgcaactgcccccacccccaaaagaaattatttgagtacaagtgtagagggtctgtcctaattggacctaaaatatcccaaaaattttgcaaacaactatataagaacaagtgtagagggtctgtccttatgcagtaaaaaaacagccatagaaaaacagccataaaaaacataccaaaactcacatttcccccaaaataattcaaccatcacagcccacatcaattcatccatcccattggaccaaaaatatcccaaaaatttttcaaacaactatataagaacaagtgtagagggtctgtccttatgcagtaaaaaaacagccatagaaaaacataccaaaactcacatttcctcaaaataattcaaccatcacagtccacatcaattcatccatcccattggacccaaaatatcccaaaaatgatatgttcttgagcaatcatcactggccattcatccatcatagcccacaatatttcatcatcacagtccacatctaaacaattttcccaacaccccattctcccccaaattcacaaattcatccatcacagccatataaaaaatttatcagtagctaacacatatagaaatgcacaagtcatcacagccatataaaaattcaccactaggtaacacatataaaaatgcacaactcatcacagccatataaaaattcatcactagctaacacatataaaaatgcacatgtcatcacagccatataaaaattcatcactacctaacacatataaaaatgcaaaagtcatcacagacatacaaaaattcatcactagcacaagtcatcat

SEQ ID NO: 101046 - DNA, 607 bp, Oryza sativa
gttgtgagcacatggttttgatggtcgtgctcatgacaattaaggaccggttcacgagtttcggttgtgaaacattaaccgtgccaaccacaagccagcgtgggtaacgactttaccttttgtatagcatggttcattgcggagcaccaaactaagaagtggcggagataagcccacgggggtcgctggggagtccatgccttgtatataagggggtgattattgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaacgcgtaaataaattttagtggaattttcagagcacaaataataattattaagaaataaacaaagttaaaataattttataaaaagaaaaactctaaaaagtcccctttccctccctctccctcttgggccggcttggcccatctccctccccctccctctcctctccccgcggcccatccggcctctccccacgcacacgccgctgacgggcgggcccgcccgccaccctcgc

SEQ ID NO: 101047 - DNA, 2048 bp, Oryza sativa
  unsure (1)..(2048): unsure at all n locations
aaaatatcccaaaaatgatatgttcttgagcaatcatcactggccattcatccatcatagcccacaatatttcatcatcacagtccacatctaaacaattttcccaacaccccattctcccccaaattcacaaattcatccatcacagccatataaaaaatttatcagtagctaacacatatagaaatgcacaagtcatcacagccatataaaaattcaccactaggtaacacatataaaaatgcacaactcatcacagccatataaaaattcatcactagctaacacatataaaaatgcacatgtcatcacagccatataaaaattcatcactacctaacacatataaaaatgcaaaagtcatcacagacatacaaaaattcatcactagcacaagtcatcatatgtagacattagcatctaaacattgaatcaacaaataatcgcactatcacattatcaaatttaaacattatcatcgaatcatcaaatcatcacatataacatgtacacagcaaatcatcacattatgcatcatcatcggtgaggagtacctaccttgcacggtggcgggctcggtgaggaggttgacatgggctcggggacggcggtcttgggtggcgccgggcttggggacggcggtcttgggcggcgctgggctcanggacggcgtggagggaggcggtggccgttggggaggccggatcttgagcggccccggcctcggggacggcgatcttgcgcaacggcggcggtcggcaatcggtagagggaggcagcggcgtggaggaggttgacgcggtggctaggacgaggttgacggacgccgggcttagatctggagaggaggatgtgaggcggccgtggtcggtgaggctggatcttcgagggaggaggaggcgacagcgttgaggacgaggaggcggcggctgtcggtgaaacggccgcggcgtcggtcttgaggactaggcggagaggaagctggcgatggcggtcttgggcgtggaggacacggacttggagaggaggccggcggcggcggcggtcttgggcgcggaggaggcgctggaggcggtggatctaagagagtgagagtgtgagagagtgagaggcggcgtcggcggtggataaggacccgtggatgaggattgactaagtaaaccctagtcaatcctcatctctatcgggcagactactatgcctgatgcggatgacactcatccatgacggcattagtactctgcccgatacggatgatacctatccgtgacgggcgttagtactctgcccgatacggatgatatggaataatctctatcgggcatagtactaaaggcccgtcacagatgacttattaaaatatttttaagttataaaaattatttataattaacttctacccgatttaaaattgctattacatttgatttatcacatataattaacaaatgtcttatttacatagtttaaaattcctattaattttttaaattcatataattgacaattgcctttctcacatatagtttaaaattcctactagtttttttaaaatcatctaattgacaaatgcctttttcacatatagtttaaaattcatattacttttttaaattcatataattaacaattggctatctcacatatagtttaaaataagtataattttttgaaaccacataattaacaaatctatttcttcaaagagttttaactggaatggcatgaaacatatgcaattcattcattaaggctccaatacaaattaaatacatcattcacagtgatatgccttccgaatggtctgaacgaacgtaagccacttcgtcttcgggatcatcatcaaggtcgatctgagatctgacatgaagattcttattgtattctcatcttgtgtgacggtgtaaaatgtgtatccattgatatcgtacccttgccatatgttaacatcccaagatggaccccctgccaacctttgtaatatatcacttggggccatcgatcgacccgtgctacacgatccttgaaccattcgttgaagcgagcac

SEQ ID NO: 101048 - DNA, 610 bp, Oryza sativa
aataatagaattaattaaaaattcgaaaagaaattggccaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctctctttccccccgtttttccctctctttctcctcggattcgtccggaatcgctcccgcaaacctcgccggcgccatcaatggcgggcgagatctccgcgcccgtttcctccct

SEQ ID NO: 101049 - DNA, 570 bp, Oryza sativa
ctattgtcctattcacaagacgaagaatcacgacttctcaagctgcaaagtccttctccgtgccatgaagacgccgcttcctaaggtccagcaatcaaaaatctctcttagggatgcagacaaggaacaaggagcgacgctgatctcggatcgattcgttggagtgattgacatcgatccccacgagccatcagtcctatacttgctcgaagactatggctcatcatcctccagtacaccacgcgtcgtatttgccattggtgggaccagcacgtccacgcacgctaatgcataggcggagaatcaagcggtcacgccggcccaacacctcggcaccatcaacgcaatactgagagaaaacacctatgatcccatacttaacgatgatctcgcatgatggacagaatgactatgggaatcggttgccaatctcagtaacgcgttcgaggaggccgctaccagagcgcaaccagaacatccgacagctggcggtgctgatggcgaaccaccggaggaacggacgtcgcctatacgagctacccctccacctcgcggcaccggcgatctccg

SEQ ID NO: 101050 - DNA, 714 bp, Oryza sativa
ttcctgcagccccaaatagtaagcagtgtgcttcaacagacacaacctcctacattttttctactagtatcctcgatcaaatttacatattctcttcgtgttttttgctgtgtcatgtgcctttggtccaaccaaggagtagtactagaatccatagctggctttataacggtgttacgccatgctgatgccaaggtacaacttgtgctgttttatttgattcttgccctttgcgttgcatggaggaccaaaaacgattccatgggaaggagaactggagaaggggaagatacagtaaacaaaagcaggtgtcggcagaccagcacactgctatatagtactccagtgcaaatagttttttttaaatcccgtgtttcattctggatcatgggggtggatccggcaccgcgtgacggcaactgccgcaatagctggacagccggcgcaaccggtgcctgcgaccggcacgtcaccgcgcgcacattgccctgtctccccactttgaccgcctaccgacgatttcgccggcgagagagtgatcacgatttggctgcaggggcgtccccgtctgcccccctattcatttttctgatttctgtggttgctgccaattgaactccggtaggttacaaacgaagccacctaacaaagcgtcatcttctagtaactgaatttttctgtgaccgagtcgaagtcgaaatcgatgtgcaatga

SEQ ID NO: 101051 - DNA, 658 bp, Oryza sativa
agtatctgctagtatgaaggcttctcacatgggaacagattttgataagttaaaattcgaccccgctgaatttagtagcaagaaggaagtatctatagtgcataatataattctttggacactcaagtttgcaaattcttgtcataatatgctttctaaaacacctagtgctagctgcaatctttatgatagcatcaaggagctgattgagtgtgtgcagcagaatacttctctgtattgtagcacatacgaatctttccatctggtaatgtgtgcttgtatttcatggtatgcttgtaaaactcgagatgtcaatcaagaatcaggggattcaaaagaacaacctgacatattctttagtccttctgtttggttaactcaggagttgtgtgcaattcggataacaaaaatgcttttcagaaaccagaggtattgggatgcctatagatctgctatgtactgttgtcgtgaaggcctctggtttgcggcgtcgtctgtcttcagaaaacttgcagatgattttgggtcaggctctttcagtttttggttcaaatcattgctgcttatttcagctggagagattgagatgaagctactgcttttcccttcagctatcattaagttggtcaatgagcttaaaacagattgcgatcttcat

SEQ ID NO: 101052 - DNA, 604 bp, Oryza sativa
catatgaacattttataccaacaatgcacttttgtagatttctatggattattgactcctgtttcttgtattttattgtatgtgtaagtaactaagtatataatattgtgagtgtgaaaaagtttgtgcaaagcatgaatgcccttatagtgatcagtgagtccacaactacagcctgtttctactgtttttccctttttgtaagaaagccatgtcatggtgtcaatgtccaaaaatctcacgccagcttttaactacatgccatggttttttgggacataaggagttgtttgttcgaaagctgcaaacaaacaattccaggtttcaccgattttggcatttttaggttccttgctgaattatcttgtatgaaatgaaatgactttctcccttctgttgtgcagttgggttggttgccagtagagcatgttgcatcatgtgattgcagggaaggagttgaaatgctatttccattcacatccccaaattccaaatgtcccaaactggagtgttgatggaataatttctcatgcaaaggtcaaccatacaaagccaacggtaagttatatatagttgcttttttcatactcccctcattccataa

SEQ ID NO: 101053 - DNA, 901 bp, Oryza sativa
  unsure (1)..(901): unsure at all n locations
ctctaataaaatataatacatacacccaaaaatattagattagagatttntaaggtgtatgatttaaaaatgaattaaaaggaagaggaatgtgctagttaactacatatatgcatgcgtgttttgtattaatattaaaaacaaatggttacgtgtcttactcttgtaccctctccgtcaaaaaatccaatcatacgtgtacccaggttcgtagctagagtttgctcttttttttttttgacagagtagtataaattaagatcgagtacctaggaagcttctatcttctgatcattaatgcagggggcatattgatcgatataggagggtttcacgtacgctaggtataaaatgtgcgtgtgcagtagtacatgccacatgtgatagtcccaaaatataagggattttgggtgaatgtcaaatcccttatatttttggatgaagagagtgtatacttagctatagctagtagaatatgtgtatatacaccaagctagattaccgttttatctagctaattgggatgagattcgtgtgcgctaatatatcctaatataacattgatgtttgatgaaacacagtacaataccttttttttgacatgaaatatattcaaatgacttatgatatgaaacggagggagtactacctatacattatatattagacatttatatgttagcacctcagaatcggagataaccctatactacaattagataatggaggtattccgatccctaaaaaaaattaaatgattggaggatcgatagagattattccggacctcagattgtacgtcaactcgatcctaggacctaccatgcatcgatatcagggtacgcgcttggaatatgatctcttcttttttactagctactatgcatacctttctttctgt

SEQ ID NO: 101054 - DNA, 585 bp, Oryza sativa
gaatagatcggtttaaaaaggccggaaaaaaaaacaaaagacttagcgtgtgagcatacaaaactctttcgcgtgcaacacaaatcgggaaaaaaatacccggtgccaaaaaaaccaaacggacttttttttactgggagactttttttcctttttctacgggagtcggacaatatttttttacgatgagatgttttttttacttacaacagaagctttttatttttatcttgttgagtcggactttttatttctttttttacctttttgagttggacttttttatgatgagatgttttttttttacttacatcagaagctttttttatcgcttgttgagtcggactttttatttttttttacctttttgagtcggacttttctttctttcttttcaacagacgacagaaatttcttatttttagtagagatatagattaaaatagaaatataaaattaaaaccgatttaaacacagatgacgtaccaaaataccgacaaaaacatctttaatttttataatagtagagaagattagagacatagagatcagatttttttttccttttcttttggcttttttgga

SEQ ID NO: 101055 - DNA, 1271 bp, Oryza sativa
tacaaaagtcttcatcatgactgccacacgggcccacctgtcagccaccgcagctagtgtaagggggctcatgaggtaaacatcgagggcatgccatgttgcgcaccttttttctctagggcgacatggcgcatgaaggacaacatgcaccgtcacgtctctcacatcgctggtgagttgtgcacagggatttgtaccgccctgcaactaatatggagtgacggtataaagaaacccataggacgtgtcaaatccccttaatgggagtaggatggatctttctggggaaagcctaggtcctgcaagtgtcctcggggccctgattagacctcgcggtctcgaggcgttgaaggcttgtcccagggctaccgctgtgctcgggtcaccccgtgtgcttggagccacaaatgtcatcgtgtgtggacttcttttcatatcgggggaattaacttagtggactcttcagcaagcttcccgaatatatcgttgttgaagtagttcgaggtgtatctgcttcagttgcccaaagatgtatatcttgtacatctccatgctcttcttcagcaccttaaagatacagatcttgtacgtctcgataaggctcgcattgccctaggcatttgagggaacgggaaccctcgttcccacttccccgatagatcatattgaaataagtccacattagttacaacttacaaactctaaatgtaaaaaaaaaagtattttgtgaaacacggtacggacacgtacactcatatacacatgcgtacactcacccttctaaatatacacacggtccatataagcacctcctctgtggattggtcaacacatcttaaaattaacaaagtcatcgctagtgccttgttattgacgggtgcttaatttgtataccgttgaaagaataaatattcgagtcatgccaagtataaaatttaaacctaaatttaactaaatctattatatctataaagtaatagaaaaagaagcctccacgttcgctctcacagtctagaaatccatgttaatcggaagaaaataagaaaaaaaataaaaatagaagggtattaggattaggttttgtgtaaacggaaaaaaaacaaagagtaaacggacaaaaaaaaaattccaatcggacaagaaagataaaaagtgaaaacggacaagagaaatagaaattccaatatttgtctctatctctactatttaaaaagctatttaaaaagcaaaagaagtttccgttgtccgtgtaaagaaaagggcgaaaaaaa

SEQ ID NO: 101056 - DNA, 681 bp, Oryza sativa
cgccagagttctacaagaacaagaaggcaacacttttttccaccacaaaggatctgaaattagggtcaaatatgttgcttttgaatgcaactattgtgtttctgcagtgaagggatgtcaatcattgacagcaaaatttccctaaccaagttattacagaaaattatcctagtcatgatttgttatatgagattcaggcattcagcaagcttaattccaagtctgcagggtagaactttttttgttcctacgacactaaagcacttaatacagctgagctaccctgaagttatggttaaagaaatgtgattaagtattgtctttctgctttagggagtgtttaaatccaggggtgtaaagttttggcatgtcacatcggatatggatattatataggatgtcgcatgaggtgttcgggcactaataaaaaaactaattacagaatccgttagtaaaccgcgagacgaatttattaagcctaattaatccatcattagcaaatgtttactgtagcaccacactgtcaaatcatggagcaattaggcttgaaagattcgtctcgcaaattagtcgcaatctgtgtaattagttatttttttagcctatatctaatacttcatgcaggtgttcaaacattcgatgtgacagggtgtaaaattttggggtgggatctaaacaggg

SEQ ID NO: 101057 - DNA, 957 bp, Oryza sativa
gcactaaagaaaagaataaaaaaataaaaagaatgatgaaaacaggaagtacatatgtggtgtgctccaacattcaaaacattagtcacactgtcacagtaccctaaacagattgtgctgatacagtcaaaagacctttcagtgttagcatattacatcaaagcttcactataatagggtaaacaccagtagaataaaacaagacaaccttcagagtaacaggacaaaccttccaaaagacaatctacatagtactagtactaccatctgacttcttaattcaagtacaataaaacagaccttgctaaatccttgtactagagaatggctttctgcccactctaagcttggttctcctagtgcaaaaggatgttttcgcagtagtaaaagtggagccgacgctctgcatgttagcgcccatctgcaaatgactcataaaagagtggaacatacggtagatatggatccgaggagtcatgtccaagattgcgtataacacgcacttccttgcgatccatttcatatgccatcaacgttttgtcccatccataaacaaagaatatcaaattacattctggatgaaccacaattatttggtagtcaaatccaaactgatatttcttccctccaaacagcctcaaggagctaacggtgtgctttaatatccaattatctgtatcataatcttcaagaatccaaattgacagtttgaagatgtcatctggatcaacattaaaagcacataggcgaccctgagtttgatgaattatgccagtatcaccttcaggctccggcatagcaatggtcctccatttcttcccctccatgtcaaccaccgcaatctcagcagcacacgtagcagaatgcagaaaaccattaaggaaaacacttctcggattggcccaatgccttagaaacacatcatcgccccatccactcacatgaagagtccacaac

SEQ ID NO: 101058 - DNA, 593 bp, Oryza sativa
  unsure (1)..(593): unsure at all n locations
gtgccaccagatgactgtccagtaccaccagtgcgtataaattccaagcgcctagcggcgtccttgattcgaacaaagcatttgcaggtgaatgggtcacggaatagcgcacaagcagcataccacacacttcctccaatttcatggccatcattttccaccaactccatgcacgcatcaaggcccatagacttctctgcttccatctgagcaacacgactctggtagctctgctctcggatgtccgcaatcctcnnnnnnnnnnnnnnnnnnnnnnnnnnncgtgacttcttggaagaactccctgaggcagtagtgtttgctgctggcctctttcccttgccccggtctgctgccgttgggggtggagttggaggtggtggtctataagcagcagcgagctgcgccatgtcgatggtctgccactgaactgctccttgcggtgcctatggggctgcccctgcgacggcggagtggtttctgacaactgtgtgcccactgaataccgcgtggtgaaggtcaatgtgcttcagaggatcattcctgaagcttaagacacctttattttgctgcaacataagtagacagtaaaa

SEQ ID NO: 101059 - DNA, 680 bp, Oryza sativa
aaaaaaacaataccaataataaatatgtaaatcatctttgccaagtatgaaccatgccattataattttgcaaagtttatgatatgacatcggtatctcaatgacatgtagacctacatgagtcaatgacatgtgggtcaggatgacatatctcaaattttgcaaaattataatggcatggttccaatttttccttttatctatatatattattatatatattattaagatagctttagaaaatcatcacagacgtcctatagacgtagaaatctttattattaagacaactcggaaagaggtacgctatttattctaaaggatataaattatcagattgatcaaagaataaaatccaagccattagatatggtagaaccaaattataactgtcgcgaccgagaaaattgccttttcccgaacgctagtgtattaatccccgtcctaggaaaagccggggtacaccacacaaacatgatataaaagacacatctttattatatcgataatatttacattattacaaaggcacttcaggcctgacaatcaaaaataaacagcagcggactagcgggcttacggctccatcttcacaggcgctcaactggggtataagccaggactccacctaagacatcttctccaaagcttctcttactaaaggggggaaagattgagta

SEQ ID NO: 101060 - DNA, 649 bp, Oryza sativa
tgtctgtatacttcaaaatttttacacctaacaactacatggccataatagttatataactaatataaatctttttcttacgaaagcttaaagtaactatagaaatcggagtaaaaaaagcttgagatggaaacgaccaaacaaaccacatgcacaaagtttctttctaatttaaccaattggattaagaactaatgcattaacttatttaagtaataagggcatgtttagatctgctgtcaagttttttcaccatgtcacatcgaacgtttcaacacctatatgaagtattaaataaaataactaattgcacagattgcgactaatttgcgagatgaatcttttaagcctaattgctacatgatttgacaatgtggtgctagagtaaacatttactaatgatggattatttaggcttaataaattcatctcgcattttatcagtatatccgatgtgacagggcaaaaattttcacccctggatctaaacacagcctaaaaaaaattagactccgcgtttgctctcatggcctagaaattctcatattaatcgaagtccatatagaaaaataatttacatagataattaaaaataatgaatattggaagagaaggctagagttcatattggtgtacaatttataactaa

SEQ ID NO: 101061 - DNA, 747 bp, Oryza sativa
atgattccatttctccacctctagacagtacaccaccagtacaagaaaccggttctccatcgagtacagcgccttcaggagatgcaccaactacatcatcttcagcagctgaggagattgatggtggcacatcaggaccaacagctccccgacacatccagaaccgacatccgcctgactcgatgatcggaggcctgggtgaaagggtaactaaaaatcggtcttatgaacttgtcaattcagcatttgttgcctcttttgagcccaaaaatgtttgtcatgctttatctgatgagaattgggtagaacctccaaattccacttgcaatattatgttttcgagacgagaagcttttcggtagagctttggaaaattctacatgtcacatatttcatctatttgagtttaatttttctatgattggttctcatgtgctatatcaaaagaaaaataaaaaaaaattggggggaggacgccagctacattggcgctctccccctgctaccctagcgccgacccgctacggtggcaggaggctggcgccctcccgttggacgacagtgccaatgactctggcgcccaaaaaagactatttccggggataagttgtttcttagatctatttacgaaataagtttttcaaaagaatgaaatcgtaaaaaatccaatagcgttcatcatacgatcgatcgctgcatttaccgagtccggcaatggacaacgttccaattggagcctgtcacatc

SEQ ID NO: 101062 - DNA, 725 bp, Oryza sativa
cacatcgagttcttctactcgatcggaatatctttattttgcttcaccatcgctgaacctttttttgtatatatattgtttttccatcgctgaacctgcacttattatactgctgaagtccccatcttctagatagattatccgagtcaacattaatcatatagaagtcattcattctctctagattatcagagtctacattaataatatagaagcaattccctttctcatcattgcaagtgtagatctaactctgaaccccattaattggttggtttaacagtaatctctgaaccgcacctccgtctccactgattatgcttctaaatagttgactatattcaatcaaattgacacaatctaaagctccgttctattcaatagtataaaatgatattttcagcgcacgcaaaacgagaaaatttactagcacataattaattaagtattaactattataaattaaaaaatagatttatttgtctctttaaaacaactcatacataaaaacgtaggaagtacatgataaaccggaacaaaatattttaacgaaaaacaaccaacagagagcacacacaagtaggcacaggcatttcgcctgaaagttccatctaacagtctaaaagactatacactgcaactgggttcatgttacatgttctgtactctgcagtacattgatcagactaatgtctccacgtccagtattgcctggacactttgga

SEQ ID NO: 101063 - DNA, 510 bp, Oryza sativa
aaacaactatgacatatagctattgctgggaaagaaggggtcatggtaggctgagggtcaaggatggatgtttttcttatggtgaatcacaccttattttcatcactatacacgcacacatttgcagtactagttacggtcacttgacatagtgctacattatttctgtcctcaacaataaacaatgcacattttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttt

SEQ ID NO: 101064 - DNA, 785 bp, Oryza sativa
  unsure (1)..(785): unsure at all n locations
cgatgtccggcgcctcttcctcctcgaactcctcaaccggtcggtatctaaaccctctccctttcatcgacaatgtcgttcatcaaacccaaatagaaccacccgactagatctaacctaggtgatcctagtgcaaagtctaacaatggtatcagagcaaccctagggcttagatcggttcgggaaaagaaatccaaagaaagaaaagcacaagatccgcacggatcaaaagagccgaaaaccctaaccctaatcttacctcgtcgccggccgtcgccgacgccggcaacggagggggggaggggcaaagaggcgccgcctaggagccactcgacggccgcgcgcgcacctgcacgcgcgtaccggcgagggggcccgcggcggcgccgccatctccgtcgtcgccatctctctctcacacggtgggggttagagacggtggggggagcggagaaaaagagaaaaggcgctggccatggcgcggcgggcgccaaggtcgccggcgatggcgacgccgtccacgcggtcgcgtgagagagagaagagaagagatctatggttttcggcggcccgcccggagagggggttttgatcctcgattttgcggccggccgttcgatcgtaccctatattgattgaccgtcacacccggccggcccgatattgtccaatatgcccgcccgggggcggtttcttgccacagccagttgcgttggggaaggggcccnncctgcaaaaggcgggccgccgaaattattaagcctggggcgaatgaaaaaaacaag

SEQ ID NO: 101065 - DNA, 1352 bp, Oryza sativa
tctcacctcaaaaacagttttgtgcatgaagctctgattaaacaaagtccacagaatccagtatgcctcctcatcgcttgtatgttgtgatgcaagttggcgcaacatctcttccgccaacctttcaacagaatgctggtctctaatagcctcaaccacattaaaccaaaattgggaaacatgcttgatcttgtcaggacttatggttttatgatcagattccatacatctctttaagtgactacggatcctaggaatcagctcagcaactaaaatgcctgaaaagagcaagatatattatcagaaatacaacaaatagtagggaaaaggatggctacatagattacaaacaagaagttgttaatgactagaacagtgtgctaggatgatcagccatgacatgaggcactgctatcctgggtgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattggtaaaccattactgcaccaactagagctgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatagccgcttgttcagttgcaacaagaagctgatcgacaacacacttgaagaatgaccttggtttccatcaaggacttacagtttggaggaacaaacatagtgcaaataaatacatattagctgagaaaaagctaacagaataaaaggaaaggaaaaaaataacaaagatgtttgtgtttgtgtgtgtcgtgtttggggcggtgggggtgaggatacgatgatgtcagtgcaggtgaagctcccattcttgttttatctggaacagatgcaagtagttgagcaacccttgaaatgaaagctgctctgcatgggtgtcgagttgtcatcatcgtgcttgctgcttacagtaaactctgcaataatctggctgacccccttattctcgaccaaacatagaattaacagcctgaaatggggggaa

SEQ ID NO: 101066 - DNA, 617 bp, Oryza sativa
catatagaaatacaattaggaaataactgaaattcggaattaaaaattaggaatattagaagaggagaatagagtcccgattgaaatacaattaggaaaagactaaaattcggaattaaaaaataaggaatattagaagaagaaaatagagtccatatagaaatgcaattaggaaataactgaaattctaaattaaaaataaagaatattagaagaggagactagagtccatatagaaatgcaattaggaaataactgaaattcgaaattaaaaataaggaatattagaattggagtatagagtccatatagaaatacaattaggaaataataaaaatttggaattaaaaataaggaatattagaagtatagtatagagtccatataggaatttaaaactaactaaaatttgaaataataaacataataaaattaaaagtagagtttagagtccgtataaaaatacaatttacaaataactaaaattataaattaagaaaaacatgggaagaagagtttaaggtcaatatatgaatacaaatataggaatacaatttagaagtaactgaaattcgaaattaaaaattaaagaatattgaaaaataagtttagagtcc

SEQ ID NO: 101067 - DNA, 581 bp, Oryza sativa
acaatgtgatgaacacagcagatcagcacttcataggtatcataagaaaaatagcaccacacataaattaaccaacatgttcatcagtggctatccttttaattatcatgactgttaatattaactcacaaccatgcagtgttttatccctcgtaaaataatatttctgtttaagcagttcatgttatcctagaaagcacaccgcacaaaggtgattagtactaattagcaaacttggttcattatccagaactgtagcctaatatttatttgagaattcacaggtaaaagtttcagcataaacagtaaagttttcaaaacatgcacgcagataaacacatgacatacaaagacaaacaaagcatgatgtaaacagttatgccgacgatttggaggatttgaaaccaaaaaaaaaaaaaaaagagagagaatgaagatcaaacctccatggccatcataaacgccaaagaatgacgtcatggtatcatcaagatttagaatagctgcatgctagagaatatagagggcatatgtcagtcacagtattttacacaattacttacagatcagtaagaaatttt

SEQ ID NO: 101068 - DNA, 600 bp, Oryza sativa
aaacgcctccagattcaagcaagagttcgacgcgcggtgccgctcgatcaatgccactcagcgaagacaagaacgagaggaccgcgacacgaaacaccaagcaaacaaacatcaccaccaccaatggagcaagatcgaagaagagtagggagaagaatctcacggcgctttcggagaagtagggtttagggatggaggcggcggacgaaaccacagaagaggaggggaggatgaagtgagagagagatctcacctcccacctttcgccgctgcgctcttgacacccccgagagagagagagagaggagagatgcggaaaagtggttgtgctgcgaagcgcaaatagttgtgcttaaatacctggatcgtcgacggctgatccaacgtcgaggagtgcccccatcctgtggctggtggtccccacagatcgctccccctgcacggacgtatctcctccgtcggttcgtccctcgcggctgatccaacgctcgaggagtgcccccatcctgtggctggtggtccccacggatccctccccctgcatgatccatccacatgtaaattttcaactacccttaaaaaaaaaaccaatcccaccta

SEQ ID NO: 101069 - DNA, 608 bp, Oryza sativa
gagggcaaggaggaggagggaggcgaggtggtggaggggagaggcgttcggcatgggggggagttggctgggctgggctagggtttgggcggcgcggcgccggcgtggagcggaagcagcgcaggtggtgcaggagaggagcaccagcgggggcgtgtgggcggtggtggcttccgtggggtttatttttgggggaaaggtggcgacggcgaagaatttgggggtggggttttacgagccgggggaagcgcgcacacgtgacagcggcacggctggttcgcactcgggcgtgggatgcactgtagtctgtacgtgtaggggggcgccttccggcgaatgtcagatggcacgaaaaactttttaatggtacggactacggagggcatttcactggtacaatcgtgaatccgtcgggccatctataatatgagccactcctcgtggggaaactcagcttacaatggaggataactgtggatgggctactcaaaatctgaagcaactcaatagagacactccaacccatagtgggtatgcagccacaaaaacccatatatatttttactaccctacccctaatctctctctccagacccttcttttctttt

SEQ ID NO: 101070 - DNA, 691 bp, Oryza sativa
aactcgaggacgcctacatagccggtgtgtagttcagtgttgaacttgccgtctatcgccgtgactagcagtaaaaacctgatgatggcttaacagtgggcagggttgcggtactggtacggatgctgatggaacttcacccagtggttgtcaccggggcgtaataccacagctccgggtaggcgaggtcgatgacgagcacggtgcaactggccgggtccatggaaccgcagcatgacaagaggcacctccggagattgctgccttccgcggcaaggacggtgccgtcgtggtcgggaggcagcccgacacggcggccagtgaaagggtcccataaaaaagtgcacggcgagccgcggcgcgccatgagcaaccagccctgcgccgtggtccaccagcggtggcatctcatcatgtcgtcgacgccgccgtcgcccaccctcgttggcgttggcattggcagcagcgccctcgtcggcacgctgtacaggaacgtggcgtcgccgtggccgccgaacatcagcagaggagcaaacttgggatccagtgctgcagatgcatcgcctgcctcctccatgatttcgacggacgactggccgatcaaattcataaatccttataaataactattggcataggaaagaggtatgcacatctacgacctacaattagtactcctaccaatcatctt

SEQ ID NO: 101071 - DNA, 525 bp, Oryza sativa
agcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgcgcctattaaaaaaggtccagttagttacatatca

SEQ ID NO: 101072 - DNA, 514 bp, Oryza sativa
aatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgatttccacaagcccttccaatccttttggctttcaagcagtctcgacgccattcctcgcccactgttgctctgatcagcaaagaaagcttctgatcgcgccagaatgtaagccg

SEQ ID NO: 101073 - DNA, 501 bp, Oryza sativa
caatgggataaattgttcagcaatccatccagcatgatgctttgcttgcatccttggactgaatacttaagagatagctaaagtttagcccctctctcccaaacacccccttatgttttttgtgaaggactaaagtttaggtgatgtttggatccagggacttaactttattctctatatttagacactaatttagagtattaaatatagactacttacaaaactaattacataaataaaagctaatttgcgagataaattttttaagcctaattaatccataattagataatatttactgtagcatcacataggctaatcacggattaattaggctcaatagattcgtctcgtgaattagttcaagattatggatggattttattaatagtctacgtttaatatttataattagtgtccaaacatccgatgtgataatgacttatttagtccctcccacccaaacaccacctcagtcagctttggattctcttatcaaga

SEQ ID NO: 101074 - DNA, 725 bp, Oryza sativa
gtggcatataagagagaagccaattttaaatggcatataagggaactggttaaattctagtggcatataagagattctctctattatttgcacgctgctgcgattagctgattagctccagtttatgtgtccgaaactctgaataatattaatcgtagaagagatgtactattttctgttcttgttgcttgaacctactaactgggacaagcgtcttggtttggcatccaaatagagaagtacagaaacgaagctacgtgcaggcagctcagagtgtggtgcaaccctttgtctaatggctctgaaacttctgatggggactgtgcttggctggagtgcaacacatttacagattaaaccaatcctaattataatacatttttgtgctagctatacacagttctctagcacttacctgatcaaatatactagtagtatacaatatatagtagtagaaaactagaacgatttgtacgttgacccagacagagagagatgccgggcagtgtgtgcaggaatcaggaggcaggagggatgttccttgtaaggcagcaaccagcatagtttagctttggtcatctgtcctaaatgggatttgtcggctaaatcacaggcgtttatccccttccgtcgtatatgcacaacactacacggtcgtgcaaaagcaggatagcttgacttgaagctgtggcacttcctctggcattgcttcagatgttcttctc

SEQ ID NO: 101075 - DNA, 725 bp, Oryza sativa
ctctcagttttgtaccatctttatttatcatctgaatattaattaattggtgccttcaggatcttgcagttcttgggaattaatcatagctatctaggaataggacagctgtttgtttatgaaaaaaggcttgatcttgatgctgtttcatcgtctgatcatacatcgcagcgcctttcggatgtgtacttgtgtagtacactataaaatcgtatcgtcgcggcgatcacatcacgatatattggattgaagatttggagtccgtccatggagagagcagcacagggatacacatcctggggtccaatgtagaagacgacgtcctaacatagtgtgcacttagtttcagtccaattgacacgaagaacacacaattaacaccaacagtgcagtctcctgctgggccatgcgtggctgaactctgatggcttccaaattccatcacattcccaaaatcgcaccgccaccaccaatcaatcatgaacacgacagattaattagagtttaaatacttaaaactataggcatctttgagcgatgtgatgtgactcaaatttatttgctcaagacgagagcgtgaagcaagcaagaagcttcacgagtcattcagaagaagaaaaaaatcgaactttttaaggcagaaaaagatgtgtgcaacaggagctactagctagaggagtactagagaatcaatcagacaagaacaatcttcctaaaccgtgcgt

SEQ ID NO: 101076 - DNA, 513 bp, Oryza sativa
ttagtgcacaatcgatgattgattgcattgtgggggaggtatgaataagtgtaccggtagtaggccgtatagcacgacgcagagcaacatacggcaacaccaggagtacgtacgatgccgtgggttattacgtactcccccgtcccaaaaagaaaacaacctgtgacgaatctagacaactcttatccagattcgttgtattaagaggggataaatttagattggtttttttatggagagagtagaaaacgaaaagaaattagtatcactacagagccaacggcctagatatatgctctctacattccaaattgatctgcatataattttttttatgttattcctaaattatctacatatttgtgttcatttattaagtctattcgttatttgtgcattggagtaaatggacattgatgcatgcatccatgcacacaagtatttataacccacatgcaatatcttgatttgctattggctaagaaatagtagggatggtgtatacattgagtt

SEQ ID NO: 101077 - DNA, 623 bp, Oryza sativa
catctagcacactcgtatgcgagcttaattcgagcctgccagcttcacttcgccaacaacactcgagcattgcaatctgcaagcttccagcagcaagcagcctagttagctcacagactcatctcagtatcacaccccatgatttcttagatgcatatgcatgcattcaaggacaaatcaaagcattctgctaataagctcgctaacgcggccacaaaatccgtcgctgacagatcatcagaagcaaccaaaaacccacattaatcgcggcgactccgctcagatcgatcgatcgatcgctgcgcccaccgtgatggccaccacaccagccgtcgtcgtctcctagctccacacctcccccttgaccaccgccaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggt

SEQ ID NO: 101078 - DNA, 623 bp, Oryza sativa
ttaaattgcgaggttcttaagtatgaattctttggttctatatgatcaaagtgtcatttggaagatcgatatacatatcaagtgcaacgttacatgaagaaatagggtctctatattttcaatatactgaatagtataactgaagaggaagaaagaatcaaagcacgtatatagatgcattattcttactgatcgatcaccacacattgaaattcaagtagaaaaggtttatcaggagttcgatctgttggatcatggtattctaaaaccctacctttagaagggagcctgcttttcatcagagaccatggaagttggaacgaaataagtacattcatgcataaaagaagaaagacagactgcgcaggaataataatctcgtagagtagaacataaacacagttaaatattgcctttgctcatcccaaagtatcatgcatgcatgtgtgtatgttctgtgttcagccaacaattaatcttgctagatacaaaatatacagtaaaacaaaacatgcataaccgcatccaggttacttcttatccccacttcatctcttatacatacattcttgaaagcgtatgcagaaggttaaaccaagctactcgaacagatctgagttatt

SEQ ID NO: 101079 - DNA, 742 bp, Oryza sativa
  unsure (1)..(742): unsure at all n locations
ctctgtgtatctgattgacctangnannncnnnncananattgngaagtaagcaccccaccaaacaagcccatactatctttcttaattgcacacggggaagagcctcccagtcaccacgtctcttcctctctcttctctagtcgtcctgtcgaggagcatagccgacaggggaggagggccgcgcccggtgggcgcgccggcgcccgggggggggggggagacaaacctacctgacgctcagaatgccttctaccaagcgaccattaaaccttgcgactttttgcttaacccgattccataaactgtctctagtctttgacttgcatattcaatcgcctatctctcgaatttcccttaccatcctttcctcgtcccctttcaccttctccctccccttccaaccgttccctttcctacctttcttctctgtaccttctaggctctttcagcatcatacatcttccctttcgcgttcgaaccttacttccccctcgtctacctaggttctcgcctctatcccagcccttgcccactttcctaacctccttctattgatctctatctttctctccccacccatttctattcttctttctaccaaggcttcctccctatttgtctcccgtctcttcctctctcttcttctcccctttcctcactgtacttgacctctttgcttctccctctctctttcatcccttctcctaccttctcgttccccctcgctcctctcccctccc

SEQ ID NO: 101080 - DNA, 738 bp, Oryza sativa
  unsure (1)..(738): unsure at all n locations
aagcaccccccgtcccggggacaacgggaattttttccgggggcgccggggcaaggtttttcgttgcttcttgctccaattgccgctgccgttcccagtaattgttaccccgggcaacccatcgcgcgttgaattaaaaacgcaccggccacggcggctgtggttgtctagctacttaattaattttgtggttaataaatttttgaaagcgagcgcgaggcaagctagctagctagcggagccgtatagaatttataccaccctgatcggcggttgctatcgatcgatcgaccgggatgatgatcgataattcgatattactgaccaggtgcggatgaatccgggacatcaagatggaagggaagaagcttcatcggaatttcgatcgatcgaggcgtatgtgggtcatggccgggtgaggtggccagggacgaattttctttgttttggtttacttatatctatctatcttctatctattatatatatatactaaataaaagtccattaaacttcctataaacgctctcaagccgccacgtggcactcctacaaacgctcctagaccgccacgtggcaatgtctaattacatcgtcgattttcacttaatcggtggacccaataatttagaccattagattagattagatgtattatatatttaaaaaagacagaaataccttactggtcaccacgaaaaaagaaacaaagcacatgtnctccatatatccatatat

SEQ ID NO: 101081 - DNA, 825 bp, Oryza sativa
  unsure (1)..(825): unsure at all n locations
gggctgtactgatatcgcctttttgagatcnnnnnnnnnnnnnnnnnnnnnnnnnnnnnnnnnacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcgtcatgtatatatatatatatgtgtgtatatatatatatatgtgtatatatatgtgtgtatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatatatatatatacacacacatatatatatatatatatatacacatacatatatatatatatatatatatatatatatatatatatatatatatatatatatatatatatatatatatatatatatatatacatatatatatacactcacatagatatacatatacatactattatatacatacatatatatttccgtccatactttcctatgtttgcacgccgcgcacatttttccgctacatatatacatccgtacctacgtattaattttcttattaaatattttcggtgttatttttaccctttatttttttcaccctcctcgggtaatgtct

SEQ ID NO: 101082 - DNA, 735 bp, Oryza sativa
  unsure (1)..(735): unsure at all n locations
cgcgcgnctttgattgatcgaatcgnnnnnnnnnnnnnnnnnnnnnnnnnnnnnnnnnnnnnnnnnnnnnnnnnnnnnnnnnnnnntatagcccttctggaataaaaaatatgcattactgctttatgagaccattaatgaagacaaacgttatttcgggactgtaaccacagatggaagagacagctccgacggtcccatgtgcgtgatttagaagaaatggtagcaccaaactggtctcctgaggcgcggaaccttaatggtattaacatgccacaagattttgcgacgctaaagaaaagactgcaaaagatgcatccctcgcataggtgttggagacgcgagcgctcacgggttcgtatatagccgatctactgtggagccatgtccaggaacgacgcgtttgacaccatgtgcagaagtcaacgctcctgctgaggtgccggcttgttacagaggtccgtatgtaggacctcaaacagtgatgtgcctaattagtgaacagattgcctgttggaccacctatgactagcatcactgttgagctgcatagttaaggaccttgattggacaactctgcaagcttagcgaactgagacgggctataggggctcatntcagactatcgacactattgaccagtgaggcggttatcgagccagtgctcgccagctatcatggtgatgatagtgcgcgtgtgcgacagacgcgcatgcgacgcaattgccaccagga

SEQ ID NO: 101083 - DNA, 1001 bp, Oryza sativa
  unsure (1)..(1001): unsure at all n locations
agggaagacggggnnnattgatagacatcatgctatgccagtccacgtgacnnnnnnnnnnnnnnnnnnnnnnnnnnnnatgggcacccagcatgaggacgcctagctatttaggggacacttaaaaaaaaactttgggacaggcgcattttccggatttgcaagcacaacagggatattaaggcgtcggaggagactgggaaacgcctcaaggaagagttgatttatcacacttacaggtctgacaatcacttagacaacacgttttcaatggagcatatggctggtgatttaaaatgtcgactcaacaatcttttgaaaaatcgagatttaacttattcggaatccttctactacatagacgctgaagattcttggtttagacttgtgttgatgtattacaaggagtaagcttagctgagaacctagatcatcacctaataatgaggtggtgatgaaacttgaacatattcaccattgacctaattcctgtgtggcgaattataaagcgtagaaagaaacaaaaacatttacatttcaattaaaagaatctgatgttagataaaccatgctggcacgccaatgattctgatcaattgtgatctgtagatcaaagataagatatacaaggggttgcatgaaatttaaatgactttgttattggctgacatgcttgcaatacagaaatagagtacattgagcactggcgtcaattatatgtactcatatgacgtgtgaacaacaatagtctttatacatgcttaagattgatcagaaaggtgaatacagngtagtgtgcatctatctgtgtagctgtgacggaagtccttcactggccaactgatgatcgcatggaaatacggcctctttttattattatgggagttttgtttcttcctccacttgccaattgtggatcaggaaatgtgtcgngcaaaatttgctgnggaatgattatccacttcgtatgaaggtcggttttctttgtttatgtgaagaaa

SEQ ID NO: 101084 - DNA, 679 bp, Oryza sativa
  unsure (1)..(679): unsure at all n locations
actgccccccntttgaggtagaacaacatctagcnnnnnnnnnnnnnnnnnnnnnnnnnnnnnnnnnnnnnnnnnnnnnnnnnnnnnncatctacctctctaatgcccctcacagggtcttgagcctgccgctttgaaccattcctgtcccaaattactggagattgcttcctcttcttactcggggacatcttcgcctcctccttgctgactcgcgtgacaccattctccctcggctccccggtcttcattgggcgctcaccggacctctctgagccactcccacctgagacctcgccgggctccctgtcctccgtcctcccttccgatggacgcctcctcggtggtggacgcggcgaatcccggcggtggctgtacccattcgacagctcccggccaccgctgcgcccgccgtcacggcggcgttccgagtcgcggtggcggctcgggtggcggtggtggtagagctccttgctcctcctagagacccccacgtagtgctcccgctccctcgccacctcgtagcccctgtaccccccgtggctccccgaagccatgaatcgctcccctcacaaaccctagcaaccgacgttcgattccccaaaatcccataagtaatttctcaccaacttaaaaatcttgggcccgaaaccaaccccttttgagacaaaaatagccg

SEQ ID NO: 101085 - DNA, 598 bp, Oryza sativa
  unsure (1)..(598): unsure at all n locations
ggttattagctcggtgggcntgagccatcggttcggtctttgctggtgaatcgagagcatagcggtcgttgtgtgatactcgcttcagtggccaaagcaagcaaccttgaccgatgtatcactgcgccgtcacctcaaaattgcctagatatcggatcggtctgttgattttctgttcggtttagcactacgtgagaacgagatatttatgtgagcattcagtatgctcccgatatgtgcgggataaaaatattacgatgatttttttcctcgcaaaaatcaaaatgggtcgcggtatgtggatccgctagcagactcgatctctgctagttgcgaacggatggtggatgaaactaggagtatgtacacctgggtgtatagaagcattttcatatatatatatatatatatataaagaatcctcgtcagatttccattgtcgtaacggtttcgactcagccgccgttcgctcgctcggactgaatatgaaaattgaatcgagctatgtgaagacgaggattcttttcttgctttatgtggatttttttttatttttaattttttttattaaaagttttacaaaaataattttccattt

SEQ ID NO: 101086 - DNA, 742 bp, Oryza sativa
  unsure (1)..(742): unsure at all n locations
cgcgctcnattagatgactactgctnnnnnnnnnnnnnnnnnnnnnnnnnnnnnnnnnnnnnnnnnnnnnnnnnnnnnntatatatcaaaaacttagtatgtctactgaccaaacaaaaaaacagtatatactcattcagtacggacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcggcatgtatatatatatatatgtgtgtatatatatatatatgtgtatatatatgtgtggatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatatatatacatatacatatatatatatatatatatatacacatatatatatatatagatatatacatatacatatatatatatatatatatatatataggtgtgtatatacgggtactattactgtcaattaactctcagggatttccggctctttttggtcgagactttg

SEQ ID NO: 101087 - DNA, 667 bp, Oryza sativa
  unsure (1)..(667): unsure at all n locations
gtcaaatcacaggtactgctattagaccctacttaccaaacagtagctgtacttttcctaccactatggattgcctgaaagcaactcagttaatccaagctatacatcactgacttcttttagcaattaaatacatggtgacatgttaatacagccacttgaaatgtttcattaatccgtgttttacagattactgagtaatggtcattatggtttttaaccacatcagtgtgatcattcaactaagctagctaagtttgtcaatttagggagcatttcttttggaagatacaccatttgtctttaaaaaaatcaaatcattaccatgaatctgaattgggacggaggaaatatctaacaatggatttttttttttaaaaaaaggattatgaaacccggacagcatggtttatcaaacatcagattcttttgaattgaaatggaaatgattttgtttctttcctagctttataatttgcaagacaggaatgaggtgaatggtgaatatgtccaagtttcatcaccaccaaattattaggtgaagatctaggttctcagctaagcctactccttgaaatacatcaacacaagtctaaaacaagaatctgcaannnnnnnnnnnnnnnnnnnnnnnnnnnnnnnnnnnnnnnnnnnnnggagcaaatcg

SEQ ID NO: 101088 - DNA, 914 bp, Oryza sativa
  unsure (1)..(914): unsure at all n locations
actgacgccctaaaggaaatagcgacnatgnaantaggcaacantgngcaanaancccgccnnntttnnnnnatcgtgnnaaacaaanncccnccccncnnnnnnnccnnnnnnctctcacatataaatactctctaccaacacaccttatttctttttcctttttttcacccccaaccaaaagggggggtaagggaaaatatttgagagcgaaaccggaccacccaagaagtaaaccaaacacaaactatagaaaggctacaaaccaaacaagcccatactatctttcttaattgcacacggggaagagcctcccagtcaccacgtctcttcctctctcttctctagtcgtcctgtcgaggagcatagccgacaggggaggagggccgcgcccggtgggcgcgccggcgcccgggggggggggggggtggggtatncaatctttatttatagattgtcaacttctaactatatatgtaagtatattttttttacaaaacggctatttaaatctcattatataattttacctaaaatataaaatttgaaatttataaattttattttaggattttttatttgccgtagctttattttatattaacttatataaaacgagtaaatgttactgatgcactatttctatttcttaaacaagtgatacaaatattaaatgttaattattaaatatttctaccggtttatttattttttatttgtaacacaatatatatttatgaaattgtcacgtattcctttacaataattcattacaaatttataaattcattattgttaaatactaacattcattttaatttggataatatttattgtttttgacaatagcatatttttaaaaaaatattttttaccattattttttatttttatgtgtgtaaaaattttaaaaa

SEQ ID NO: 101089 - DNA, 1662 bp, Oryza sativa
  unsure (1)..(1662): unsure at all n locations
acgcgttgaangtcattctcctctctctgcaagnagntcatcaaaatttgaatgttgttactgcacgtaagacatagcgttactgcacgttggccgtcgcgttactgcaccattccgcgagatgaaagctgagaagagggggtacgcctaatgggcgatcgatcgtcatggggatggggtagcgatcagattcgctccccacctcccccctccctccctccacctggtttccttttttggcaccgcattactttcctattttagtaaatttatgcacctaaaatttatacacctcaagtttacacatctagagtttagagaacaaaagtttataagtcaaaagtttatatatccgattcaaatttgaatttgaattcaaatattttttatatatagtatttctatacatctaaagtttatatacctaaagtttgaatttgaattatattcgattcaaatttgaatttgaattcaaatattttctatatatagtatttctatacatttaaagtttatacacctaaagtttatagaccaaaagtttatatacccgtttcaaatttgaatttgaattatatccgattcaaatttgaatttgaattcaaatattttatatatatagtatttctatacatctaaagtttatacacctaaagtttatagacccaaagtttataagttaaaagtttacatacccgattcaaatttgaatttgaattcaaattttttataaatagtatttctatacctaaatttttctaactttttgttttttttttaaaaaaaattctggagatgtgtaaacttaaggtgtacaaactttaggtgcataaatttactaaaataggaaagtaatacggtgccaaaaaaggaaaccaggtggagggagggaatcagtatctgatcgcccctagcgatccctagcgagcgatcgcaaggtagcattctaggagaataggtaggtggtggggggagttggtaggcgggttgaccgggctttgaccgacgtggaggtgctttgactgatctttgactaaggtgggaggtgggttttgagcccttagaagggaggggaggtaggtttggcccttgggagggagggggtatagaatatatatatatggttagcatgtgaggctttaaccaatatatttttgtttccattcctggtctaccataattttactacgacattactgtcaaaagtgcagtaacgtcctatgtgttctgcagtaacgtcacgtgttactatacttttacaacaatgttactactggagtatagtaacatgttatgagtttcggtagtgaaagatattagaattgataatcatattagatgacttggttagagaatgtgctttgaatatgaggtcatgggttcaagtattgaatttgacaatttattttttatttttctataaaagagaaaaaatgtttcagggagaaaaaaaacagaaaaaagaaagagagagagattgggaggagggaggggaagcgacgggagggggaacaggaggagggagggagggatacggatgagaaatatatatatatatatatgtatatatatatatgtatatatatatatatatattagctttattaacacccccccttagaattatgatgctgtactgttcgtctgtcatccattgcccgc

SEQ ID NO: 101090 - DNA, 542 bp, Oryza sativa
  unsure (1)..(542): unsure at all n locations
tattatgtattttttaaggacaaagagaagtatttttagtacttgtattttgcacaagattgagatttaaaaatttacgtgtacacaagcagtggtactgtagtagtacctttactccatatatgttctctgctactgaaattttcatcatgatgttactgcaaaaagtgcagtaatgacctataaatttcgcagtaacgtatcgtgttactgcacttctgcaataatgttactaccgaataatagtaacaaggtgtggttcctacagtaacataacgggtttgtgttcataaaatttgaacagatatatagataaagcaaacaatgatcttatatcacattgtgttatagggtgaattggttaggagagtttgttatgaagcatgagatcatgtgttcttgtcttggattcaccaatttatttttcttttttcaaaaaaaaagagaaaagaataggaggaaaaataacaaaagtgagggagaaatcgacagagagaagnnnnnnnnnnnnnnnnnnnnnnnnnnnnnnntaccaaatctcg

SEQ ID NO: 101091 - DNA, 603 bp, Oryza sativa
gcttgatcttccttaattcatcaccagcaaaatactttctgaaggcatttgtttctcatttctgaaatttctgcatccatgtgaggagcttcacgggttggaacctcagccaaccagctttcgcagtagtacctacattttataaaaacaattaataggctaacaacgactacaaattatggaaacaaacatttaaaagtagaagcagaacattacttggggttcagtgagtgtgccaagcaatgcaggggggtattactttttgcccatcgagagtacaagatctcttgcacatgaaagaaaaaggaggaatgctcatttagttctttcccttcatgacgataaactatttttttcaccttatctatcattgaatcccacatctcataaaccaaatggaggcaaggtttgtcggtgtcagctgcacgaatcatggaatagataggatcagtgaaatctaggatatactgcaccttatcccaccacacatcatttagaaccttctctttgacttgctgtgcttgaacttgattgtcttccctaataagaattccatttttcactcactaccatcaagattagagattctttgacagcacggaa

SEQ ID NO: 101092 - DNA, 2258 bp, Oryza sativa
ctggaggaggaagaagacatatatataggggtgggactttagtcccagttggtgttaccaaccggggataatgattcccgggatctttagtcccggttcataacaccaaccgggactaaagttacgatctttagtctcccctggtgttaccaatcgggactaaagatcccgggggggcctgacaggccatgacagcatttgaaccgggactaaagatgatatttacaaccgggactaaagatcaaatatggtccgttaccctttttaaccgggactaaagatcatctttagccccggtttttattgtaaccgggactattgtggaattcggccgaccgatgaaagatggtttctccaccagtgaatgtacttcatcggtttcataattcttaatgttttggacaagatttagacaagatttagggcaaacttttataactttgactagcaactttaaaaacatttagtttaagtacactagaagaacatatatatagatttgttctcataaaatattataacaaaagtaaaatatagttaaatatattttatgaaaccggaggaagtaccttgttcacattactccatctacatgaaataccaaaacctgcactccatttccagattgcgggccttgttcttgttctgcctccttttgatagaatctattcgatccataccactgagtttattcgggtttcaacgatttaccatttacatataccgacgactttattaattattctacaatatgccattgggttgggtcttcttttcaaaaatacccaaaatacccttagagacatacaagattaataattgatttatctcattaaaagtttcaaaaaaatatgaaaatttttatgtggcctccttatacagcatgaaattttgtatataagcttcaaattttttttggtatatttagtttttagaaaaaaatattgttatgtggcatatatagaatttgcttatacaagagataatagcgcaaaaatatcttatgtagtgtataaaagatgatttatattaaatacaacaataaaaaattattttatatagtatataacagataagtaatttttttaaaaaaatagaaatgtaaaatttgatacttctatacaaatttttatgtcgtgtaaggaggccacataaaagtttttatattttttagaacttctaatgagataaatcaattgttaatcttgtatgtccataagggtattttggttatttttgaaaagaagttccaacccaatgacatattgtataacaattgataaagtcgctagtatatattatagatagatataatgttaatggcaaattgttaaactcgaagaaactcaatgatatagaatagattctctctttctttttcggtaagcaacattttcatgcatatcattactaccgtaaaggctagtcctttcttctcctccaacgtgcacttttccaccatgcgaaaaaaaacatactggtgactatactgccaagggactaaatttgatacggtactgtgagttggggtgtgttatattattttagtttagggatgaattccagactcgctgacaaattgaggaaccacaagtgaacttagtccttaaggaaaaggcctggacatatcacggcccgaaaagagagctggccggcatatcgattcgtttttgcttgggccgggctacagaatgcccataccgccaacagcccagcgtaactgggctccgagtcggcgactcctcgctcctagtcgatccccccctctcggcctatcccctcgcctcgactcaccgcctcctcgcgacttcgccccgccccgccgccttgcaccgagctcacacaacccgcggcgacgcggcgtcgccgccgctgcttccggcgcatcctcgccgccggtgagcaacccgcacgccgcgcctcctcctactcatccctctgtacccttcgccttaatcctacctttctcttctagatcccggaagcttttctccccttgccctaaccctagtgctaattcccagttcgttcccccaaatctggggtttggctcgagccgccatgtcgcacgtgaggtccgcctccgataggcaccgggacaaggagaaggagaaggagaggagggagacgcaccggagggaggagaaggatcaccacggcagcgggaggagggacagggacagagacagggagagttatagagagaaggataaagatgacaggagggagaaggagaaggagaaggagaaggagaggga

SEQ ID NO: 101093 - DNA, 731 bp, Oryza sativa
ctgcagcccggatccgacttgtattatttaaagttatttctgctgactccttcatataccttatgataaaccaccggggaggatgatttgcaccttttttgacgttgagggaagcgttatacccgttttataattgaggatatgatttgatcaacggctagatatgagggtaggctaatatacttctctagcatagacctagcatgggctaaacttcacataaataatttaattcttagtagatatcacgataatggaaacaatactgtaaatgggcctaaattctgtacacactagtacacactaccttcccaacaggctaggacaataacacggacaaggccgacacatggcattagataggtgatccaagcatctattccactggctgataacggttcaatatatctgtacagagaattgtttgccaatccaaaccatgcctactgcatgagcatcttagtaaaaagaaattatcatgcacgctggatttatgtgacagccgcatatgaaccagcatgtttctcctttccgtgattatagcatctatctatgatattttatcatatactaaaagtgcattgtacatcgtataaacgctcatataccggtatgtggctcttttataaacactgctagacactcgcatgacactatcaaatctcaccatggatgttcatgcaaattggtggacccattattttacaccactaaattagatttatcattaa

SEQ ID NO: 101094 - DNA, 574 bp, Oryza sativa
ttctatatactaacttttgcacaatatttgatcgttcatattattcaaaaatttaatatagatacttaatagtataagttaagattatattttatttgatgataaaacaaatcacagtaaaataaataatatttatatttttaataagacgaattgtcaaacattatatgtgaaaatcaacgacgtcgtccatttaaaaatggaggtagtatatctaaatcatttttccacgtcgtctatgtaacattatatgtacataaaaaaaaactttgcactgccaaggccaaaatgcctattttctttaaaaaataatgttaagggtacggtattctaattttatcaattaaagaatttaaaaaaaaaatcctcgattggtagatcgatcgagttggacgcaggtgatagatgcctgttctgaactttttttccgagggcggtgatacgtatcttccgatcgctcctttgggagtttatttatttggtttttgtccaatcgctttgtactttcttgatcctttggatgcatgcttgtgctttgtgctaactatccggccgggcctcgacagaaatggct

SEQ ID NO: 101095 - DNA, 639 bp, Oryza sativa
  unsure (1)..(639): unsure at all n locations
ttaagttattaaaatgttgcaaggggtgttatttggatgtttcactaaatcatttataacgttgcacgtgttgttctcgatgtttcagcatgtattctgtaatgtttcaacaactacaacttaatgtttcatatataatataaaaatatttcaattagtaatataattatgttatttttgttcatcctaataatgtgagatctctttgttaagatttaattgcaacaaatccaacggtgcaattggatcacacatcaaataagtattttgtgaaaaaaatgatttaaaatttgctattaagggaatatgaggagagagaaaggggtgcgnnnnnnnnnnnnnnnnnnnnnacgtggaagagataaatagttccatgcctgtgaaggttcccggagagaaatagttacatacatgcttactgacggcgcctgtttttttttaataaaaaacaaatgcttgatatgtagtcttgtcaagggtgaaaggctaaatggtaagaaagaaaagaaggaaggaaacaatccaaaaagggagaaaagaaaaaaaaagacaaaagccataaaattcgcaaaaagccaccaccttccccttgtttgagcagatcaacacaccacatgccaatacgtgaccatgtcccct

SEQ ID NO: 101096 - DNA, 615 bp, Oryza sativa
ttttgcaccaatttgagaaaacaatatttcaaccatgagtcattcccactttctatgcaaaagcagaagcaaactgcccagtgacttgcttgggtttgctctattctatgctggtttagcctcttccagaagaatttttttttactattttaaatttttattatttcaccagccgcggttggtatggctgttttttcttgcctctagaaagtttttttttttgccactagtgtggccaacgtggcaaaacattactatcacgccaatcagactggtgtggcaaaataacattactatcacgccaatcagactggtgtggcaaaataacgttgacacgttagatagagcggcatggtaacattgtttcaccgtgctaacatggctaaaaggtatagatttagaaaggtttacttttaaaattaaaaattaaaaagatttaaataataataataattctacaaccagctcctccacagaccaggagacgacgatggcctaacctgtcctgcaatttgctgttcggtgaacttccactggaagagttggtgtcctgactaatctaacgacagttgatcttcccatgaacagcttcaatggcacaactccagaaagcat

SEQ ID NO: 101097 - DNA, 670 bp, Oryza sativa
gctctcaactagtggatcccccttcgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagttgcattttagttggataattacgaccatgaagcatggccagatgtctcgagcacgcagctcatcaagatagtagaatgtctaatactgcaattatcccatcaactgagctagtggtaattaagcatggctaagcatatagttctagctaggtcacataagtaacatgagctagtcgattcattacccaaagttgacaaagaacagatatcaagtaaacatggcacaagcgagcagataggtaataccctgaccccatgtaattagcaaaatatgcatatttatttgcaaacagtaaaacatttgtaaattgggatcaacatgctcaaggggaatgtgtgacttgccttgcttcttcacttggatcttctgaactcttatccttgcgaacgcaatcttccgaaacggcggaaattacacgctggcacgcaaaacgaggaaaaact

SEQ ID NO: 101098 - DNA, 817 bp, Oryza sativa
atcaaatgtggtagatactgttaaacatattttccccttccggtatggatctttttaaatcctaactgtgtgcacttgctaacttgtactttgatgagtgacctgtatcgatagtccacataagaagttaaataggccatgatatggtgattgacatggtctaactaactttgctagcatttcttgtcagctagtagtgatttgttattgctatctggttgagttgcagaatctctttgagctctattttgctcagccatcattgccatatatagaaaacacaaagaagtaatactaaatttatgctgctgcattgccaaaatttcatgaaggcactgctgagttacatgccctgaccaatgtgcccaaaagatttaatctgtcagggtaaggcaggctgtctactcatatttcaatcaccactcaagtctaagtcccattcaatcctatgatgtgggttatatgtggtgcggtgccactgggacacaatgcaaactggtctctggagtgcattaacacaataattgatggaggcacaacatagcacctgaattttatactcacaacacaacatacatctattttttttcaaacatcaaaatacatctattgagcctaggcagatcttgaatacttgaaataagggtctctactcatgcttttataccatattgagtttcatgcgcagaccaattcatgggaaggctcaagttgtttaggaaaggtcgttaatgggtccataccaagttgaacttttcttgggtgtttctagtattagttatatggctgttgatgagagtctatgctgatgagacaa

SEQ ID NO: 101099 - DNA, 604 bp, Oryza sativa
taagcacaaataaagtttgacattacctaaacaaacagaaaaggaaatttgatcgtgtcatgcatagaggaagtatggcttaacatagcaattgatgataatcgagaaaaataagtcacaactaacctaattagataaaaccatgtataagaaaatattactgcagaaatgttgtatgataatgatagaaacatagtacaaaatgaatttatttcgtagctaaacattgtaatcttatatgttactttgtatagtttgcatctttagttaatcatccaaaaaaagctataaacacaattaagatgatgtgatctgaaaatttagatcaaatatagatccaatatcataagcaaaaattaaggtggtaaggctttatgaaagaagaaacaaaagagagagagaactttccaccagattaatcatcgaggtgctagaaattgagagatgagaaaaataacattagttatacttagtgatggttaagtatataattatatatatgattgtagcagacataataaattgccacgaacataaaaaattctaattatgtaacacaaatttcgaagtggaaaatggtaggcactatttcatgcccattgca

SEQ ID NO: 101100 - DNA, 593 bp, Oryza sativa
caccccctccactttacaatcgcgccatggcacagcctcatggaggtcattgaagctataatcactacactagatcaggtcagcactgacgggctcaaaccctcaactttgacgggttcagctcccggtcagagattagtggtcactgatgacttgagtcacctgtgacggggtgaacacccatcagaagtaagagccacctcaaacggcccccaactaaaacccgtcacaggtgagagtcacctctgactggtcccaaccaaaacccgtcacaggtgagagtcacctcaaacggcccaactaattgggaccgtcactggtgtgataaaaggggggcaaaaaaaagagaaacaccgtcctcctaggttaccatcacattcatttcaaccgattgcatttggcattcacaaatcaaaaaaatcgtcacaattccatcgcagttgtcccaatcacaaaacaaaatcacaagaatctcaatcaccataggactcagaatcatcaatcacagtagcaacaattggaacaatatgaacaacacaagacaaaatacatgggtgaaagaggacttgctggcaatggatctgagctcgtac

SEQ ID NO: 101101 - DNA, 637 bp, Oryza sativa
tagtcgatcgacaaaggtttggaaacattgaacgacgtacgtaatgagctgatgaagtaaaagcccgggcggaatcgggagtatctcttctagatgatcatatttatcatttattatactactaagtggcgatattaataccatgtagaaataaattaaaaaaacaaaatttatatatagcccaaaacaacaacgagaacaatattcttataagaaaacggcgctcgatcaatcaagaatttccgtggtcatttttaccccaaaaaaattatatataacccaaaacaacgagatcagtatccttataagaaaacggcgctagatcaattaagaatttttgtgatcattttcaccccggctgatgggctgatggcagccagaggctttggtccacaataatcgaccatgcaatgcatgccttaaatgctgcaggtgatacgtacaccttagttatataacactacttcgatgatgctgacggctactaatcatccactatcacggctaggctttaattaatcattgtaacgaaatggccgaacatctccatacgtcacgtcacgtctggtgatgatcgatcgatctcatttatcagttcattcacacgtcattatccatgcattcgactactcgagag

SEQ ID NO: 101102 - DNA, 685 bp, Oryza sativa
ttagacttattcattaccataatttttataatgcttggtgggtaatctttagagttttaaattcggatgcctgtccagtgtgttcattcgtgaacctttttagagtgtaaactactcggactcttttcattatggctaaaaagcggtcggctagcatgcctatttaggcgctgtgtgtgcttttgtcatatgatgcacgatcgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcacgaaaagtttgaagcactcggattattatttttgagaaggctacgacgattgactgcaaaggtctcgggggctactgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaagggcagatgttgattttctctaa

SEQ ID NO: 101103 - DNA, 590 bp, Oryza sativa
ttaaaatactctagataataattgctagtgggtgatgatatggcacacttgcatgtaatttaaaatgctctagataataattgctagtaggtgatgatgtgatatacttacatattaagtctttaaaaattattggacatcaactttacagtaagataagatccggggttagaaaagagggagatatgatagatctattccttcattgtcccttgctcacaacatattcttgggccttaagtgggccaaactccattaatctttgcacagccggccggttcacggttcgttggttcacaaagtaggcaacaaatcatcattgattaacgatcttaaggctgagttctttgtgttggaaactcaccttccatgtacgtaaaacttaacgatttattagcattagcgtatgattaattaaatactccctccatctatttttggtagacatattttcaaatctaaaaaaattatttttgattggcatatttcaatccaacaacctatcctcttaaagattttttcggatttaatgtgtgactccattttaccacaaaagattggttacatgggcatcgagaaatataaatatt

SEQ ID NO: 101104 - DNA, 800 bp, Oryza sativa
ttgattaaaaatttagacaagtacttaaaatggttacagaatttgattttttagatgaatggtatacgtacgcaggatgcctgctggctctagtaactcgttcgtatacgtggatatgttcagatatgaactttcggccgcctacagcggcgcgcgatcgtacgttgccgaccatcacatcatcctctcatctcgattgagttagatgctgtgatattttacgtctggttgctagctaaagtagtggcaaacatatgcatgtcccgcacatgcgcaaatcgcaattgattcgcagacgattgcatcatgtaacacgcagaaagctttgggtttgaactgatgaaggtatgttcacaagctcagtgttgggcaggcattctgttttttctctctcgagaaatcattcctctaattgagtacgagagatttagtaaaatatgcttcgattatttaatatcctgacttagtattttttttaaaagatacataggaagacacacaaactcacttcatactcacgccacaccacatacacacgtgcacgcgttcaacacatgattagactagagacttgaaggacctaaagccttcggtgtgcgggaaacgcacattacaacagaacacacgtaagtgtgtatcctctctagccgttcgttcaaaattattgggttcatgcggactattcaaaattttgattctatcataaatttttaaaacaattacaaaatcataatcataagacaagtactattttcaaaaatgaattcaacatcatccataacactcatcttcttttctca

SEQ ID NO: 101105 - DNA, 560 bp, Oryza sativa
tcgtcgaggatttcttgatttcaatcggacttttggttatggggggcaagggaagaagaagaattggctaaggaggaggggctagatggcaatggcgtggccgtgtgcggagaaggagctccggatggggagaggcgagccgaggcgaggggtttgggaatggcggagaggcgcgattttgcggttttggatgacgcggctcgaggtggaagacgaggggtcgtttggtaaataagggataagtagggtggcaaatggaaattatttgcaatcttcacgttttcagcgtattgctggattgcggcgatggtgaaagttattactaaactgcccccgttagctccattttgaatcgtttgccatttattgcaaggagggatattttggtcattagtaaaaaaagcattcccttccatatccatcaagttcgttagtgcatcattattatattgcagtcgataataatgcaatatgtatttttcagggcttattttttcctaaatagaaagcatgttttctctgatatactccgtagttagaacatcaagttaatggatata

SEQ ID NO: 101106 - DNA, 678 bp, Oryza sativa
ccccagtcacgccttcgccccaagcaagtcaggcctcgccactgctatccgagccccttgattggggaacggatgccgaggaggatgaggatgacgtcattgctctggagctacaccaacattcagcggagacattcaatccgcagaccgccaaagcacgcaaagcagcttctccatctccggcgtccaaggctttccatcaggaaatcaatgcccgaagccaggaagaggagctcgacattactgcagagagaggagagggacggagcgccattacgccccctcccgaaaaggcacaagaggaagatgcagagaagaaggccaaaggaaaagcaacattaaagtcgataatcgtagccccggcaagagctacaagcaagtctcaaatcgaggcagaagagtgcggcggcctcgacattcagaatctggaattatagaacaaggagaaaacggttatttaggttatgtaaatagagtagtatggcaagattttcttatgaaaaagtactcacacttctgataagggttgatgggtgttaaggctgatatcttaaagtttgggacttttgatatatagaacaacactcagctgagattttgataacaacactcagttgagaggatcgtaggatagataactcctcttttgtaaagtgtctgtagaataccgctacagag

SEQ ID NO: 101107 - DNA, 592 bp, Oryza sativa
gtaaggcgcgcttctcgtcggtgccggtgtctaagtgcgcagaagtgcgcctcatgaagcagatgggacttctcaccccgggtgaaccggtcggggatgcggcggtggaggcttatgcaaagtccttcgacacaccgcttccgtcgcatgtcattgccggtctgcgggtgctcacacgcctggatgaagtgcacgacatcccggtgccaggagaggaaggaaccaccacaacgacggtggtctgaggcacgcgctgccgcgccatgagagaagtcgtcagctgtcatgattgtccgcatcagtgttagagctgcagaaatggtcttccatcatcatctgcatgtatcctttacatttctctgcggtcttaagctgctgctcgctgtatggtcgatgcgactagcgctcccatgcagcaacggccttaagccggagctccttagtcggttgatacgaatagcgctcccggtagacaccggccttcagctggttagtagcagagtagacaggctagaagatagtgaaattgcttctacatggtcatgtttggtttgtagttgtaggtcatggaagaaaatatatagccctctat

SEQ ID NO: 101108 - DNA, 673 bp, Oryza sativa
tgaggagattgggtcgacgcctgttgttgttcgggtcagccatgtgcaactagcctagagtaggagaaaggagtaaattgctagctgaagaggaaaaaaaatcaacagtaaagaaagagtgcacttaaaacaaatcatattagctaatggagaggtggctagtccagaaaagtattcgacgatcgattgtcatattagcaaaacacacacacatatcgaacatattagttcaacagaaagattagcaactatcagacacacacatcgaacctattgttctcaacaacagaggcagaggcacatcgaacctattgttctcgcagtagcaactagtaagggtcgatgcgggagcctctgtgctacttaatacatacaggtgagtcgacccatctgaaccccttggcaggtcccaaagtgtcttcttcttcttcttttttaagaaacctatttttatttttaatttcatatcccatattttgtgtctctattacatttacaagttttttacaagaaaaaaggactgaatggaatcaattgatcttaattcgggtatttgtgaatcgagaacgagaaatgaaaatgactagtgaatcactaaatgagtgttctaaaaataaaaaaaaaaacactgaatgagatactagtatagaaattttgacaccctgggggttat

SEQ ID NO: 101109 - DNA, 677 bp, Oryza sativa
taaggagagagtagtagtcaattaaagagtaaagagaatagtctagctctctgctaaataaggcttacaaaaatccaaaggtaggtcattgactggtactttacttgccactgtggtctaagatatcgcaaaacttaatttaaagggtaattcttggctagtaagtattcttccaagacctgaaaagtgaaaccgcttgttagagcgcaatatgcttgaataagtatatatgcagataataatttagtaagaactttacttaaacagacaaaatgaggcatctactcaactgtggcatcctacccatcgtcatgcatgcccaccatctccatcctcattgtcctcaagaagctgcagctaataattaaaatgaaaaaactttaacagtatgagatagaaagcatgtgcatattgttagtcatagataatacttacgttttccaatgcattggtaagaaactctctgacatcctccaaacaaattgcatacccacatttagcatccaccatcactgcgtgaaataccgccatacattgaccatcaccatttataaccggccctccagaaaacccgttggcacagtcaaattcatgaaactccgtaagtttcatagtgtaacctttggtattgcaacttgtgagaacatcgtaaggtctctctagatagcttacggaac

SEQ ID NO: 101110 - DNA, 587 bp, Oryza sativa
actatagggcgaattcgagctcggtaccccactagagtcttcttaaacataggtcgttgaatgactgtttatagttgcgaatgtgctgatactttggttcaatttagcttctgggtacatggttgtcgtgattttacaatgggaagttggcgtgtgaactgatgatggtgtcttttgattatgttcgtgtttgcaatgtggtattccagtcctggtaaaatgagccatggtcttcaggccccatttttaattacaacaattttgtagtaggaactatattgcttaccgggcaaagctacagagcgattcttgtggtacgaatttttgtttgcagagaagtttcataaagatcgcctagtcgtgttacattgaacatgtggggatcgtcaaagccgccccgtgctagtccactcaacatattgtacgcactggtttactgactggttatgtgcatacgctacgttatctggttgaatttagggagtttatcagttgcctcatgcttagtagcttgcatctcacatcagtttcgtgtgcaaatccttttgtttgttgaccaaaccagaatacggccgggcctgagaact

SEQ ID NO: 101111 - DNA, 1267 bp, Oryza sativa
ctatagggcgaattcgagctcggtacccgttcattacgtatgacttattttttttatatttgcataaaaattttaaataaaacgaatggtcaaacatttgtaaaaaacgaacggtgtcgtatattaaaaaaaagaggtagtaacactaaagatgattatttggttgttacagttacaagcacaatgcttacgaaagacatcgactgatatgcttctttcttctgcagaacattctaacaatcatcacttaaataatatactatactgacgattttgcttatagagaagaatcagtcacaagatgattgggtttcaattttgtttcactggatcatcaatcagctgggattagcagaaaagaaacttgcagcgagtttacacgtttgtttcttgctaagaattgaagatcacgtacgtatcatctactccagctagcttgtgtagacgtcaactccaaagagagaggattagagattagagaagctatctagtagctaattaacatggcttacttgtcatcattagcattttttttcttccatgcaaattaaggcttgccattgccaacttcagatggacagacgacagccatatcttcagattaattacacgtcgttttgctgcatatgcacgtattgcatgccgtggatctaattttcagcgaacatttctacatttgtttctttcttgcaaaaaatggacatgacgataggatattatatgcagtaaactgaaggattagagggccacatgttgctgctgatattatgttcatcagtcatcgtctctcattgatatctttcagcagtttctgaagactgaagttgctgctcaaggcaagtcttggtcttgcttaattggaacgtgaaatatcttgaattgttgtgggtctatgcatctttctatcattaaattttgtgtcaaaaatctagcgagaatgttctacatcacgctagttaagaagctagctacccctctatcgtttgcttgttttgtcagacaatagccaaaatttaaattatgaaacttaattttagatttgatttttaggttttttttcatagtttatttttcagtattggctttagttttatgcacaaattattttttgttgtatcatttattttttttcaatataagccgtagagcgaacataatgttgtgagtaatatattgacgaccaaagggagtaaatatttatatagtggcaaatataccttttgtctccttcgactctatagggtgtcgatctcactgtcgtgcatct

SEQ ID NO: 101112 - DNA, 640 bp, Oryza sativa
tgcaagaaccaaagaggaatctgaggttccgatttgaaaatttctggattagagtgtaaggtttcctaggcgtcgtaacccaggcttggaacgagcctatccaggaaggtcaccccacttggcggataagtcaaaagctcagaaacaccgaagcaaccttgaggaaatggagcaagcaacatgtaccaaaacaaaataaagttaaatacctgaggcaaggaaaatagaatatgcatttaagtgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaattgtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcagtgagaagtggccaaacggcaacaatcggaggacttctttttattgaaaaatcgtatgacttctgg

SEQ ID NO: 101113 - DNA, 531 bp, Oryza sativa
tttgatcatcttttttagccaaagttttataatagactagaaataagcatatattttcacttcacaccatatatgcttaccatctgtgatatatgacattggttagtttaaaatagagtaaattttactttaataaatattatagttagattagtatatgacattggttaattcaaaacataagtattttaaagttatttaagtaaatactaaaggttagagtaaaaagatttttttagtcaccacagtaggctttttttgtaaaaaaaaactcactatggtggttaaattttaaattgtttatattccctatcataatatgtattcagtgccttagaaccagtattccagaaacacttatattgtagtataaattttgaataatataaaaatacttatatttcaaaatggagaaaatagatttgcattttctgtcactgttgatcatcagttggtcaccattgacgccatgatcgacacgcccggtcttcacgtagctgagacatgactgcaacaaccttaattaagtat

SEQ ID NO: 101114 - DNA, 535 bp, Oryza sativa
  unsure (1)..(535): unsure at all n locations
acaaaaggcgcaggnctgtggcgccggtaccggttgcccccccggcgctcaggttgacgagctccataggctctcgctctctcatcatttctctccatgccaaatacctaacagaagttggtttaagagccgttctacaaatcctgtaaaaaagttatgatggtgattaatggtaaataacactcccaccacaactctatactttttttttaaaaaaaaagagagaataatatataacacataaattagagggtccacatgtcaaccacctcatcaccaactcctacattttataaaaaagaaaaaagaactgtgaggccaatatataaatatatatatatatatatatatatattagtaacaactatattatatataaattaagcgtagaaaatgagggtaataataggttaatttttatttttgtaaattgaaataccgttgtaccgcatggacaataataagttttctagttaattagatggagtaattaatataatgttgttggcattcgggcagcaagccgattgcgccg

SEQ ID NO: 101115 - DNA, 1102 bp, Oryza sativa
tgcaacaagttatttgtttgtttaactttatatactccaatcttccagctctttggtaggattcatccttttgtttttgctcatggtaccatcaacataccaaagtacaggaagttgctgctaataaacaacatcaaaccattgctagtactcctacttcactaagcaaatatattatttgggagatgtggctcactcttgttaagatcacccgttacactttctgttaattaaaatagaaggttggacttttcaattgctgtgctaatatttttctctctgtttgaattagccctggatcatatagtagtattatccagtggagccggtagaaaaatatataattttttgaatgttactcctgctaatctaacgtgagctttgcatcatcactggaattgtagcggcagtgcaggcagagttttgattcgccttcggctccttgttttcaacgtatttcgccttttctatcggactctactccctccatcaaaaaaaaataaaaaaataaaaagataagtcacgtataaagtattaatcaaaacctgggttttcgtatacaacgtttaaccgtatgtcttatttaaaaaaaattataaaaaaaattaaaaagataagtcacgcataaagtattaattatgttttatcatctaacaacaatgaaaatactaattataaaaaaatttcatataagactgacagttaaacgttggacacggaaaccaaagatttatcttttttagaacggaaggagtatgttctatgaatactactagtactaataatcatgatgtcaaaagagcaaaagagccatgccactgggcagttgccaagtcaaccctcttcgtgcaagcaatatgtaaaaagtcaacctgcatatgttctctccacaaccgtacttgcaaagtactccccccatcaaaagggttagacatattatttttatactgaggattaaggaaaaaaataatctatctttcatataacaaaaattaaatagcatatatacgcatgcaaccaatgaatattaagatgatttctcatggtttgattaaacatttaatttatcttttcatttaaatcttaagtacatggaaactac

SEQ ID NO: 101116 - DNA, 608 bp, Oryza sativa
ttcctgcagccctatttctcgtgtgttgctcattggcccgttcaatccagcctttttggctaccagttgcctgtttggcactgaatttttttcagatgtttaccttcgtggtggttgtccccacttggtcatcaaaatcaggagtttagaaatgacattcgcggttaaatccctcgtgaaattcgatattctaatttcactggaggaaaaattattttgtttgtgtaatcctgaagtcttgactccatggtatccaagagaggtaagaccacatataggtacatctgtacatgcatgctacgcgctgtataaaatgttttggtgagtcgtgttatggattttgtgcatcggtgttcttttgtattgtgggcaactgggtggggtgaactggagtgtatcagtaagagcgagtacaataacgggctacaagttagctgtaagcacgcacatgtggagtaagaacgagtacaataacaggctacaagtcacctgtaagcacatgtggagaaaagagagagaagaagtaaagcgagctacagatttctagaagagagaagaaaagagagaagaaaagcgaagaagagcgggctacagagctatagatttat

SEQ ID NO: 101117 - DNA, 1103 bp, Oryza sativa
tcatttagccttctcacaatcttctattagtacttgcttgtaacataccgaaaactaactattttctaatcctgcatcatgccgctttttatgttcttaataacttcctaaacctaggaaaatacaattagagggaccttctaaaactaacttgcataaaatctctttctggtatttaacttcttttgtgtttttcatttaaaaatatagttggttaaattaaggtgtttcttgatttggttttaatttaaaaaccttctttagactaagattcttttattcaaatttagtttgaaaactctttctatttttttatgaattatggtcaaagaaacattcccatactgtcctagaacctaaaacaaagtaattccaattttattataattaattgttagcccattctttgttcttaaacccatcctttgattctcgatccaaatgtccaaattcctccttttgatctagccaccaatttaattcctgtggcttgatttcctcttcggcacaagaatagtattattgtaaatattgtgaataattgctcttgtgctaagaaaatagcaatttatattcttcactcaactttccctattagccacaaataattcttcaaatacttctactatcaaatttaggattcaaatcctatttattttacctccaaccattctcctccaaacatatatatacattgaggaattatattgttaattcccctctcatttgagtgcattaaattccaccatattccacttccaaaaatattgcactcaaattagaaaatatctgttttggaaattagatccaaatataatttcctttcaaccttccctattcaaattatctccaaatatattttcctttcaaaatcttctattcaaatccctttcaaaattgagaaaccaattctacttaaattggccgaaattctttttctccttcggcccaagccggcccaatacccagccgagccgccaacttgcaccgtgccgtgttcgtcctccgccgctgctgtgccttaccctcctcctccgccgttttctccttctctaagaaaccgtcgccgctgccctaccgtcgccgccaagtcggggctgcag

SEQ ID NO: 101118 - DNA, 1192 bp, Oryza sativa
gacatggacttgcccctgtgggctgtggcctgctgctggtcaagtgcctcgtcgccaacgcgcaacaaacttcaggtcccgagcgagcgtgattacgcaattgattgaatgacggatcaagcgtttgttgggagccagggaaaaatcgtaggacgtcacgcaactctcttttaatttgggacattgtctacaccgtggctcgatcgatcgttgctctcctggagaatgaaaaacacgttttgctcttctgtttttgtttttgtacttccaggacaacatgaaaccgcctactcagaatgatttttttcttgcgacctggtaattgagatcctaagcatggcagcatcgtgggctaattttgcgtgctcaattgctcatggaaccgtgaaagctagcctggttgcatgcacggcaaggctactgatccagcactgtgtgaggccgattgaagcttccgtggagtagaagaatcttctggcgtttgatgtacggagtacttcatctccagggacaggtacggtgatggtcgccattccaccaacctcgaggataaatgcgtctggtacagttgttaagttgatgatgtacgtatgaacgcaatagatgagcaaagtatttcaagcacatgcgtcgctaattgatgcgttcacaacaaaacaagcccttaaatggagaactgtattaggaccatccatgataagtaccacaaatggagttgcacttaaccttcttgctgacgcgccagcgcatggcgatgacccaagcacgatctacgaaactggctgttgagagtatttatgtcatagattctccattttcggtggcagcggtccagttggtttctccgtttctgcaaactatgtagtcttgtactgcaaaatggacggacagttcggtgagacagaatccttacgctgtgcttggtgatttctgcagtactgcaacatttcttcttcttcttcttcttcttcttcttcttcttcttattcttaacggaaagactgcaatatttcttggacgggccggaaaagcttgtgagttgtgatcgatatctgttcttgacgggtcgtgcaaactcatcagggaataccaacttcatggttaactgctctacacgcacatatattcgtcagaaattcagaattttctctagttttgtacaagggcctaactattgcgtagaacacacgag

SEQ ID NO: 101119 - DNA, 676 bp, Oryza sativa
agaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaa

SEQ ID NO: 101120 - DNA, 1771 bp, Oryza sativa
  unsure (1)..(1771): unsure at all n locations
tttttctcccattggatacaccataaagtgtagtggatcaaggggccgacatggttgatgcgtgtctgatgaagttcataaattctcggagatgagatattgaaggcgcgtacagcatgcgtacaggaagcccattacgctggccacggtacctttgctctctctgacaacgatccacgccgttttatctagttggtaagaatacccaatgcatggattaaaatgaaagcaactttcaatgatctgtataaatttccatggacactatggccttggcatgcatgcgtgtagaaacagaggtacatacacgtacatgtatatatgtaccaatgatttttaatgtgtgtccatgtattcatgtctagctgaattgaatgggctctcaacgaattctctgtcggtgcggttactgtacagttcgatcattcgatatgttttcagaaagctctgcagtaaattaaatcaacctcgtgatttttttttttgttgatgtgacgctcatgttagcttgagcttcatccggaagaactatgaggctggctctcttttagagttgaaagctactacttgagcaagccccacagattgttcgaccaacaaacattctagatatatacaggcaacaaagcgtcaaagcaaacggcttttgatctatgtactcgggcctcgtttcagaaatgcangaagccatagctagctgaaaccatttctttctctcttctgttttttatccttgttctcgttgtgacagatggtaacctgacggctacattgcacggtgacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtttagcagttaaaaaaagtgttaataaaaattgagatgtactccaatttgtatgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcg

SEQ ID NO: 101121 - DNA, 2401 bp, Oryza sativa
cggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatagaactagccccctgtaattacaggacctcacgaggttttttttgtcaatttccttccacattttttttactaggactattttgtaaagagaaaaaaaattccagccccagatgagcttaacgtctctgaactctgaaccttccatcgatttggacaacatcgtcgccattctctcttcccattctcctcctgtcctcgcatcaatcctcgcaaattttggcggtattcaagctcagattgtaaccactggagactggtcattcgttcgttttctggagaggcaattttctggagggggaaaccgggcgaatcgcacacggcaggatgccacgccgtgctgtttgctcctttttccttgtggtttatagctgatctggtcgcggctactctgaagcctggtggtgcgcctgcagcctgtgcagatgtgtggattctgaatcacttgtgttgggtggaatggatccatggccgtggcttagtgccctagtgcgtcgtaggcttgcagtcaaaaacgtgtccaatcccctgcgaactgaggacacaccacttcaggtttgttcgttgtggtgatcctttcttgtgcccagttgaagagtgtaacaaaaaaaaagtttaggacattactgagagaatggattagtgatcctagttggatctagtatgtagacagttttagtttttttttccctttgtttgttgctaccgtagcatgctcctggcttgtctctgtcatggagtcgaggatcttgctaagttgggtagcctgcccggtggtccttgttatcattggatatggttggtgggctggaggcttggtgcaatggtgccaaattgccaatccctcctagtagcatatactgaattcagatttttttctttcccggggaatatgaattcaggttttatcatgtatactccctcacttcctaaatacaactattttttggtacgcggatttcagtgcacgggaatcaaaacattttcaaccaaacaagtgacgagaatcaagcgatttaaaattcgaaattcgatcaacaaaatgactgaaaagaaatcttccctcctatctttaatctctgctatacagtgtaaaaagtgcttatacttaggaattaagggagtatgtgagtctctgagatctccgatctcgttagcgttggtggctcctcggatgtggacctggtgaccaatcatcggattaagtacttgcatcgcgatacctgaacaaatgccaaaaccaattcgatcgtctcgccatgctctcggcttcttctcgcacagccagactgatcgtgttagctcgtcgccaccagcccactaccatcattttctagcctgctactactaacgctaaatctgctactaccactgctaatctgctgctactgctgctgctaccaccaaacacaaccgactggtggtgactgccacccaaggaagaggcaccgtcgcgtagcattgaattggattgacgggtttgagcagtgatcgcagcgttgctgtgccgtcgtcggttttaaccacgcaggcaggggcggcgaccagctgcacccaaccgcgcacttcaccttgaatgctctcatttactccgccttcctaccgaaatcgtccgctcgccgctcgtctcgtgcccttcggttcgtagggaagagtcgcctcccctcgcgtggtgccgtgccgtgcagtgaaaaaaaaaactctctcatcttttcgcttatacttatatctattatattattaaaggaatagaaaaaggagcctccacgttcgctctcatggcctagaaattctcacattaatcggagaaaaagaaaaggcagagtccatatagaaatacaatttagaaatagctaaaattcgaaattaaaaaataaggaatattagaagaggagagtagagtccatatagaaatacaatttagaaatagttgaaattcggaattaaaaaataaggtatattagaagaggagattagagtccatatagaaatacaattaggaaataattaaaattaggaattaaatgtaaggaatattagaagtagagtataaagtctatatagaaatacaattaagaaataactgaaattcggaattaaaaataaggaatattagaagtagagt

SEQ ID NO: 101122 - DNA, 712 bp, Oryza sativa
gaaacccaacaagccaataaactctaaaaactacaaggtccaatttttaaagtttcggaacttctaaaaagtaaaaataaaacaatgataatcatgatacattttaaaatctcaatgacaataaagaagggaggcagcgggcgaaccataaaggagtacaatggcaaagccactgacggtttggcgggacttatagaaagtaaaaaaatgaacccgaacgattattatgttcgatttgtaaaatcccaatgacaataaagagaaaagacaatggacgggtcgtagatgagtataatggcagcgtttgacgggacttctagaaattataaaaacgaaacccaacgagataataaactcaaaaaactataagatccaatttttagaggtttcaaggagaatgaatagaaatagtggtagaccgaggaaacaaaagaaggatatgacagaagtaaagggtagcagctggtgtgacttttaaaaactatataattagaaatacaagtatagctatttaataaatcttaagtaaaatcatactgaaaaatatatgattttgtttgggtgctagccgcgcaattgcgcaggccacccagctagttacttttgaaataaatgaaacgcacatgtttcagcaatatgtatttttaaaggtatgatacaaactgaaatgtgtacagtataatgcactcattagtactttaggggctgcagg

SEQ ID NO: 101123 - DNA, 2021 bp, Oryza sativa
agaaatgcttccaagagagaacccattatagacacatgcgatttgctattgactttatactttggacaaaaattccaagatatcatattataaacataagattataaacatccaaaatttggtcaaaaacttaaaatttgatatttcagaatttgtatccaaattttgtaactttttgtcttaggggtgttttggtaatttggataaaattgtacattagtaatggaggctcatcagacgatgatgttgaattgtcgaagttaaacaaaagccgatagcgtattgtagaatatgactaaatgataaatcataaacatgtgacaaacttagtggcatatccactctttaatttatgtgttggctttaacttaggccctgattgattcagcttagcattattataatctggattattataagtagattgaaacaaacaagtaaattattttgatagattattataatctataagccagattattataatctaataatctcctttggaggagctttttccagattattaagtgactaaagactcattacccttacatgcatgtaataatctatagaaacaaacaactcacagcttattttatgtcagcttattataatccagtttagagtaatctgatttaataatttagattacaataatcttaagctaaaacaaacatggccttaaacgaaactcttcacatgggccacttccattgggccaagatattctgtagacactggtgcaggcttccgggctcaaactttgaaatgtcatagaagttccttctgcagatttcagtgtacagggtgaatttctccgtaattggctaactagtcactagggaagactttttctgtaaggatcactagggatgacttaagaaataagtccaatttaactacctcaattgtagggccaatctgatttatatccctcaaacgcaatattgcatatgttgacccccccacgaaaaaaaataataaaaccagtacaatttgattcccttgatattttttagggtggtttcgctaacgtggcatgttgacttgatctacctatgttgatgtgacaacctagttataaattgaagtgggaccacatgtaaatgactaaggttttaaaaaaaactgtgggacccacttatcagctcctcctcttcttcctcctctcttatcccccacttatctttcccaagctcgtcagaccatcctactcggcgtgccgtgccgttgtgtggaggcatggcttagtgtagctagctcacctggacaaaacagtcgtggaagtggaagcgggtgaggctggcgaagctagatgcagggggcgtcttggcagcgccctcttcaatcattacgcgtcgcatggcccggagccccggatgtgcgtgtacttgttgcacacctgcgccaacgcgctggccacgaccacaaccaggacggcgccacgagtcaatctcacttttcgctacgtacacggctcactctgacgcacaaatgacttgagtgtgttgcactgtaatacaacatattacaatcaactatgtttttttaggaaagtcatttagcgtgctttattaatctacaaacatagttacatcgttcactggaatgttccacaagaaaattggggcctcatcaacccaattacaagaattcttaaacttaaaagcatgattacctagaacatgtgctacacaattggcttccctattacaacactcgacagagactttaacaaaatcatacatcaaaaatctggcattcatagaaaattaccacaaccgttgttgccgaaaaacccccatcttgcatcatctccaccacctacaaacaatctgattgggtaacaataaatcgttgttacttcaactatgttagcctcgtaaggactttttttccttcttccttattaatttacaaaaaaagttcattttactccctgaactatttcattggagcacttagcccctttaaacttttttttctcattttacaccccgcactattgaaaatggttcact

SEQ ID NO: 101124 - DNA, 514 bp, Oryza sativa
taaaatgagccaaaaaatagttgagaggataaatggtctattgaattagtttgggcgagtaaaatggatttttttttctaatttacatgctcattttattcacctgttacttgtaatgtactaccgttgcttttatgtttgtgtactccgctgccatggagacatggagtgtctacaggacaataccatttacagaatcaccatatgatatttctgtatcattttcacatctatttccttacgatagctattcagcctattctaatactagtatatgctctgcatagaaaatgtgaaatgaaaaacattcgggatatggtccactaaacagcataggaccatgaacaacattttttttctttatgggcacgagaacaagtgatcaacagttgacactgcacaatcatgactaatctgaaggggcgagttggcaagttgcttcagaccacgttttgttgaggagtgaaccagataatttttaggtcatacactgtacgacctatccaaaaggttt

SEQ ID NO: 101125 - DNA, 1016 bp, Oryza sativa
ttttaaattccgaattttcgttattactaaattgtattttttatatggactctaaattcatctttcaatattccttatttttttaattcctaattttagttatttctaaattatggccgagtttagttccaaacttttttcttcaaacttccaacttttctatcacatcaaaacttcctacacacacacacttccaacttttccgtcacattgttccaatttgaatcaaacttccaattttgacgtgaactaaatacactctatatttctatatgaaatctagacttgttttccaatattttttaaaaattttgaaattttgttatttctaaattgtatttctatatggactctaacctttacttttactttttttatttttaattctaaatttcacttggttctaaattgaataccaatgtggactctagtttcctcttccaatattacttatttttaatttcaaatttcagctatttttaaattgtactttattatggactccctttttttcttattcttgattaatatgagaatttctttatcgtgagagaaagtgtggagccttttttctattatttaataagttagtagatagaggattgaacacccctagagcaatgtcactctcatgtaacgagtcaagggcaataatgtaattttccgttgtcaatgaatagatagggccctccagagacaagggggatcccaatccatcccatgaatatatggttactctaactctcatccctcctctcctcctatttgactatctcctatatccaaccttaggctctctccaatgaggggtgggagcccttgccatgattgttcggccaatttgttccaacaattgcatgttttatcaggaaactcttttaacccatagagggatgttccatcgtatcgtgcttatcaaataaatagttttgaagaattaagataattatatttggcaagatatattaatatatcactccataaatatacaagtttaaatttgacttctataagtt

SEQ ID NO: 101126 - DNA, 1757 bp, Oryza sativa
tttgatgatatgcctgttgaagtctagccacacaggatcacattgttgccagagtaaggggagacaaattctgaaacttgggctggagcagcgttgcaggatagaggcgactttcggctgaggcgtgtatacgtctgcatggaagctgtcgtttaaaaatgacggttttgattagatagaattaatcacggatttacctagagttttctatatatgcagtacagtgtattcctttactatatactatggattttgcacttggtagggctctggaacaattatcatcctatattattttcttctactgttttcatcgtacttttactcttgtttctttggccaaatcctagttatctagggtgcagatgatctttactggtttgcgctgaaaatcagtcgggttcttccacgaaagtgaagatctttgctagtttgcttgaaaactagtcgttcgtcgtcacgaaagcacaacggttttcattgttgttgcgtgaatcaattttacgtgtcaacagagaacagatggtgttgttggtgttatgcgtgggaggtttttataagtgaaatattggatgaaaaaaaaaacaacgttaacttgcaggcatgctaaacagccattgcttcatttttgttcgatcccgtagcccgatatgagaaatcaagccgtgaaagtaagatagtattgcatatacttaagaagtaagatcacattaggttgttcaccggccaattccctcgaaaataaaaattgttcaccgcccatgaccatatatatatatagcatgttcaggtctgcatcttcttcccaattacttgatgatgcatatcttcagcctgtggcgtcaaatcttactaaattaactgaagaagtaggagaagccggtggcgtatactaaaatataacctatacgtggaacttgcttgatcatgtccatcagccgtcctgcatctcgtcttactaaatcagcacgaagaagcataacaggagaaggcgagtgggcgagtggcaatcccacataatccataatcgcatcacaagggctcgtgcgcgcccatggcacgtgttgtcttggttcactacaacgtacactctttgtcatcacgttggtgtgatccataccacccataacctcatctctcctgccgtgttttcagaacaaagtgtttgttagtagtagacggcaatgggagtccgattccaatctgaaagaccacggatcaatccatggtgcacttcttcctcccgagcgcgcgccctttgctagcacttcttcaaaaattgacggtgcaggttgggccttccgggccttgaggagagaattggttttccgttcggtcccttcctcatttacacgtgggccagaatttcaaggggcagcccagctttggatttccttgtctcgtccacagctgctgaacagtcgtgcatctttctttctttctctttgaaaaacaatgtatttatttatttaaagaagttcagaagaacaatatactccttccgtcccatccagttttgcaaaggagccccttaacaatgggcagattacactttagctcaacattttgtagtaaaggacttaagaagaaaagaaaaaaaaaacaattgagtcctgctcgaactgcctctgtcttcaacgtcgacgacgaaactttgaatcctaacatcggcggaggttggatccaagtgagctccaagtgagctccacaagatgacgccaccgcacaatccttaacggggcctctcatagatgata

SEQ ID NO: 101127 - DNA, 764 bp, Oryza sativa
tatagtaatatgactcaataatatagattataataatcttaagctgaaagaaacagggcctgagtccctgactgagcttacgatgatgatgggatacaaaacaacgctgggcagcacgggctgcaaggggatgctagcccgcttgagtcagcatagcggatgaatccaatagcttgcaccggcgctgcagcaggggtaactaagggcctgtttgtcatagctccagctccaccccttctggagctagagctcagccaaacagtttcagctccatcaaaactaggagtggagctgggtggagctctctcacaaaatgaaagttgtagagctgggtttagacagctccacaactccactccagacctaactcctagagttaaatttaggagttggagttgtaccaaacaggccctaaagaacacaaccttaagaggggatcgcagcaaagacgtaatgtgggcatcccaagtaatatatcgtccagtgtgtccaacatgaccaacacacgtagatccaaatacatgtgttagtcacgataagcactggacaatatattacgtgtggtgcccacagcagttggtatcatagcaatgctaattgtaagctaaagcttggcttgacgatttgaaaatagtttgaaaaaaaaatcaacttaagctatttgtgaaaacccttagaatgtatgatcctttttacttctcacatctttctaataattttctcaccttactcccaatttaatttgctcccattgacacgtgcta

SEQ ID NO: 101128 - DNA, 632 bp, Oryza sativa
tcattcataattcgatagatggacttttcagctacttgtaaacggcgaaattgtgtctaagttgtgaatgagcttttcattttcatttgcgtaccgaagtggtaaaactgacgacctaaagtacgatatacggaataaagcaagttccaatactctctgctgtttgaccagtgctacttggcgctgttcattccaattagccgtaaatttgtgaaatagatcccaagataatctccgttttatttgcttccaaagaggttatctttttaatagttggcattttctagcttcttggttgctataaggcatagttgaagtgcagtgagaggaagaggggaactcacggaaagagactccttatacttttgtcaacgggtgtgttccaaaattcgctagttaaacgttttattagcagcggtcccattgagccaaaaccccgctgagcgttgcgacacaatctgatcataccacataatcattgcagcgcctactttttaacttctagcagccaaattgttattcagatttaattggcggtacgactccttacagcagtaaattattcgaattagtaacaaacgagtgattggtatgtggagataggaaacgaagactgcggccgccaccgcggt

SEQ ID NO: 101129 - DNA, 639 bp, Oryza sativa
ttagctccaacacctgcgttccgggacagacaaggattaattatggtttgttgcaaggcgagacagccagccatccatccatccatccctacggagaagaggaccatcggatcgagtactcatcttcatctagtgcgtgacatatatcacgagtcgtcgtttaaccactcgtttggtggttagttagctgtgcgtattagcagcgatcgaacaaacacatgtagtattgctggttccagtaccgtttacattgatcggtcccaaaataagcttatgtgtgggtttctatgtatcacgtttgatcatatgtattatttgaacatttatagaatgttaaaagatcaagtcatgtatatcgaattattgatattttatctaataataataaaaatagtcaattatattattttttttaaaaaataagtataatggttgaacgttggacataaaaatttacaaatcatctcgtttcgtatgcagggtgtactatttctcatgggcaccctgtcttcttctgccattgagaactcacagagaatcagacatgtatttgtaactgctactagtagttggacaggtagattggcattagcaggaccagcaacaacatgatgctgcttgttgcttgttgcaagtaga

SEQ ID NO: 101130 - DNA, 1456 bp, Oryza sativa
tctgtttggtccatcatccaagcagcatctggacttcctccaccacattatgtagcgcatatgtttgggagctggcttgatggaattcataataatttgaaatcacatgttctgttaggagcaactgctacttgttggtcgctttggctatgcaggaataatgtggtttttgataaaaaaaaagtcatatcttcacctttgcaggttatatattctcttatccattggcttcgtacatgggctatcctacataagcctggttcgcgggatatggtagttgcggcatgtcaacatttggagaagatggttaaggagttatttacccagggatatgggtggcgatctagtcttagaattggtggtccttaaaactctgtgcttttggaggagatggccaaggagttgttcatgagtggcaatttagttgttagattgattgtacttaatactccatgtcattcttttttcctttcgagtgtggttttgtttgttcagctgtgtgcatattagttatgcagaggccgaaagtgttctcaggataattgtatcaccttgatgtaattgactgagttcaataaaagcttccattatctaaaaagaaaatattgccatgtcttttaccacatcatgcatgcaaacccacatattagttttttttagacgtttagacgttttgatagttgactaatgagttctggcaaatattggagctgagggacgaaaatttaaactatgaggactggagggaccaaatatagacatttcagatcttacatggtagtcagtcattgagatactgtcatgactttgatctaaatttgcactgatactggtgcaacgataagcagctacttctacagaatacttcctccattcctaattgatcttccattcctaattgatcttcatatatggtttatgcatcaataccaagataaacttgcggagcacttaatcagcatcggaaacatgcattagcgtttcgtatccatgaatgtagcgccatcagttttgcatgccgcataacctgaccaatcagatgcatgcagtgttcagtaggaagtatgattaacgtccttcccgggattttcaccgcctcctcaccgtaatgcgacgatcaaaatggaattatcattttttttttttgcatacgacgatcaaaaggtaacggaggtctgctttaagcgttcacaagtcttcagcagtaaactctcgcatgctgcacttgagagatgagagcatatcattgccttgcccactgcttttcactgtcaacataatagacaggggttagcgactggatgacaaaagaaattaactgagaaacatagttagcacttagcacattccagtgcatatacctgtggtggatgttctacttgtgcagttgttactgcaccggtcaaagcagcagcctgctttcttcttcatcatcctgaagctcctgccctattct

SEQ ID NO: 101131 - DNA, 622 bp, Oryza sativa
cttgacgcgacgagcttcgccagatccgccttgttgaacagcgaagtgccgatgaagccggtgcagtcttcgccaatcttgcaggggtccggtccggtcgctgcggctggagcaggcttgcgcggagccatgatggaatggcgaaaaatgaaagtcagagctagcgaagactacaaggccgaaaaagaaaaggtgaaagcgagagcaagaacgcagccgggggaagtaaaaatagatggggtaaaagtgaaagcgacccacggggggactatatagccctagtcatgcgacggttcgccttccggccaatagcagcccaccacgtggcacccagggatggacacaatggtaactcctgttaggatgggccgaacagtaaaaggccacatgaacaggaaaaacgcgacccaaaacccgagtttaaagaaaagaagaagtgacctaactcacgtccgaaaaggatagaaggtcgaaaaacaacatggaaacgtttgagagaactcatgaaataacaagggttagcttctgcaggtgtacataggttttggcaggaacatcggccgaaagggggcacctcatgccataccacatatttgcacggtctcgcccaaagctccctact

SEQ ID NO: 101132 - DNA, 542 bp, Oryza sativa
cgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtccgccaggctgcggtggaccgagtccaccgtgcgccc

SEQ ID NO: 101133 - DNA, 656 bp, Oryza sativa
ttcacatatttcgttatgcatagttgggctacacttgcaccgccaaagcttcttatttccagcaggaacacattcacatatttcgttatgcatagttgggctacagaaactagaaagaccgtatcttagctgatatatgagagctaactagagcgagccatagtgtgatatagctgactgcagacttacaagtattagtagccaattgtttgttagcagaaaagctttgtgtggagtgtagacatgcctaatcaataaaagtcaacaatgactttatattttaaaacatgttagatcagtataggtgacacataaccatggtaccatcaataccctggctaccagcttactaccaagaaccaagtaagcagtatcaaaactattgattgttgggaactaaaactcaacaagggagtattactccatttgaagctaaatgtcaaccagctgatgtgttttccttgtttggaactaaatgcttgtgagcttgtctttggacatctgaactagtactacaaatatacaagtttatgtaaagttgtaaactaagacaacagactaacagaggaccaacataatataattgagttcacatgctcacaatcatcactctatatacaatatagcgatgtattaaataaacattacctgcactt

SEQ ID NO: 101134 - DNA, 1100 bp, Oryza sativa
cataaatactatgatgataaagagctactccctccgtcccaaaatataagcatttttaactataaatttggacaaaagtggcggaggtaatagctaaaaaattgttatattttggacggagataatagctaactagtgcagcgcttaatatcaaaattggataaacctaattatagactctgaatatgaatagatccatcctactataatgatttggacataaaagttcatatttgttatatctagattcattgaagtaggaagggtctaatcctatcctagttaattagtttataatattttagaacagatagagtatatggtaataatgtatatgcgcacgtgcatatgagttgcatgaactccctccctttttataagacatataacgctggtgactcttgtatatatatgttttgaattatgtatcttattttaaaaactatataagtatataatatcatttttagtttgttgtgatatgtttttatattttgatacttaaaacatgattttatattgtgcacatttacactaaatttttaataatataaaagtaaaattaaatgtgtgcttgaagattaacaacgtaacaacgtagtatgtttagaaactgagggagtatatatatcgtgtaagcaagcatgcatgcaattaagctagcttattaataagtagctttaggtagctaactttgtggatctgttatgtgttcctctccgtttataggaaaagagaaaaggtgagcggcgcctaattttgccatctcccgccaaacatatcatgagactaaccccgcccaagatgcgcccaaccatgcacatatatatctattactactatccgtctcaaatatgagtaacttctacttataatttcgaatgcgtagccaaaaattatcacattttagaacaaaggaactacggacatttgcctagatgcgttcaggtttgcaactgtaagcttatagctaaaagcacgtaaagatggatgcgtatttcatataatgccttttcaggttggaaaaagcaaccatctgacatgaatttttcctgacgtgatcactaatacgtactcctaggtttatgggtggcgagagc

SEQ ID NO: 101135 - DNA, 1151 bp, Oryza sativa
ccccaaccccaacaccaccagaaaccaaccttccttctttccttcccattcctcctctatctccacgccccctgctttgcttctccatcaccatcagtacataaaaatcaatgtaaacgccgcatcggccacttgcattttttctcttcgatctcttccactccacaacacacactccacttgccccccgctcggctcctgctccgcctacgcgacctcactgctcttatcggccatttctactgatcacgtcgtccagtcagtagagccgtcatgctttttgtgctctcggcttttttataatagggtgtgttcgccactctcgtttctagactgaacagtatacacggaaaacagatcagttcattatcacgtaattaattaagtattagtttttttcaaaaacagattaatttgatttttttaagcaactttcgtatataaactttttaaaaaatagcgtaccgttcaacaatttaaaaaacgtacgcgcgcggaaaataagggagaggggttgagaaaaaggagtgctgaacacacccatagtgttctaatcatacatttttaagttgatgccagaatgcgactataaacaagaactgctctatgtggcaccaatttttacttgtactagtacatgggagtattttgtttactacagtggtggtgtttggtttgctaacctactaaaataattaatttttagtatcacacatttgttctactagatacagtagaaacaatatacacatttgcgcgtcaggagtttcgaaaagactcccccacacttgttttgtaccttgtctttattcaacaaaaagataaaaagcaaaataggcttccaccggggtaaaataccggtgagccaaattttattcaagtaattctaggcacatgaagtgcctaaaattacttttattttatttcacttttattttgtttttatttatatttatattttatatttttatattttttatcattttttatgacagcaatagaggtgatgggtaacctagcagggtggacatatgtgacgcaatgatacacatggtgtttcgaattcttaccagataggacctaccaagctttgattcggttgcaagaatgcaacacaactttgcatttgttctgcctggttccctgagcat

SEQ ID NO: 101136 - DNA, 588 bp, Oryza sativa
aaatttttaaaataaacttttctatataaaatttttgaaaaaaaaagtttcgtttaaggattgggaaagcgtgtttacgagaaacgagagagtagaagatggaaataggtattttccgaacacaaacctaaaagagtttcgcaaatatatgagagtgggtgtacaatctcaaccggattttgtttctctctattttggttgtagctcaagagttgtgcatttagggccggtgtctgtagaaactctcattttttttttcatcttaatgcaacgaggttttgcgtttccaaggtaaaaagtactatgtaagaaatagtcttttcgttccaaaatattattagtatttctaacttattatatatctggacagggaagtaattaagtgagttcgatggagctttaggtatacaagggagctcaggaagtactcttaacaaacattggctaataagttgcagatatccctgactaataattactcctacttaattactatttcccagtattagaacaaatttcgtaccttgacagtacgtcgagccctccatgcttggttcgacgaccaaaggggatcggaaaagggaacag

SEQ ID NO: 101137 - DNA, 581 bp, Oryza sativa
taagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttgttcgaatcggtccttgagcttttgagctttgctcttttgttccatacgatccataacgcccacctaatgaatcgggtgatcaaggcaactcaatgaagatcaatcttgttgatgaatg

SEQ ID NO: 101138 - DNA, 517 bp, Oryza sativa
  unsure (1)..(517): unsure at all n locations
catgaagggggaggaaagcctctgcggacggagccgatggaggtagctcgatgcttgcgtgtgccangaactctttgtttatttagaataacgatatagncccatccttatatcgaccgaagactttcatatcaaggctgggagagaagcgctcccatgatatgctccttaagcgcatggtatcacccaacctactgctacagtaccgcgggtactgttcactcgccaggggttgggcccatgggcctcgacccctaggtccctacctatgacatattgtcactgttagtgacggcagttaaagatatagactactacgaagcattcccgagtgacaaagtatggcttatgtagcactgacatactccctataaaagggcccatgccatcccatatgaaataagcaatgaatctacaaagtttaattcagtattcctcatagcctctatcatgatggggagaagctcttctgggcctcgtagagagcggggtgccctaatccccagtcttccctatc

SEQ ID NO: 101139 - DNA, 693 bp, Oryza sativa
ctgcagccctattagaaaagtagagattctacccatggaaatgtagcatggatccctccctaaaaaagaacaccatgtgtaccccgctatcaatcgacaattgaatctctaaagttagtccaataagccttagactcccttggttttgacagggagtagccttactggcgttaatatagagcgagtgtcgtattccccagtctttggatctttaccatatgcatgaatcggcattcataatatttacggcttattgtatgcataaactaaaagacattaatgcagaaggccctttattgccctgcatgccatgagccagccttttccttacatgcttctagaagactaggacaaaccactagcgctagaatatagaaaaggtgagacagttctcaacaagcatggtttgagaaactcgaaatacaatggcacaaaggatggaatgattggatttgtgaagaaatatattgtccacagccatttatcaattgagctttctttagcaatctcaattaagttcatgtgccattgtccctattcagatggacccacaaacacagtggcataaacactgagaacactacattaattttttacatacatctcaccagtaatgatttaaggtttctctaaaactgttgagtgcataactactaaagttaattacactacactacatatgttctaaataga

SEQ ID NO: 101140 - DNA, 774 bp, Oryza sativa
tgcctgcagcccaaattaagaggatgcttgtgataagaggcgaagccaagatttatagataggcggtgtcgagattttcagagactcggtaagacggccaaaactttcgggtttttggattggccatcaaaggagcacaacacgtcgacatgtcatgactatagatggccaaaaggcccgaggcccgacggcctggcccacggcatgacattttggcccagcccaagcacggcacggcccgaccaccgggccgtgcctaggccccccactggcacgttgggctggcccaaaatgaccgggacggcacggcacgatgggccgacaggccaagcccgacacacaaagaatagggactaaaaatagacttattttagctatatatatatatatatatatatatatatatatatatatatatatatatatatataggacactcatatggggcaccatggtgcccgggcaccatggtatctaatgcacaaaatcactcaaaatttttcaaaattttaaaatgtgagtatatacctaggtataataaatccgatcatacctatacttaataacaaaaacacctcacatttaactttattcacaatcagggattacgtacctaaagaagtatatgtatggatgctatatacctagaaacaaaatctaacaaaaacaggtcaaattccgtacacacatgctttgaactagtagtagaagaagtaatggttatacctaagtaattgaaaaggttatactcatttgaaatggtatatatatata

SEQ ID NO: 101141 - DNA, 514 bp, Oryza sativa
agctatagtaaatagccactgtttatgtccttagatcgctgttcccctcacatggacagtgcttccctgcagtactgtaggcgatccggatccgcaggtcggccgtgtgctccgcctccgccctcgcgccgctgcctcctcccattgggagagaaagagaaagaagggagagagagaggaggaaaaatgaaggacacagggaggactgccatgtgggcaccacatgtcggtgggcccacatttctctttttgagtgactaatgaatcctatgcatattttttaattctaatgccacttaagcatcacgtcaacgccacgtgtaaagaagacccggtcaataccgccacgtaagtgccacatcagcaaaaccgccctccaaaaccgcctagagagttaaattgcaccggtttcaatagttcggggtcgagttatccggttttgcggtttagggttatggattagattcgggtcacttttaaagggtcaaagtgaacttattccgttttccaccat

SEQ ID NO: 101142 - DNA, 561 bp, Oryza sativa
cagtagttcatcaaaagttatggcgttttataattattaaatggagggagtagcaatcccgattaaatattcatgctaagcttttgttgattacgctttcaacttgtcacatgaatcactttttgcttaaccaaacagagtgaaatgacaaataagttgtgataggtccaggttagtaaaatcccgagttaatgaaatcacacaaatacattaaacagctcaaaggcagagaactatagagcatccgaagaatattactactaggataaggttcatcaaccctgtgttgaccggcttgaatcatagtacaagatcatattaaaacacatggacgatgataacgaaacgtaagacctccatcctttgaaggtctgattattgctcgagagttaccctccactttcaagcgcccggttcttttggttaaccccttttcgtccattttttggggttaaaaattttttttcacaaagggccccccccttttgggcccttttttttttcccggggggttccctcggtagagtgctttggataccaacagaatcttttaagagtatg

SEQ ID NO: 101143 - DNA, 683 bp, Oryza sativa
tttgttgtgtgaagtaagaatatgcataaaagaatgaaacattaggagcttatcctatacaagaatagaaggcatttatcaaatataggcattaaaataaaaacatacattcatcatctccatgttctgaatgtaaatagactaaataagatatggctcaaacaaaatattagtctcacatgcttatgtaatcacataaaaatattatatatgaatatattaatatgtgcacggagagaaagagtgtcatatatagcttgatctccatgcatttcatccttgttatttaggtacaccatcaatgaacgtttctctctcatattccattttcatatccatatgagactagtagacaaagaaatatttataacaatgttagtctcatgtaattggatttgtcatttatcaccaaaaccaaattaaatggatttgtcatttatcaccaaaaccaaattaatggcactcgaactttcaatttacaagtagattttcttgactcgaaactagccgagccgtctaatgtagtagcgagttgatatacttttctcctctctttttttttttaagtgaaagcggcaaagcattatcgaatatattagaaggccagaaataaagtttttacaatagggtgattacatatagcatttgtgagcatctaggagatgaattaacatattaagaaa

SEQ ID NO: 101144 - DNA, 570 bp, Oryza sativa
agtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctcttctattatttttgctccttttatcgttagattggcttatggcttcttccctgctttgtaattttccataacctcaagtagactgggttatttatttatatctaccactaaaaggaggaggcaaggcgaggaaaaagatgtttgcccgtaaggagaagggagtaaaggtgaagtagtctatcgttctttgaagcagtgccgtggacagcgtgatgacaataa

SEQ ID NO: 101145 - DNA, 545 bp, Oryza sativa
tttttttatgtacgtacatattcatgttttttttttgcaaataatagtctcctgtacatgcatataaacatacgtatattttctccgggggaatagtatatatttatttttctctcttgcaaatacgcatgagattaggagagagaaattaattactttagtatgatctaatctaatgattgaaaataatagttcacctgtatatgcgtaaatcaatggttcaatgtttaacttttatttttttcagaatattttggatttttattgatcttaagttatcagttactcccaatctaaattaaattgtgaccatttaactcaccatgtttatgttgaattgctagctataaaataggccaatagggtgttgagagaaaaggagatatatgtgggctgcacgtacgtatctgaagattttagatttttttttgacatggtacgtgacagagtatgtacaaaaggggagagagggttacgtgtgggaggagggaggtggatgtggaaagattttttttaaactaatctgacggcttgaaataatgggt

SEQ ID NO: 101146 - DNA, 637 bp, Oryza sativa
ttaatagaatttatattaaatgatcttttttttacaagtgaagttaaatgtgggaaacaaaatttccttaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaagggagtatttttaataaatggaattgcatttcatgaataatttaaattgaaaaaggtttttaaaagtcttcttttggctttgggccgaaagtcggcccaaaacctctcttctctctctccctcggcccagttcggcccagtccgccgagccgacgctctctctctctctcccgctgacaggtgggtcccacctggtctggcctgtcttcctcct

SEQ ID NO: 101147 - DNA, 682 bp, Oryza sativa
attctaaactctgtttgggaagaattggaagcagggagatggcaatgtgtacttccattttatcatttgtttgttgatttccttgttatgcagttaattaatgaactgcaataaaactacagtactgtatgtactcggcagttaaaaaaaaaacagataacccctgatttctttacaaattgtggcaagcccactctcgcctgtggtagtctgttgaattttgtgatccttcgactattgcaatgcaggtatcagatattttgcactaaagcaactttgtttatgaaattgtttgctctaattgggtttgtctggttaaagctctacattgccttgttgatattgtggctgtttttccccctcttctttgttgttatgatagtcaatctgccgttatcatgagggttgcctggtattcttctgttctgtggtacattttcttggttaagtgaaccactagaaacactgaacaatgtatagagaacctttttttttttttcataaacatctgttttgtctgggatcattgttgcgctttgttggcccattttgatgggttgatctgaatatgatcaaatcagtactccctccgtttcgttttatttgacaccgttgactttttagcacatatttgaccgctcgttttattcaaaaaatttaaataattattaattcttttcct

SEQ ID NO: 101148 - DNA, 503 bp, Oryza sativa
ctatagggcgaattcgagctcggtacccaacagaaaataaaaacttagctagtgtactatgttttgcatgcaggtaaatcatgcctaaattttggcattttaaatcatatttcatattgatgagggcaagtcatgcatacgttttgatttacaggaaacaaaaggaagcaccttgtaaaatgattgcatgttcatagtataaacttgcaacatatatataatttgatgggaattaataataaatgcgtgatttttatttctgtaaaatgcaatttgaaatgtcaatttttcttctattctgccaacgtatataattttgtgaaaattcctgtaattgcatacctcactgtgtcgagaagttgctggtaaacaatctgttgcactgtcccatttgggaagttgaaaaatccatttgggatgcctattctcttgccttttaatcatcaggcttcaaaaactgcctatatccacccgtgggatgtactttgatgctgcccgtgtgg

SEQ ID NO: 101149 - DNA, 835 bp, Oryza sativa
gccaaaaaattctggcatgattattatacatttttttttacaaatccagacaaatacatcgcaaatatattgcaaatatgttaaacgatgaaaatgcaatcaaaggaatgagaaaggcaaaggaaaaggaaagaacaaagaaagcaaagaaggaaagaacaaagaaaatagctgtcaatggaataaattgaattattgtggtaaaatttttattttttggttctcgcaagattgactcccggctagggttccagcggttaccgctaaggatccaagattaacgttgcataaatgcaaaggtaagttattttggggtaacttatccttatctattgagagctacaaacataaataaatcatcatattctacaaaattctcacgttccataacttccggaaagtttacaagataacccacaaagccgcctccagaaaaacccttttactccaagattcttgccactaattatcatggcattttgtaaagagtccaggtatcgctgacaaaatgaaccgggaaaaacaggaaagggaaaaaaagaaccaagcaacgttttctaagcactactctacaattgaattagcaagggtcactattacttacacaatgtacaacagatctgacctgttccacctgtacactcaaaacaagacttaaacctaagcctaagaactccagaaatctagtttactcaaaataccaaggctattctaaccacgatcaaaatgtatgctaatgcatatctaactttaatatatctgcactagtctggaatactcctagaaattggaggaaaagttgcaggtttagatcactaggctgcctctcaaattc

SEQ ID NO: 101150 - DNA, 546 bp, Oryza sativa
atttttagttgaattttcagagccttggaaataattttaaccaattaaaataagcaaagtgcaatattaaatccctgggaaaatcctttttcctttttatcttttcttttccctcctttttcctttttcttgggcccggcccatttcctcccgcgccggctcgctcctccctcctactcccgaagttcacccggcctccttctccctctcgggcgctgacaggtggggcccacctgtcagccctttccctaacctccggcagcccacgcctgcgccaaccgccgccgaaaccaccacccatcgccgcccgcctcccccgccttccgcgccccactccgcgccctgcgcccacgtcgccgcccaccatccccactcctcccactcgcgcgtgcaccccgcaacggagggattcaaattcgaatctctctctctctctctctctccattccccacgtcggcgagaaatccggccgcctcccggcctcgtccgtctctctcgagccccaataaagcttccccgcactcccctcaaccttttttctcttt

SEQ ID NO: 101151 - DNA, 564 bp, Oryza sativa
caaatttgttgtgatgttgatattctctatcaccagggctccgtgtttcctttattggagaataggagttattaaatgatgacataatttactatatactagatggagtctttcattgcgagttctaatatattattattccacaacatatacgtgaaatattttgttgatctatacttaaaagaatagattttagctatcattttaatggttcaatgcttgattagtttcttttacaaatattttgaacacaataaatcagtctacagtttttgtaactaaaattatttgttcaccactgaatttctatggggagatgaatggattatcttaagacaaggagtttcttttcaatcatggatggataaaataaaccggactggctacttataagataaattttattcatatgaaacaaattaagaattttactgaggaaatgagaaaaaaaaagaaaaggaaactggcctttgtgcatccaaaaggtggttgaggcatgggccaacgtgctcatgcctagtagtcagtgatctattttcattctatatgtaaaacagtatatat

SEQ ID NO: 101152 - DNA, 519 bp, Oryza sativa
agagaggttttggccgacttcgggccaaagccaaaagaagacttttaaaaacctttttcaatttaaattattcatgaaatgcaattccatttattaaaaatactcccttagctcaaataaatcccagaaaaatctaggaattatagaattaagcaaagtatttaacaaaattttatctagcccaattttatattgagatttaacaaattaaaattagatcttctcttttaagcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatttcagagagttgacttaatcatggagaatttaataaaaattaaatccatccatgctttatattaaggaaattttgtttcccacatttaacttcacttgtaaattaaagatcatttaatata

SEQ ID NO: 101153 - DNA, 623 bp, Oryza sativa
catacaaagagcagttcagcaattatttaaatattaaattaatcattaaatggtctaattataattttgttaagtacttttagtgtccaagtattttcaggatttttcttggaattatttgagcattggaagtatttttaacaattgaaagatcatttaagtgattattttaattgaaaaagttttgaaaatccttccctaagtcgttgggccgatttcggcccaacatcctctctctcccgcgcggccgagccggcccaatcggcccagccgacgccgcccgctcttctctcctgtggagaccgacaggtgggccccacctgtcgggagctccttcatcctccgggagttttttttgtttttagatttttttttttaatatttacagaaatattatagcgccgaaaaaatttgcaaaactagaccctgccgcccttcgcaagggcggcaagccgacgtggcacacggcgccgtgtgcgtcttgacggcgcgcacgggccgcggggagccgagggcttgccgccctctgcaagggcggcagcttcctctctgcacaacggctggaaaggactcctgtttttggaaaacgtaacagcgaagtgtaggaatgcgagtcccgaata

SEQ ID NO: 101154 - DNA, 549 bp, Oryza sativa
tgtacatgtgtactttaaatagactttgtatagtttttatgcgccgttgtacaatgttgaaagaagacgtgcaaagaaagcatattttaacttttttatcacgaggatattacatcttgtactggtagctaatctatacttactttctataaagttacaacccactaactctaaatcttaacatgcaactatgccacatcattacccactagcaataattacatattcaacctcatgcaagtatgtaacatcatctacaatctatttaattaaacaaatcaacatgtaaacatatccaatcattacccctcacatcatttccacaatatttttacaaatctatgtatacatagtaattacctgcatgcatgccactggttttttaattttgcatgtatgccactcggatgataattatagtggaatttttgtaatcttctaatggcaatcttgcaataatgatttacatcattaaaaagagctagataatgtgatgctggaagatggtgcgtgctacaatttgcatcaaagcataaatctctgcatcta

SEQ ID NO: 101155 - DNA, 670 bp, Oryza sativa
ttgtttttaaaatatcatgtggaatgggtcctattactcagctatatgtggttgcccttacgccattgataacttgggtattaaaatcactagacgttgttttaggagattgtcacatcctgatttttgttttagggtttataaattatttaataaattattaatagaatttatattaaatgatctttaatttacaagtgaagttaaatgtgggaaacaaaatttccttaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagtgcttttcttgtttaaaatccttaaattataaatggttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaagggagtatttttaataaatggaattgcatttcatgaataatttaaattgaaaaaggtttttaaaagtcttcttttggctttgggccg

SEQ ID NO: 101156 - DNA, 608 bp, Oryza sativa
cagccgctgctccgggcgcggcggcggggggccatggcggcgggggtgggggggggggcaggaatggctcgcggcctagggtttcgatccgggggtggggataaaaagtgggggaggaagcgggagctcgaattcggggacggtttcacactactcgcctttgttcgttcttcttcacctcctcgcggtgtgtgtgtgtgtttttctttcctctttggggaagaaggagcgtttccactggggcgggtgacacgtggagggcccggattaagcgagggggttccccttgtcggctgctcgtggccgttggatctgggccttcacgggcccaacagggggatcccccccaacggccgaatggcttgtccagttgttgtcctcctgcccctacagctgtacactgggattgatatcctctaccttcgaactcaccgtgtgatcacgatttgttaggctcatatatcagtgataaagtctctgtgcacttgtagtataaaacttctgaataaaaaatctatgaatatttggatggtttggataaaatctgggtcgactttgaacctctttctggttcccacgaatgtagctagtctcaccaatctcgctcg

SEQ ID NO: 101157 - DNA, 531 bp, Oryza sativa
ggtttatataatcatctcatcctcctctggtctcctgcgatagattgaccctcatctctcctcctctctagcctctcgagaagctaggcgatcgtcaaatatatctccaggtgcatcaggttaatgaggtgctagttatcattttaaaaaacggtaagatgctaattgctttccatgaaccaacatatccaaactcctcataagtaccaacatcagttaggcatcacaaaagcggcactaataacatattgttagtgccagtacgttctacaactggcatatttagtccctcgtatatgttggttcttgtttagacccggcatgaggctcaccagggacgagttagcatgttcccatccggccaggctgtgttcgctagagcaagttcccatccgaaataatcgcacagaaaatggaacggtctattaatggattagcgcgtgattaattaagtattagctgaatatttttcaaaaatggatcgatatgattttttaagcaactttcgtatagacacatttttgaaaaaaa

SEQ ID NO: 101158 - DNA, 675 bp, Oryza sativa
aaattgcatgatactgtatgttatttttaccggaacaaattaaactgaatttatttaacataaactcacatttatgttattatatactaaaagtccattaaacttccttctgccacgtggcgctctaataaaataaagaaaatcctagaaattctaaaaaaaaacaaaacatctaccccttcattttcacttaaattggtgggtccaatattatacaccattagataaaattgatcttaaaacaaacaaaatactatgggtcccacctctcctctttatacgtgcatacgtaggtcacgtacgggtatgtagtacgtacgcctccctcccttttgtttcctttttttactacttttttccatttatacaattgataattttataaacaaagaatataccattatataactctttataaacacaggtaactaaattagctctataatatttgaaaataaaatttacaccatattatatgtttacccattaaatcaataatgtaagatagtttccacttaaaccggtgtactaattactttgtactattatttttaaataatgcactattttaaaataaaatttacacaattatattgggttcctatcaaataaaccaatttcagatctatattaactaatatatacatgcccttaaacagatagacccattattta

SEQ ID NO: 101159 - DNA, 507 bp, Oryza sativa
cataaatacatatctgagatttttttatatattttgaacctttctttaatataattttaaaataaatcctgctaaacttatctccagatttgcatctttggccacaacaatgccatcctcattggtgtggcaggacaacactgttgcacctgttaaagcctgtggcatcacaaaacatatgatgtcacaccatgagcaatggcactatagtaactcgctaaaccattgctcaagaagtggcaacatttggttgctaggtgtccaaaaccttttcttttttaatgaaatttagctattggtagttttcaaatttaaataagtaaatgttctaaaaataaaaagaatttggcaagatacaaaagttacatccatttgcagttacagcaagggaatttgtgcagatggtcctttttagagttggccctactataagctgtggaaaagcacgtaaactaaatttaattgctgtggaccttcagcttcaatattatttatttctttagtgaa

SEQ ID NO: 101160 - DNA, 516 bp, Oryza sativa
ttgtctttgagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatctt

SEQ ID NO: 101161 - DNA, 508 bp, Oryza sativa
caagataactgtactgtatacgcgtgccctagatgtccttaatttcaacttgctcgatcgtggtccatgaactgatcatcagaaggtacaatcaatcagtcaagcaatccggcgttacagctggctcgtcgtctacggcgccggcgtaaactgcagtttataatcatctcctcatctcatctcctgcgatagattgagttgagcctgatcccgtctctactttctcctctccagcctctcgaaagctaggtcgatcttcagttatctctctccaggttagtgctaattaattaattaattactgcttccaattcctgtgcaggcagtactgtttgttcaattgctccttaattagcttgggcttttacatttgattcatgattcacattggtctgatggaatgttggttactgatggtgtgtctctgttgatggataagcaagcttggcctgctggtctttctttttctttccttttttttcccttttaatacaaggctaggattttc

SEQ ID NO: 101162 - DNA, 640 bp, Oryza sativa
ataaccactgtactactctcccggtattttagcgggatggaacatattttaatacactatgaatccagatttatactccctccgcccataataggtgatgtttttgactttttatttacaacgtttgaccattcattttatttgaaaaattagtgcaaatataaaaaaagataagtcatatgtaaagtacttttgataataaagcaaatgacaaacaaaataaataataattctaaaattttttgaataagaagaatgatcaaacattgataaacaaaaactcaaaaagacaagtaatatgggacgaagatagtactactaaaatatgtcatagccacccaaaatttcctgtatattggaacggagggacgactactactatggatactttctgttagattattaataattctattcatttttatgtataactggattgtatttagatattaacaaataggattaaatatacattatattttatcttcaaaagaacaaaattatgactttctccgttcttgaattgatattagcactattcaagttcaaactttcactcctagtctttttttcttagaaaatttacaaatacttgaaaatattttatattatgaaagtgtgcaacatcataaatacaacc

SEQ ID NO: 101163 - DNA, 744 bp, Oryza sativa
tccactagctagtaaatgtgctgttatttagaacagttaagcaatggttctgtactattgttaacgatttgagttgcaatttgcaactcctgtatgatcactccaacaagcacaacacccatgctgatgatgctggcacagcaatatacttcctttatcttaaaatataaaagattttgaacagatgagacactttctagaaatacaatatatactctatgtctagattcatagtctgaaaagtatctcatcggttcaaaattacttatattttattttagtacggatgaagtagtaattgtgatgcagcagaggcagccggaatttctggctatctatgacaaagctgacctttgcaaattgcaaattgcaattcaaacacattaatgcatggttcacgataactgcaaagttgactactgaactcacggtgaaaattggcaattttttaattcatggctgaattagtgccagattgccacttagagtgataaatagttaaatatctcacaacccctctcacaacaacctggacggtgtcgctgatggcgtattgagctagctagctagtagcttagttgtcgaataccttaagggcaactaggaatggtatatatagagaagtttaattactataataatatacatagaaaagttattttagtatgataatgcatctaagaattaaagtcaggttttgatgtctgctaattgcttccggtcctcttatttggaaagattggg

SEQ ID NO: 101164 - DNA, 501 bp, Oryza sativa
tggtggcaaggagcagcacgaccagcggcatggcgccgccggccatggctgcctcaatcattgtttggctttgaggggggaaagtgtttgggggtttggtaattggtagcgtgtcgtaatctttcgcgccatgtgaatatgtgatgatgtgaactgcgattttgactaatgacggtaatcaaggagaccatttgactactgctcacatgaaattggctgtgtttagttgctgggccaaatctttttaagtattcgtacacacatttaaaatattaaatatagtttaataacaaaacaaaatacagatttcgcttgtaaactgcaggacgaatttattaagtttaattaatctgttattattaaatgtttactgtatcatcacattgtcaaatcatggtatatttaggctcaaaagattcgtctcacaatttacatgcaaactatgcaattgatttttttcttctatgtttaatgctccatacatgtgtccaacattcgatg

SEQ ID NO: 101165 - DNA, 519 bp, Oryza sativa
ttagaaaaaatgcttgtgcgttgcaacgggtgaatgctattttaatcttattattgttatatggtttagctaggatgaaattcactatgggaattcgcttggatatttttttttagaaaatcatgagctgcaattaggagtctgactttcatctcaaattagcatgtaagtttttttaaagaaatctcttatacaacttgttttgtatttccaaaagtaaataaacttaaattcaaatttatacacgaatctgtatttccaaaagcgaatttataaacccactcaaatacagatgacgtaagaaaataccggcaaaaaaatctttattttttataacagtagagatatggcgttggaaggacaatccatgtcacaatggattcatggaacaaatggcatcttagtatcgttactctacatatattaagtggacagttaatattaagatgcatgggactgatttaggtttacttaccatagtttgtgcgggaacctgccagaaccaatctggataattcc

SEQ ID NO: 101166 - DNA, 673 bp, Oryza sativa
tagctttagtgggctgtaactatatagcaggtatagatgtgacgatggccatttgagtgaaatcttgagttaattaaactatccataattacactagttaaaagtttgcgatagagaatgtttgagatatgagatctattaaatctaattgatggataaaatatacattttgacttagaacagactgtatatgctccctcagtaaaaaaaagtcctagttatgaatctaaacataaaattgggttagtcaatcgattcataaccatctttcgagcactatattaaaacctctttacttgcccgatcatatcttagatctgtaaattatgttatggtctacgttccactcatagcgatgtgcttgagtccaagggacagggggtcgtcttggggccagagagaatgaatagatagggccccacgagttgttaattggccgctggggaattcacatgaaagggaaggacttattctgaaccaaaaaagtgctcactaaaccgaacatgaaagttgttttccatcgttttccatcataaagctgtgtcacataacttcacttttgacttggattatatatcccatatatccaggtaccatattaagatgtgattggcattcctcggcaagcactggtatgtacttaccgtataataattgctccacaagtactagt

SEQ ID NO: 101167 - DNA, 645 bp, Oryza sativa
gttttggattttttttaatctcttaaactatgcctttctattataatatatagaataaataaaaaatatttacttatattataatatttttaaagactattatatatatatatatatatatatatatatcttgttgtattgtttttgaactaaatattttgttcttgttcaagcggaaaaaagcgggaattttttttagtccgtttgggaaaataaagtctatgttaggaaagatttttcattttttagtgaaatatctaggaagtggaagaagcactttagtggcttctgtggatgctttacttctgggatcgaagcgcgcttagctggcatgccaaaccatttagggtgtgtttagttcatgttaaaattaaaagtttaattaaaattgaaaaggtgtgacgaaaaagttgaaagtttgtgtgtgtagaaaatttttaatgtgataaaaaaagttagaagtttgaagaaaaagttgataactaaaccaggccttaggttggaactttatgcatatgacattacattagtctcttaatatcggttatgtcagggttatgggtgcttccaaaagaaaaaaaaaatgcatgattaattacttggtgaactactactccatcgcaggaagacaacatgatttggtcg

SEQ ID NO: 101168 - DNA, 1024 bp, Oryza sativa
gactactatagggcgaattcgagctcggtaccccacgtattgctgcggaatatttacgtgttaaatactccctctgttttaggttataagacgttttaacttggttaaagtcaaattactctaagtttgactaattctgtagaaaatagtaataatatttttaacccaagacatatatatgatgaaaatttattcaattatagatttaatgaaactatgctggtattgtaaatattactatttttttctataaatttagttaaacttagagtagtttgattttaattaaagtcaaaatatcttgtaacctgaaacggagggagtagttactatcctggtaaggatgtgcattctaagaacatgttagaaatgaaggcaaccaccatttgaaatttaggttgtaatgtatatattaattgagaaatctcaatacatgtgtatcaaataattaatgcggttatacatttaggtttaatatatgagtgtgctgcaaaggaagagattagtcactcaaattttctaaaagaagaatcttcaatacagagtgaaaagggtgaagcagtgaaccatgcttccttttttctgccgttatgttggactatactaaggtagtacttccatgttagcgattgtccgtcaataaatgttaagataaaagatttacttagcactagtacaaatattatttaataactaagctgataagcaagcttaaaaaacagaggatgatataatgtaaatattttaatgcaccattagataccaaaacaaagctatggcgatgaaaaacaaaatacctgtctcatgatagaaagattagataacacccatgattagatcagctccaggagattaggagaagagatgaccgattgtcatatagaaccaaactgattgaggataaaaccggggaactgccatgagcctgacaatcgatgtgagataaaattggagaactgccatgagccttgacaatcgatgtgagataaattgcttgggtgtttgaaatcttgaatgttacaaa

SEQ ID NO: 101169 - DNA, 590 bp, Oryza sativa
ccactagctactagtagcagcaccgatgcaaccatatgtgaatgtgatatgcattttcctatttcttagtagtatcagagcgggcacataatttttgatagtggtattcaaacattacactaatatcttatcgatgaaaaattaaataagatatattttttcaatttaaggcttaaaccatgaggtatttctaaaatcatgatctcccgtccctgatagtagtaccgtcctttttcagcagagtaaattaggcttgccatattttcaggggtgaagctaggtagaagagggggtgcctagaaatctgatcaagaaaatatttttagctataattcgtctattttcatcatatatgcaccacctcaatccaaactcaagtgttcatatcagtctaaaattagtctaaagtagagtaaagtaagtgccatccttcaccatttcgttctagctctgtccctgtccctgggccctgtatatatcacaactcacgagccatgcaatgttgggctgtgggtaattattttgatcaaaagtcatcggtttttactgcttccatcagacgtcggtctgttttcggcaaacttgtcagg

SEQ ID NO: 101170 - DNA, 743 bp, Oryza sativa
atgcaactttggtgagacagactacctgggtactgacaaaggaccacgcatgctgctgctggattcacttaaaacgacaaatccgacaaggttgcgatcgaatatcaaaaggtctgatcctttcccccttcaatatgggtctcttgataatacatatagatctatattgctaccagcaatttgaaatattaaaaacaactgttcttttgttctgtatgggaatgcaacaatatatttttggaacttggaacagcccagcaggtggacttactagatacctgtttctctttaaccataatggatgttttttcaacttcgatatatccaacgttagacccaatataggttttggacacttggacaatgtttcggtaattagggtgcttgttgtcacaggcccacaatcagtttatgctgctcaacatagccacctcaaacttctgcctcttgcttgtgcctactgaggccttagtagtttgttttcacagggactatttaattatacaactcaacttctgatagaatataagcgacaaacttgtgtacttagagtctcttagttaaatttgattcttccttttttttgctggagtaccagatttattgctgatatttttaaaactgaagagcgggaagagaatgagcaattcattaacaaaatctgtcttgagtttcctgaggtatggtgtttaacatctcaaagtgcaccgtttcagtttctgcatcatgttcatcttatctga

SEQ ID NO: 101171 - DNA, 665 bp, Oryza sativa
tactacagtgttttatggtttcagtcatatgtcgacgagtattacgtataccattatagagctattaatcttaatcatatgggggattttatctttttcaccataagatactttatattcgttataaataaattttggtccatactaatacgtgagatactaagactactaaggctgtgttcggatgtgaagttggaaactcacctcccacgcacgcaaaacggagtaccatattttcttataattaattaaatatttacttttaaaaagatagattaatatgattttttaaagcaactttcgtatataaaccttttgcagcacaccgtttagcattttaaaaagcgtgcacgtgaaacacgaggaaggtgagttgcgaaagttggggaagaacacagcctaaatggctgtcgatgacagcaaaattactctaaccgtatgtaatagtgtgtaaaacagattttgctgctcagatttaatgtatttatcgtggaaaattgtatgcatttctcgaacagcataatccagctagcttccagtttcaaaacacaatctctatggtagtatggttccatcgaggtcatcacagagctagaatgtcttaagaatgaaacttgtcgatgcaccaacttttttctgactcatttaatactgaagtttctagt

SEQ ID NO: 101172 - DNA, 654 bp, Oryza sativa
agcggccttcatctggacatgttccgtggctcgctctgccaccgcatactctcgtttactaacgctttatttagtcctttaaattcttttataaggttttttaaaaaataattaaatttataaaaatatagtaatatgtacaaaattaaattaatcttattaaatataccattgaatatatttttgataaaatatttgttttgtattaaaatattgatatattttttctataaacttaatcacactgtaaaataattaaaataacttataatataaaatggaaggagtagtattttttttctgatttactagtgataaatccctggccataataactttctattaaaaatgcatcattgttacgtaatattaatagaaatcaggattaatttaaagcttggtgagtcatataccacgactccattaccgtttatgtttgtactttctatctaagttttaattttcatttgtgataaaaaaataattttcatttgacaaaatgtaactcatctgctttgaacagaagacagcagcataagcctctaaacgtggaaacaaatgaaaatattaaattccattgacgggagaccagaaatatagctttccgcctctccctccgtccttgaagttctacagctcaagttttgttttaaa

SEQ ID NO: 101173 - DNA, 687 bp, Oryza sativa
  unsure (1)..(687): unsure at all n locations
tttggttgtatgtgacttcccctacctgaacaagctgccactcagtgtattattttttggtacttattcttttttttgctgacaaaccttgcgctgctaatttcaaaactatgttctgaaggggatacggtcctggggagtgccttatgnaacactatcttacttgttgagtgaagatgaccctgacatgtgcctgaagtatgatatgtgtgagtatatcggggcatatgcagcagaagttttaccaaagtttgagaaagaattttcttgcaatacagctggtcatgctgctgaaaatggcattactgctagtgacaaatcagagaagcctatagggtatggtctgaataatgaaatgatattttgtttttcttgttccgaatattaataatgttgcatcagatgagtgacatttggtttttctatactatcggtagggtcagtactgttggagatctgaattgtgaataacccgattcgatgggcaagaatgaacgcgatcttaaggacagtaacgtgaagtggaattcgaacatgaagaagctgaagaaggcgcggaaaagaggtttaagagggcggagaagaggaggttaaagagggagaagaagaggctgacgagggaggagaagaggaagtcggaggatcagaccgaaggttgaagtgtgaaagaagaccaaaacatttagt

SEQ ID NO: 101174 - DNA, 549 bp, Oryza sativa
aagggtcctatatattttaccccgccggctccatccccttaaaataagttcatttttcacccatatcccacgcttagcaatacaaaagcaaaaagaataaattataccaactttattaaattccattgtaattgtctcctactttatttagttcgaatgcaattattctctatttttataaacttcgataccatgattgttaaaagttaattttttaaggaaaaaagaggacaaaatgttcttattttaaaacggagcaagtaataccaaatcggtcgtggtataaacaccaacatataatcatcgagtgtgtgatagtgataccaaatcggtcgtggtcatcaagttgtggcgcactaaaaattcacgtactaaatgagacaaaccaagacaacaggagtactaacagtagaacgcctgaaatattcaaagtactcaaatgaattggtcaaaaactacggccctgtttagatcccaccctaaaaattttcactccgtcacatcgaacgtttgaatacctatataaagtattaaatataagctaaaaat

SEQ ID NO: 101175 - DNA, 654 bp, Oryza sativa
gaagtttcagaaatgatattgtttttcataattttctaggcttgagggtgtactggactttgaacttggaaaagtcggcgctatagtttgtttgaagggttcaaaacggtgagtgataaaaaggaccctgctattcatcttgaggttgagcatgttactgcttcgctgcatcttctgcaagtctaaattaaaagaagttttccctgcaaaaaaaaagaaagaaagataagcttgactgcaaacatgaattttagtaatatgttgacatctcagaatgtggtcttcattctttgttgatattccagacgttctttctctccattgcgaaacctgcgtaatgcaaacaatctactgatgcagggttgtgataggtcatcaggctggactagtaattactgaaattcgtaatgaacaacctggtcccagcaacaggtaaggatgttcaaactgttggtgccaaggcaagctggattggatgcagataatatggcacattgacactaaacttaactttagggaatatatctttcagaagaccaattgaacagtgtggagaggagacataaatagccaagtcctgtaattgggatggcaatggggaaaaaaatgtaatatgatgtagagtagttgatatctatgtagtctcaacctgca

SEQ ID NO: 101176 - DNA, 521 bp, Oryza sativa
ccttgtgcatacgttggataccggagctttcacctagtctagtcagcttttggttggaattgctttcaactggttaatcctgtccggtttgtggagtgctttggggggggggggggggggggatggtggctgtcgtaatcttagattaatttaattttcttggagatagtgtgctgtactcttgttatcagtattgaaagcacgactagatttttatgtgaggatggtgaagcacttctggaccatgtcaaatgactgaacatagctacggccagtttatttctgtactatatatttttgaaaattgctagagggcttgaatttccatccctccaatttgttgcagggattggtactccggttctttctccggcacactaatctctcacaacaatgtatattagtgtgggttggtgtggagaggtggcgccctacgctggtggtaggcgggggttggcaagggggtgtatacggtggtgttggtgttgggagtgggttgtggggggagggggagtagggat

SEQ ID NO: 101177 - DNA, 711 bp, Oryza sativa
aagataaattctgataaaattatatttattcatgataaatgaccttagatttgaataaattatttccccttacactttcatgcagttaaatgcacattttagttaggtatggtttaaaccgattaagaactataattagtctattattgactggttggactgatttattcgaggtatgaaatttagttattaaattataccaaaattacagtgagttttatatgttaagtaaagcctacatgaattttcccacgattttatcttacacgaattattttaaataattcgcaagacttatgtcttatatgtgtttccctttcctaaatgcatgtaaatgtttataaaagttatatttggactctcattaacctgaggtgatattgatatgttagaattacagtttaccttacacatgtcataagctccttacctatttatgcataagtttactttagtattaaatgaagagaatgcttatagagatgattaagatagaatataccctatatgatataatttatttgttcactttcatgttcatgacatgtctttagatggatgttgaaattagttttgtgaggcttgacattagccatgttgatatattttaaggtgtatggtttctattttaacttcctctagctagcactaggccctaatggtttacttgtttatctagatcttagttaagattcatgagacctattatga

SEQ ID NO: 101178 - DNA, 530 bp, Oryza sativa
tatttttcccttttattcaaaaaacttattggatttgtgccttatggcaaaagctggagatgcaaatcatatccattatcttaaaaaataaacttaaaaatttacaaaggaacgtttggtactttgatttagtataggatatggtccaagtgagtggttagcaaaaatatcatagaggggcaaccaatggatcggatgtccacctaatatttcatgtatcttagcgaagaactactattgcctattgaaactagcatgtgtgttgttcgtggttccttctccagtagtttggttgatgtacatattattgctaatatttataaaagatatccatgtattaattgtctaccttctttcagggttataattcaagttatcagaaggtgcttgcaaatgctgacatggacagagatagcaatagctcgacaatgcaaacacaagtccctactaatactagggagggaccaactttcacacaactactactcggagaccaagattttgacctaccaccatatgttcccgaagcc

SEQ ID NO: 101179 - DNA, 629 bp, Oryza sativa
tcaatattattaagattattatttctttaagccatttaatttaattctagttgaatggaaatttaactagaaagtatttatgatttcatgtcaacatcattatgatggtcatttccttaataacttaattatttatactcgaatggaaccaacgagaaatttgactagaaagtattaagatttgaagttatatttaacccacattattataattgcatgacaattataattttttattccttagttattttctaccaaatggtgatataattaaggaattaattttaagattattcataattatttatgaccaatggtgctttgactatgaaattctaagtttattttgcatatgattgattaagccatggtaaactaattatatgcaatcaccaattcttattatttaagatcacttgcaatactgagtaaattatttcaagataaatggaaccaacgggaagtttatctagaaagaaagatgatttcattaagattgttatttccttaattattttctgcccaatggtgatgtaattaaaggaagaaatctaagtattgtcaatccctattttaaatattctctgtaattttcgccctaatggtgatatgacttaagattttattta

SEQ ID NO: 101180 - DNA, 1950 bp, Oryza sativa
gctcaaccttatgtcgagcttgagcctaggccagcaagatcgcttgagctcggctcatcgacagccctacacacgatgtttaatgcaaatctaggttatgttgatatacgatatctgtctaatcgataatcagatctgttctgttaatgtgaatgctcatagcaagtgcccatataacatatttatatatagatttattgatatgaaaaaggagagggaaatataggtgtggagttttagctcttagtatatataaaagaaaaggtattaaaaggggaataaaaacaaaacaagggtatacaaaagtaaattatattggtggtatgtaatcttataaggtggatgcaactgagtacattaacttgcgaaacattcatttgaagcatgtggacatttgtagttattcgttcgccccagccaaaacacggtataccgacacggttaattttgtggaattggacgctgattagctaagatgctatgcacacacatatgtgagaaagatgacacgttggcacaaaacactataataatgctcaatgattgtccaattaaatatgatatagagcaagaggaataaagagtgcagtgatagtaattgaataagaataagagaaaaacaaatacatgatgcatgtgctaatagacgcattcatgaagatgtgagtgtgatgttacgtgtgtagtggtgcgtgtacatgtgtgtctggcgtgtaattaaaaagatagataatgctattgctaagtgatatagttcatctagctctaagagtaagaagttggagtatttgaaatttttctcaaatgtaaggggttgaaaagtactacttcatactaaattagttcattttataacaaaggaaacactactttatcttatcaatcagttttctttaactttctcctcaaaccacacccacctattaattaataagatgtattattgtcaattttctctattcttgatttttcgaaaaagaccaaaagtctcttatatttggaggatggagtaacatgaaacacacgctccttaggtgtgcacatgatgtcctaatcatggtttactttatcaagattgattataagttttgtgtttggtttgtacgcgctacacacgttcatatacaaatatgagtgccttacacatttatgcactagtctaaatttttgtgtatcgctaatacaattcactttaaaaaaaagttgagtattacaatagaagtaatctctaaatgacgtatatcagtctcaactcttacaccctcagcaccttcaacccataaaaaaaggaaaccggacgtcatggttgtgccctcctcctgctgcgtagggacccagcttcgaatagaggtggaaaaaagcttgaagtttgtggctcatatcgacttgaactcgtaaacttaatgagtcgagccgagctagccttagagcccgtgagcttaatgaactagcttgcaagctgcttgtttaactcgttagtagaagatatcaccatatcattagtagaagatatcaccatattttcatatacttagtattttttaactagtgtttagtcttttacttacatcagaaccattaatatttagtgagttatttattggttagtgtctatcatcatatttgatagatgaaaaataatgggaaaatttggaagatacgtgagttgcaaaataccatcgtaagtagggttggacccatatgtcgacacatatgatggtattttttaactccttgattttttgatggtactaggcaaattggccctaaaataataaatttgaaaatattaatacgatgtgaatgagatatatttaatgagtccaacaaatttaacgagctagatcatcataaatcaagtcgatcaaactaaacattttaagtcgttaacattaacaagctaaaaagctaagctcgttaaaatgacaagcttaaacgagttgaggtggt

SEQ ID NO: 101181 - DNA, 1041 bp, Oryza sativa
cagtttctaaccgaacccaacctaccagaaagaactcttctaaagcactgagatccaaactcacaaaatagcctaagtttaactggttaagctaatataaaccctgcgatccaaacgcaaagcagggggcatgcgggcagcaggcaagtccaccaaccgaagtaccaacccccgtggaatggatagaccgatcgatcggcgtgcgccaccaccatacactgatgcacaccgctgcaagcggcagtgaaagctgcagcggaggcgtgcacggccaaccacgtgagcgctgaatgattacgggctcatttttgggatgccgcaaccaccaacagctcctgtgccgccggtattattgcgcaggcacagcacatcatccgctccgcaacaaggctgctccgcagcagcagcctctgcacctgcactacgtctgcgtctctcaaagtcgccaaaagccgagactgccagatcaaagtaccggcagtaccacgactcggtcttgcatttcacatcctatatatggcgataggctcatgaactggaaacaggcacatgcacgcgtggaagtgagggggtcaaactgtgcctcgcctgcacgacggcacgagcaacgttcggtggaaagaggtgaaaggatcaaaggacgtctactgatactctgatagcatggtagatttggcatctgctccattcaagtcggccttgattcttcgttccatatctgacatcccgggtttagtacggatagcaagaaaaagttcagaaaagaatttacgagggaaaaaaaatcccacgcgagacacaccgttcggtgaaagggaatggaagacaaaagcctgatcaaattctctcttttcgtgctttgtagtcgtagtaactttggactgtacggccaatgagcgtctactttggtgaagtttgtaagagtaaactgtgcacggctagagcagaactactgtaaaaaaattgcacgcatatacttcacccctgtgcagaagacaccgagcatctcactgtataccccactggatttacagctaaact

SEQ ID NO: 101182 - DNA, 704 bp, Oryza sativa
tttttacatctatgtaccatgtatgctacttattaggagttttgagaaattctaaaaaccactttcaaaatataaatatgaaataaatcaaaattaagtcatatctagttaaaaaaacacaactaaattttatggttcttctttatagatatatatttaaattagcgtggtatatttttaaggggattttttacaccctaaaatatgatgtgaaatttttcggaaattatcttaacattaattattatttgtcaacccatgtgtcgtgatgtatttatgaacactatataatttttataatacatcaatacttcatttaattaaaggaatacaacaaatatcataaattggatatatattataaaaatattttaaaatgggaatggttatagaccggtgatttgatattttatatttatattatagatatatcttaactacatatgtctgggggaataaaatattttatctttggatggggaaaaaaaattctattttacatcaatttttttcaatgggattacgtacgtatgttttttgctctatcgtttatgctagaaaattttatttgactttttagatgatactacgtatgtattttttgcttttatatttttttacatgtggctttatcttttcaaccgtatgtatgtgggtatgtttttttctttcggcgagccatacctttttgttccaaatcatac

SEQ ID NO: 101183 - DNA, 603 bp, Oryza sativa
caatagaagtagttgatgttgtaggaggtttaacttcacagtggggaacacaactgcatgggggtcatcttgcacgtgtaatttcatatatccgtgcatttcatgacccagagcagcagatcctttccaacctcgtcacgcatcatctattgagacaatgttgaaccactatgcccaaactgcagagatgtcatattccatgaaatatccaaaaaatgcagttactcgtggacctcaaaatgtttctgggtttcctcaaaccaatggacagatcaacacactgaacaacatgaattctgagttccatttcttgcttgaacaagcaaagaatccagagaacaattccatgcgactcatcaacatcaggggccatctatgtgctttcaggtgcacacataactcatgcaacttttagtgttttatttatagtgtggttgtttaaattagcttctcggtaagaatatgaattttgtggtgccatgtgttgtttgaatcatatcttgcttagatgagattcgttggcgttactacgaagaaactattatgatattgaacctcatgccatatcgagcatcttatcccatcttaaagttggtttatttg

SEQ ID NO: 101184 - DNA, 747 bp, Oryza sativa
aaacttatgcgagcactgaagatgtatttttgatatttcattcctttgttttcatctgtgtcgattctctagattggcaagtaaatttatagggtgcacaagatcgaggagagatggtgatatatttttatactgattaagaccttggaagagataacaccctacttcagttggttgtaaattagatctgtatcaaagtgtgcccaacacggtgtgtgaatagcacgtaacacgtgtatgatcaccctaattgtttccggcctaccgttatatagacataaggaggccggctacggtaggtagcgtaccccatattatccgggtacctaccacctatttatatcggataaaaattaaattcttatctttgatcccttttactccctctgttttggattgtaagacttttacatctatatgaatatgaacaatgcttgaaagtcttacattatgaaacggaggaagtattggattacaatgtgccttatgggcttaaacttcttagcccaccttatgtaatatagcccaaaggcctaacctcggttactcgggtaccgggtcccctacaatctgcaatccacattacgtttgtttgttgacaaaactatgttgcaagactgccacgtctttggtttttaatcatcaaacgatcgtactactatttttttctctaatacgtacatagcctgatacagtgaacgagtgattccaaagtcatatatatgacaaatttgcaacacattacgt

SEQ ID NO: 101185 - DNA, 1123 bp, Oryza sativa
  unsure (1)..(1123): unsure at all n locations
gcacatcctgggaactagattcacatgagtgggagttaggaatatttgggaggttgcaaatctttacccatttttgtcaagtctcctgaatgtgtaacacatctggtcgccgccttcaagtggtttgacgggcacatctaaggctgaagttgactggcaggctaaggcccaccatgtcttccatattcctctctcgaggcgtccgatggttcattatgcttggttgatgacttgaattattcacttcatctctcaaatataatggaaggtctggagagcctatgacagcatggtatcagaacaaataccgactacaggagccccttaagttgtcacttaaaattgcttcttaaaaattattttgagtgctatgctctcagttacaaattatttgcaaaaatcatgttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctctgaaccaaaaatgaatttggtgggattttgtactttcctctcccgatatttcaaaatttcaccggtatggcctaaaatgtgtagttgggtatagaatagaatttgctgtgcttaaccctctagattgtttgcttagatggaccacccaaaattcatctagccttggaccaccctaacataatacgactaaaaggtgatanaatttatacactaaaacttgattaaagtttcattttgtgccggttgttcttttttttttctggaatcttgagtcagtctgcttgttatttttgtctagactaaaccgtaggtgataaacctgagaattttttacatgcatcatgtaaactaacccagtaagcatcatgaattttggcataatttt

SEQ ID NO: 101186 - DNA, 510 bp, Oryza sativa
ttggggggaactggggttggggggggggaattggggggccttggggggggggatggagccaaaaggtagtactgaccaagattgggtcttggcgggcaccggcgatgtcagctgcgatgacgagacggtcatggatgctaccaaatgtcaggcatttctctatcacattcgatccgtacttttgacagctcatcataaccattaaccccttcaacctcatcaccatcatcgctcgcactgactcccctccatgctccacaacatactgcatatatatatacaggcatgcatctatgtgttactatacgacacacacacacacacacacatatcaatatttcatccatgtagtaattaaaacacaatcaaatatgcttcttaattgatttctttctctagtatttcacattaagttataggacatattacttaatattattttaattagcagagactttgtctactgtggttcactggaggagaaaccatctttcgtcggtcgggctaatt

SEQ ID NO: 101187 - DNA, 1318 bp, Oryza sativa
gttcctccctcgtcgcgatattttggccgccgtacggagccgctgccaccgcggggccgacggcaacgtggtccctgagaggcgggggcccacgggctcaggaggggaaggagccaatcgcggactgacgcgtggtggggccccggaggcgtggaggcggtcatcggggcgcgggtggagggaggtggggcggcacgtgatggcggtcggtcgtggcggaaaaaggaaatcccggtcaaatcgtcgggcggagcaccggcgtcagaggccctctcttctgacccccgtagcactaaactactcgcactcgttagttaatcagctcgctcactcattcggtccttcctgccgcgtgcttagcgggtcggaacccgctaaatcatacgtccaggttttccaaggagcagtaaacttgaagcattaattccttggttgtgtcaagcagcaagtgacattccggttagtatcttgctattgccatgatgatctcaggtgctctaattttgctatctcccggttatgacagatgttcgtagatgggattgtatctgattttgtttgcatgctcgatcaatttcgacagtctggagatacccttttagtactcattctagtagagtattgtcgaggtttttttttggaacaaaggaaaaatatagtaatttcagggtcttttggattgcagtttttaaaggaaaaaaaaattcctacatccattattccagaggaaaatcatgggaagaaaaaaaaaatacactcaaacctcattctttttttcctactcaggtgatcaacattctttggtaatgtattacttcctgtagggccattagtgataatcctataattcctatattctttgtattcctatgttccaaacaacctatccaacggaattcatttgttttctatttcctctattttacccatgctataatcctatatattctaatgatttttctattcctatgtttttctacgtctctaaaagaaatcctatgagactctttggaacgaatgattgggtcgctagaattcctttgaaattcttatataatggtatatttcatacggatttttggaggattcttagtataagttataagctattaaagtttacccttgtgtttatctcccttatctaaatcctgtgtattttatgtgctccatttaaacagttcccaatttcaacatagagtataatcctcatccaaattcctccataggaagtgtaattaggtggtgaggtaaaattatataatttgcatatttgtcattgtcaaatatcaatctgctcgggaaacatctaactgcttgt

SEQ ID NO: 101188 - DNA, 1747 bp, Oryza sativa
atgtgctccatttaaacagttcccaatttcaacatagagtataatcctcatccaaattcctccataggaagtgtaattaggtggtgacgtaaaattatataatttgcatatttgtcattgtcaaatatcaatctgctcgggaaacatctaactgcttgtgccattggatccgacactgtggaaccaaaatgccactactgtcatacatcaagacgtactctctgtttacacccgaatttgacacctagattcaaaataggaaaacattatcaaaatttggaaggcatcgggttttcttcacagggccaggctgaccgtggcctatgggctagacagaccagcagagtccgacgcttagtccgatattgttgggtctcggatttccttactggaagatatgtttcgggtttcctttggtttctatcctgagttggacatggagaaaaacctataggaggcaaaaccaacccctttataaggatcaagaccgattcgattcaagaaccccccaccccccaatctctcaatcctacacaatcgactcgttcttttacctttgtttttcagccatgtcttttaatgtactctagtttagtccatttttatcgatttatgctataaatcgtccgttgtcgccacaagagtgcgattgcccctttgtaggtttgtcccgtaagccttctgttcgcctatgagatgggtggttatcttcaaatcgttctaaatcggcctcgtggctggttttgatctctaaatggctccgctagtcggtttaatcttcaaaacccatcttggtttagagttgtctatatcgaggtggttgacgagtctcgtgttgggatcgaaaaagacgccttgttgtttagtatgagatttactaaaatgataaataaattaaaacggacagagtataaattctaaatattaggaatgctaagatatattccatccgttaaaaaaatatatttcctccgtttcacaatgtaagtcattctagtatttcctacattcataatgatgttaatgaatctagacatatatatctatctagattcattaatatcaatataaatatgggaaatgttaaaatgacttacatggtgaaacggagggagtaactatctttaaactgaaatttaataatacgtcaaatgcgagctcatagtaaagggagctatattttgaaatggagataatataatcggattgcccttaattaccgcttcgaagctccttattggcacggtatttgaccttaatttacgaagtaccttgcggtagccctgcttcataattttgcctgtactaaagtagttcagcggatttatatcctcaacagtctatgcgtggagtattaagggtgtgtttggttgcaagccacagtttgccacagtttgccacgcctaaggttaggcaaatttgacaggtgtttggttgtagtcacagttgtgacaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccagtcatgggcccgttaagttttgtcccccccctttcggagcttttacttaaaaaacctagtagtaagcacaagtttaatatatgaacacactcacgcacacacaatctctttaaaacagt

SEQ ID NO: 101189 - DNA, 613 bp, Oryza sativa
aagctattagcatatgaataaataaattttaattattaccaaactgaaaaaagggatcctttaaatattttgaaccacttttaatataaaaagttttcactcaaaacaagtcgtttaatattaaaaaagcgtgataataaaaactaaggtaaaatctttatctttacaagaaatgaactaggtcatagtgtctatctatttgtagctcgcattcaccatgcaaaatggatgagtcgtgtacctattttctcggttgtcttattgttgcaattgcttattaggcaaagcaaaataaacactccccttttttttccccttgacttgactagagtacataaaaaccgacaatcatttcttactagaattaaccattttgactctagtatacatctttagtgctgtgtgtgggaatggatgataagtattttttaaagaaataccggctttactatatgttaaaacaagaaatgatactacagatgttagcttcgtactataccaaaatgcaagaacctctccgtcaattaaatataattttttttgtgaaatcggtgataattgggcatcctcttctttttacttttaggcaaagcatgagttcttttttaaaaaa

SEQ ID NO: 101190 - DNA, 1027 bp, Oryza sativa
ggatttgttttggagggtcgagattcaccctatgtcacccaatctgaatccctactccccctccccccacaacccactcccaacaccaacaccaccgtatacacccccttgccaacccccgcctaccaccagcgtagggcgccacctctccacaccaacccacactaatatacattgttgtgagagattagtgtgccggagaaagaaccggagtaccaatccctgcaacaaattggagggatggaaattcaagccctctagcaattttcaaaaatatatagtacagaaataaactggccgtagctatgttcagtcatttgacatggtccagaagtgcttcaccatcctcacataaaaatctagtcgtgctttcaatactgataacaagagtacagcacactatctccaagaaaattaaattaatctaagattacgacagccaccatcccccccccccccccccccaagcactccacaaaccggacaggattaaccagttgaaagcaattccaaccaaaagctgactagactaggtgaaagctccggtatccaacgtatgcacaaggccaagtgacacctgactacctgagactgagatgacaagggcagccagggcgggcaccaattttacagtcttccaaaccgcacaaaccaggggtcctatggagcgcaataattttacacgtaacagtccacttgttacctaacaaatagtgaaaccgggaaaatcggcgttccaattactcaactctcaccttttcccataaataatttcatttctgtttgaaataacgaaaaatatactagtagtaaacttaagaaacgtgtacacgcttcctacgtgtggccataggattcgcttttaaacccaacaggaagcaaaagaaagccgaaccaatgcatttgaatcactgctactacgacagttttgtttttttttttggaggtgaattgctactaccacgacagtagaagtatgataatatactcgctacaagatcgaacagaggatcttccggagtccgga

SEQ ID NO: 101191 - DNA, 704 bp, Oryza sativa
tttcatacccttgaaaattgcccgatcccttctatacccctgaaatttcaacttgatcccttctatgctcctgccgttacattttcctttattccatggttaagtttggttgcaaatgtcttttatgcccttgatgatttatgtttgaataacgttgaaaaacaattgaaaatttgtttgagtgcatgcattttatgaaactaaagagactaaataattagttcagaaaattttgacataaatttggaaaataaaacaaatgtaataaattaaaatttttatttgaacttttaatagggcagtgttttttttatcgggagcattcatagaaaaatatcgtgagcatcggtagttctaatactcctcattttttatgactttataaaaaataaaaataaatacatattttttatttcattatctaaaaataaattgtcacgcagaacaaactcataattataacagtctcatgcaacaaacttttatattttcaataatataattcataattttctatgttcatccaaagggtaaaatgattatttttatagaaatttgatggtcaactaatggtcaactgacgaaaggggtatgaaagggatcaaaatcaaattttgaagacatacaagaaagtaagcaaaattcagaggcatagaaggattagctaagattgcaggggtatacaagggattttcagatttttt

SEQ ID NO: 101192 - DNA, 1296 bp, Oryza sativa
ctattccgtgtcgtccgtcgtttggtgatcgatgtgatgataatccaatggacggttttcaattaatggcaaataaaaccgtccagacaagcttattcaatatacatggagtatataggtatcaaatcgatccatatgccagcgacagcgagcgatatactggcagttttaattactactcatagccagtactgttattactgtacatgtataaatacggccgggatacagctaacctggccataaatatatatattgctgcccgtattcctgtgagatcgatatatattgctgaaaagaaaagaaataaagaatgagtcgtcatcaccagcaaatatgtatgcgtgcgtttaacttttgaattcatgtcgtttgcgcaacagaaagaaaatagtccagcaagacgatgagttgtaaaattttgtttgtatccatctacaggtgatggttggcgtcgttccgaaatcaacacgaaagagaagaaaaaggaaagaaaaaggttggcgtcattttgtagtatatacgtgtaggtgtatttgcttaactacgacgccagcatcggcctttatttcttttgagcatgtagttcgatgggaagtgttagctagctaggcatgtagacacctggcatggcatgcacagcctccgaggccagaatagttgtgctgatgatatacacacaatagatggcacgcatccacgctcgatcggttgatcgatctgccttttgagttttgtacacatccatcttttcctagcatgtatagcgaaaaagggcaagtagtaaacatgtgtacacgcgttctgaacttgaagctattagctatatatctatcttcctcacaactctccttttaattagttcttccatttccacaactactccatatttccttttttctcatttcttcgatttgtgcgtcgaactgcagctgctggtatccagccgccgcttctccgtagctactttcaggccggccgaccgagcggacaggtaaaccggtgtggttgtggcggacagccgtctatcatctccgtaggttgttctatttgatccatctatgcatctgtattgtattgtattttcacgcatgtatgtcttataatatcctcttatccggtcattggtcaaacagactcgcaccagctgctttcgctctcccttattaaattttcaccggcgggtcggatcgcttttccccttttttttggtttcagatctacacccttgtaaaaaaaattgattccttggttaaaaaaaaattaaatcatagggacatatttagataagcactg

SEQ ID NO: 101193 - DNA, 1483 bp, Oryza sativa
tatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactatcatctctaacgggtctagattatagcccgta

SEQ ID NO: 101194 - DNA, 1078 bp, Oryza sativa
aagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaa

SEQ ID NO: 101195 - DNA, 538 bp, Oryza sativa
aaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgc

SEQ ID NO: 101196 - DNA, 863 bp, Oryza sativa
acgcccggtcggctcggctcggcctcaaaccggccgaccggttatggcgagggcggcgtgcgcgcgagcacggtcgccggcgacggcaaccggcggcgggaggcggcggcggacggcgcaaaggcggcggcggcggcgcgcgcacggaggcagcggcgatagggagctcgggagcggacggcgaaagagggaaaaaggtggagagaggcgcggtggtcggttatatagaggtggggaggctggacgtggccgggagcggcggttccgcggcgacgacgtggagaggtggaggaggagagagagggggagaggattcaaatcgaatcccgtccgtgcgggcgcgcgcatggacgggagagggcagggcgtggggcggcgacgtggggacgtgtgggcgcggagtggggcgcggatgcggaggaagcggcggcgtgggcggcggtttcagcagcggatggtggcggctgccggaggttagggacgaccgacaggtgggccccacctgtcggcgcccgggaggagaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaattt

SEQ ID NO: 101197 - DNA, 612 bp, Oryza sativa
tccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggg

SEQ ID NO: 101198 - DNA, 837 bp, Oryza sativa
tgtgccgccggtcagaccggccttatgcgccggtcagaccgccttcttgcggctggtcagaccggccagggcacgccggtcagaccgccactatgtggctggtcagaccgcccctggtcaggccgagccgagtgaaatattgtgtgtgcgcgctatgaagatgtgagcacaagtgaaaatgcaatgacctaatgtggcaattaaaatcatctctttgctaggtcattacccctcttaatagtacggcgaaactaaaaaataaactagcaaatttgatcgccctacacctcgatcaattctaaattaaagcactagttttaccgtcttcttttcttcgcttcgcgccatcaaattttaatccatcgatagtcatccatgcgcacacatgacgtcgacctaacttaaatatatagctcaaagacaacggttagtccacaattagcgcttgtcattaattactaaaattaacaccgggggcctagatgcttcaccgcgtgctgcccctcctcgagccgccgccgcgtcccatgcttcaccaccactgaaaccgcccctggtccggggtccattttatgccggcaggttcccttggcgccattaccggcaatgagggttctttttcacagtgcgaaagccaagattgaaaatgaagggcgccttttcaagccaggccaattcattaaggttagtgaaccaggaatttggaagcgttaaggtatgatcggtaactcgatatcatacatattccagcgattagctccaagagagaccaagaccccatatatcatgatttgccaatttaaaattcagtaatatttttaatatatggatgattga

SEQ ID NO: 101199 - DNA, 759 bp, Oryza sativa
atatcgctacaaaccctctgtaccatactcatatccacccggtaccagatgtcactccagcacatcacacataccatgcgcttgagagcaaggttgtgatggatacggtctgtgattatattgctaatagcatgtattagcatttcatatttgccagtatttgcttgtgtaatagtagtggactcatctgctgtaccgtgtactgctattgatataatctaatgatgtatgtgtgtgcatgtcattcatctgcaagttggcaagcaaattaatgtaccctgtagcaaattaatgtacccctgtactagttcatccttctatcctcatcttcatccgatttttttcgaggggataggcagggagctcctgcaatttcactatagaagaagagagttgatccagtttataaagaaaatcggacccaaaaaccttacagcagcacagttaatttcaggaaaaccgacgaaaacccgacattaacaaactgaacgcaaagaacaatagcccaacaagggaagaaacttctagaacgaagccttcaagaaggtaacgccgacagaacggtgacaacgtccgatcctaacgaatataaggttttcacccagagaattcccttaaagtggagttgaaatgagggctccaaaagcaacgccttcaagaaggtgaatggtgcccgagggcatcgctgttactagcaccggagcggagcaaggttttcaccccagagaccctgtcaaccaaagcatccacaacggaagc

SEQ ID NO: 101200 - DNA, 1283 bp, Oryza sativa
  unsure (1)..(1283): unsure at all n locations
gacctatagctcactataatactcaaataaactcaagcttaacttagtgagtgttgattgaaaaattaagtccccctcatccaggatcttagtaaggctctaatttacatatgtactggccaaaacataatcttaattaatcttaatttatgagcctttagaatatggatccattagcaaatgcttagcttaataattcgatcatgggacatgtctttcacaaccatatcaatgtgttaggcagaaaacacacaacatgttgctactagaatagaaaactgtgtttaattagtgcacaacttataacagtatattttgggtggttaacatcttttgagtggtttatgagcgctattcactactcttagttttgggaaatatgattaatcataacacgctttaaaatctaacttcatcgtcgactatgcagtaagagattatttttggagcttttacatggttattgctcccctatgtgtgaacatagcttaatctgaataatcttcataaatatccacacatctcataaaataagtgtccaaatatctctaaacttctgagatcaatggactttaggaaaaaagagcatgttacttaagattgtcttgcaaataatggaaaacattattaataccagtggtttagtctggatttaattaaatactgccaagattcccagtaaaaaaaagtatgccaaatctgtatgcatccagatttgagctattcccaagcttcggtcagttgattcataaatgataatcttggtaacttaatgtcagcttgactaactttaattgaattctctcaaattatttctttatgtcagtgtatgacttactgatataaacccagtactccttcggaccaaaataattcatggaaaaaaattccttagtttctaagagcaatatgcattgcttgacaatanaatgtcattagaatggagtaccggtgaatgaaattcccacctttaattttcatgcacctgtccacctcacttgaattgtttgaaatttccatcagagtcaggcttaattttattaacccacttaaatggcccaatattttgactcattcagaaacttctactaaattctttattttgttcatcaatctcaattattcttatatggttcgaaaaccatttatatgaacactttaatgtcttattttgttcatccatctcaatttattcttacatgattcgaaaactattgggatgaacgcttatttttaatgtcttataaggtgaacaagctttatttagtgtttaccaccataat

SEQ ID NO: 101201 - DNA, 976 bp, Oryza sativa
tcaaggaaagttttctcctcccatcctttgaacacattgaatcccatgatttgaggaatgaaaatatttgtttacaaagttgcatgtgaacttagactatatcggtatttgaaattgggttaaggtagttatgacctatttgctacatattccaccttgaataattgatcctcttgctgtttgaacccctagaaatggttagagtacactctttgtgctcaaatgggtttatatatgctctatgtgcaactacttgcttagccatgcttagaaatatgcaaatgctcattccatctataattaaaatgtggtttgatacttgaacctttgctggaataaaatgaatatgatgagtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaacttctgcaaagttcttttaactaat

SEQ ID NO: 101202 - DNA, 645 bp, Oryza sativa
ttgtgtgccaggcttaacttgcgtggaacgttagcttaaatcagcaagtgcttcgtttaagagctgagaatcataattaggtctactcctactagatgctgataccgtttagtgatgacaaactggagttgtgttcttatttgacgagccgagtttagatacaaagtttctcttcgaacttcaggtgtgtgtagttaacgttaaaattgaaagtttggttaaaattaaaacgatgtgacggaaaagttggaagtttgtctgtgtagaaaaattttgatgtgatggaaaagttagaagtttgaagaaatattttgcaactaaacacggccttctaacttttctatcacatcaaaactttcctacacacacaaactttcaacttttccgtcacatcgtttgaatttcaactaaactttgaattttagcgtgaactaaacataccctagaatgtttactgatgccaatctagctatccaataaaggctgtgttatttcacacttaaactagaagtttggatcaaattgagacgatgtgacagaaaagttagaagtatgtgtgtgtacggaaagatttgatgtgatgaaaaaagttaaaaggttgaagataaaatttgtaactgaacaaggactaaacacggcgaaaga

SEQ ID NO: 101203 - DNA, 591 bp, Oryza sativa
aactaacttttttacacctatttaacggtcaactagtggtcaattgatggcaagggtatggaagcgatcaaaatctaaagttagggggtatacaaggaagcgaagaaaatttagcgacatagaagggatcgactaaagttttaggggcatagagggaattttctcaagattgtatggaaaaccacttatcacctatacttcagattttgttaggtgtaagagaatctccaacagcctctccaaatgactctccaagccaaattttagccattccagtgaaaaaaacacccttcaacagcctctccaaccggatggctaagccatctggctggccaaaaccctcccttccactagccaaatttggccagccaaaatgactagccaactatgggccctacgcacattaacatccggctattctctctcgttgttgcacgcgaccgcaccgggccgtccgcggtctccgtcgtcccgccgcgaccgccgccgtcgtccgggttgtcgccggccggggcctccgccgccggagtccgcgccatcgaccgccacgaccgtcgtcgccatttgcgtcggtgccgaccgcgacctccg

SEQ ID NO: 101204 - DNA, 601 bp, Oryza sativa
accctttttctggatgggaacatgtcagtttcttgcggctatgagatcttattgccggtgagggaggtaaatgctgcgccgacggaaaggttctcaagctggggatccctgtttccgtgtcatctatgtatcttcgagctgtctttttctgacggatcttgactggagtatcttgtccctgatgatcagtcgttccacgaatgcggaaaaaaaaaacgctggctcgatgcatcggcttaaattaagttgctccctatcacccccataccaccatcgatttatccaacaacatcctccaaatcacaaaacacaaatcacccatcaatccatctaacaacaacatcccctgcacaaaatcacatagcacaaatcacaaaaatttcaaccggatatccatcaacaattgcacattatagaatcaagcattcatcaaaaaccaaatcaaaggaggtgcagtcactcactgcagacgagaactccgcctgccgccatcgctcattggggcgccgaggttgccattgtttgcttcatgtgcgagagccatcgacgccactggatccatctgcgggagacatcggccgatccgctcatgggagcccat

SEQ ID NO: 101205 - DNA, 621 bp, Oryza sativa
tcaccgcggtaaacgacgaacttggtaaacgaacttgcaccgtccttggatttgttcctccctgcaacgtttgtcttctcttttgatttgtaaaccaaagattcgagagggactgtggtgatatatattcttcttttcttacgatggcagatgatgccgttccaaccgtccacatgccattgatttttagcgtcgaatggacagtgtggtcttgaaggtaaacgccaacattggttctgtgtggtataaaagtgacccaagggctgcacacatacacaaaaaataatgacatcaagaaagaaaacaagtggcaaagctccacattatcatgctcaaaaccaatgataattttcgatggtcatcggtgaaactaaaaggttccattaggacacagaaaattttacaaaaagaatcatagaatatagttaatttcttaagtactacttaatacaaaattccactaaatttactcagttgaaaggagccaaaactaccacccgtcttaaaatggaggtacctaatacaatatatgagatatcatctgatactatcaatcactatagcttatccatagtactatatgagccatattttaacttgtcttaattcatagtattggat

SEQ ID NO: 101206 - DNA, 641 bp, Oryza sativa
cgtcccgttggatgacggcgccagccactctggcgccccaaaaaggaccatttctaggataaattttttcaggggtctatttacgaaataagtttttcaaaaggaccaaaatgtgaaaaatccaggagggagtactaagtagataagtttatcgtaagacagagctgtagctaactagttgaaggaggataaaaaaacttatctctgcgttgtaaccttaaaatcagcaattaaagacagcatgtaatgatgagaaagatgatgctttaccgtcaccgtttatcagagagcatctgccctcgagtaaatttaataataaagttaacactactagttataaattatacctaacatgtataatagattagctacagagatttattctttttttttctattctctctctttctctcgcttcttccatttaatattataagtcacttcattttttttctactcaatttttttaagtttaactaattttatagaaaaatataataaaacacaaaataaacattttatcaaaatattttaaagtttgtcttagaaaaaataaaacgacttataatatgaaacaaattaagagagtatataactaatgcatttatcttgcagcatgggtatagctacctcttgcataa

SEQ ID NO: 101207 - DNA, 611 bp, Oryza sativa
ctttgccaatgcagtcatcgcacctccccttttgccaccaccacgacggattcaccttccctataaccgccatcgccagaacgacaaggaagggggagaggccgcactagatccgccacctctgggctagcaggagacagatcgctgtggtcggggccctcctcgacagatttttccctcctgttgtcatcggagggagaggcaccactaatgccatagctacctacctctaccatcgccgccaatctctgacgccatcatcgaaagagagaaggtgagtagactaaagtgaggagggagagagaactgaggggataagagaggacggggtgagggttatcttatgtagtcacgggcgggcaggttgtggtcctgtatttcctaagtgggcctcttaggtttaaaaaatatgatttttcacatgtggttgtcttaagagtgtcacttgtaaaagcaagccgtaaaaatacgcctacttttacaagcggacctgttaagatgaccgtatatgaaaatcattttttgtaagtgagccttgaccggacacctcttacatatttttgcaaacgaatgcctttctagcccgttggtaaaaatacgggggttcataa

SEQ ID NO: 101208 - DNA, 542 bp, Oryza sativa
caggaggaaaaatcatgactatcttgtttgccgtgttgaccggtgcatcgtaagtttcagcaaatcctccactgttgatatcaaaatacatgctgtttagtgcactacaataatgaacccccaatctattcatgtattatttggattgatggaaatataacaagaaatttatatatattacctcaaaatcaagaaggctggttagcatgcaattttagaagtgcaaatggcagttttgttcatttctcaggtgttttttagaaaacttctcaggatttcaagatgattttcagaattaccttaaattattttcaatattttcttgattactatttacaaaaagacaatgctaattgccaatgcatgaaagtaacttgtttcttgtaaacagaatggaatgaacttaaagtttgatggtcaagtcaattgcttgactatacataatccctaggccctattaccattttaggcagacataccaattgctaaggagtagttattaattccagttagtaaaaggggatcatgaactgagatataga

SEQ ID NO: 101209 - DNA, 609 bp, Oryza sativa
ccactaacgtatcctagtgcaacggattgactccactagagacgcttagatcgtgaccgaacatctgaaactgcagttgcatcagggtgaggtaattaaggtgagccaaacgaagcgtagttgattacacctacagtaaattaaacgcgatttagacaacatactccgctacgcgtacgagagcatctcgtccggtggtctcgcgctaatgttccatttagaaaaaaaaaaggtcggaaaagaaactttaatcatttctgtggctatattttattttatttttgaaaaatgaaatcgaacggtattaaaaatatcagaaaatcaattggaaatcagtacttaatgcaggaatcattgagctacagaatcacatatttgatttaacatggctatatgttgtgatcacggaaattcaaacttgcactatataaattagaatctctcttatatttattaatgtactcaaaatagctatttggttgagaagttaaactataggtcaaacagagacatgtatcacaaatattggatatttagaaatagagtaaaattcataaaactacagatattttgactaaattatcacaagatatagatttaaagtgatgt

SEQ ID NO: 101210 - DNA, 658 bp, Oryza sativa
ttaggattttattcccaacaaattataaactcgtgacaatatttgttaaactaatggaattgataacactattagcagtttatatcacattatcacatcaacccaatattaaccacaaatgattgtaaccttgtcttatgggaagcattttttttggcagttcttggtaacatagtttaacagtaaatatcaacaagattcatgaccaaacaagtaccctaagttttccactacttcatcagtataataaaattgaccaaacatttggcttaatacaaatagttttcttaatgaatctcaagctaattaaccagttcgaatgaacgccaagaatatgacttcaactatgcataggatcatcaccatagttctcctatatcatcatcatgatcagcaccagtctttaacatcatcatgagcagaaccaccatcttcatgatttgattcacatgcttttcttttttaggaactttgatgcaccatacattaagcttgatgacggctgcccattggtagacaaacttgtcaatttcgacatgtgtgaacagcaagaaatatgttttccttacataattcatgattggttttacataatctctattttataagaatattttttaacttcttttgtggtactcctacctaatacttcattact

SEQ ID NO: 101211 - DNA, 668 bp, Oryza sativa
tgcttagaccacttcatcttgggtgcagccccccgccatgtcgaacagacttcacgttccactttcttgtattctcacttggaggagtacgttgtggagccgccgaaaatgtgtgagatgtggaggtcggagtctggatacgcataatccgattcgtgaggagccgtctcttcgttcttctcgacaatgcgtactcgcttgcctttttcaaacgccatgtgcttctcgagcgactttttgaaaacaaggcaatcttccagagaatgtctgtccgtcttgtgtatggggcaccaagatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctgatttcttctctcccccggtcttcggcttgtcgttcttgcgtcttagcgcatcgtccacatgggcacatcgctcaacgatctcgaataacctccgagtggttgtgatgcgtcttgtcgccattcctgggtagtgtagcgatctctgacaccggatttgaaggcgcggattacagaagcgtcggtgatttcaggaattgtgtttctgcattcgttgaagcgtcgaacatattccctc

SEQ ID NO: 101212 - DNA, 1973 bp, Oryza sativa
tgtattggaggttgttccaaccccacaaagaccaatgaatactccccgaagcacccctttggattttttcaccatgaaatataaagtaaaggttcctaaatggctggagattgaagatactgtggtctgtgtaactgagccccccaattttttgttcctggatctgcccctgcctagatgtaaccataatagctcgttcggcttgtgattggctccactcaattcttcaagaaatgttaacgagctgagtcaaagattttagtttgttagctatcttactgagatgctcgcgagccgaacgagccaaaagaaatatcaggccaacagaccgagagtctaagggtctatttgggggagcttttagttgctgtagcttctaccagaatcagaagctcctccaaatagactagcttttggtccagattctaaagagttgtagttgtagaatccagaaaatgaacaagccagaagccagattctcagaagctggctaccaatcagctactttttagaattttaagcaccccaaataggccctaagaccgacaacccatcaaggcaacaaggaccatcaaccatttggcccaagccaatcggactaaccttaaaaatctaccactaccatatcagggcttatgcaacttgggctcatccccacccccccccccaccccagcggttgtcttgcacacgtcgcttggatctcgccaactcgctgtattgcatcgtgtcacgctgtcaccccactccacccccacaaccccagatctagttatctaccttactcttgttgtcgagctgctagttatcgcatgttaggtttgccactcgtttgtaacaaccgtcatgtcaccatcgcccgtaggcaacaatgtcttggttagaggactcgtggcggcatgatgtcggccaccccaccctccatgtccactcccaatccccgcctcagccagctgctagttcccactcctccagctatgcttctatcgctgctactcgctaatcccgactcattctcaatgccaactcatcagctaattaaatgagctagcaaacaagccgatatgaggcaactttttagctcgtataacaagttaaagctggctcgatatccacctctatatctgactgtaccgtcacttaaccttatgagttaagtatttgaggaattgtcgatattcgaagtttcaaatgttaagactaaatcatgcctaaacatcagatatttataatctaggaagtggcattccaagggcatgcattcaggctgatcttacaatatattacaatagcgtatagcagcatgttttatgcctaggtgtgttgtacttgtatatgacgcaaatagtagcagttttttttttaaaaaaaatggtaatatacactactaggaaaagcattatcgcaagcggccgaaaagggtcttcgcaggcggggcggccgtccgcctgtaagccaacgattgtgaagatcgccgatcttcgcaggcggggcggccgtccgcttgcgaagattattttcgcaggcggacgttggctagtccggtccgcctgcgaaaataggaatcgtccgcttgcaaaaaaaaaaaacttccacctacgaagataggtagaaaattttgaaatttaattataatttggccgtaaattacttttaaattatttaatagaaattcttgcaggtagatttttatgtacatatattggaagattatcaagcatttggtacatatattgcataactcaaaagtgttgccaaaatatatatattacaatatttttttacattgtcacttcaaataacgtcatctagttacattatggcatagcagtgttccacttccgaagatccttgaattcgtcacttgccgctagggcaccctctgggtcaaagaaatctcctttgacatgacagcactcatggtggatgaagtggcacagatcacgctggacatttgtgatacctgtatcgtca

SEQ ID NO: 101213 - DNA, 585 bp, Oryza sativa
  unsure (1)..(585): unsure at all n locations
ctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggcccttctccccgccaggatcggtggtaagctagttcatccctcaatctctagaacgtccaactcttcaatttggtggtttctgccaattcgctgtggtctcatttcgctaattggacctctcgttcggtgaaaatcgcatcgattcctttctccaagttgagttctgatgtttctgttgcctttgagttcgtttatgacggtttggtttatggtaaaaattcaaggatggagatcatcaacgggccggttctcccgcgctatgctgctccggcgaccggcgccctgacct

SEQ ID NO: 101214 - DNA, 520 bp, Oryza sativa
atagaaactcatccaatactaaattatttttccaatacaacaaatcagaacggatagaaactcatccaatactaaattattttttttaaagtagaacttaacctattactaatataatatcgtttcgattcaggaaatattatattttatagtaaattaatatatttttgaaacgaagtaagtacaaattagtagtgtggtttgtggcaattgtgttgtgcgtgtggaaaggggaaggaaaaagtggatgggagggggagggttgaagttgaggtgtggggcctataaattcggctgtgtttggaggggttaagtatgagtcaagtcaagcacaatctatccctcggtcatcaaaaaatacttgctttaggtcgagcgcaagttaaatttgattaccatctgtctaatataatgtcaaaagatgtactggtattttattttaaaaaaactttgtttaattttaggccgttaccttttaaccacatcgatcattttcgatcggggcagttgctaaaccatt

SEQ ID NO: 101215 - DNA, 586 bp, Oryza sativa
aatttactctgttcgcttcatgtaggaatggaagtgatcatttgggatggtgatcactattttgttaaagttgctaatctggggactaaccggatatcttctgaccctccccagttcagccattcgtgtacttaataagtgattcaatcaacaattgtcttcctttttaagtaacctgtcaatatctaaggatgtcctaaaaaggaaagttgtgacctcttctgatagaagcttcaaaaaatactgggtatcatcaggttctcctgcacaattgtttctggatggtcaatccattgtaattagtagtatttgtcgatgatcattcttttgtacaagtaatacttttaaccattttttttccgtagtgctttggcaaacggcaacggcacgagtttagtgagccaaaataattttcatttaactttcaccgtgtaaatcactgtttaaactgcagtacaggacagcacattcaagtgtaaaacccgcgacttgtagatgggaaacttcaaaagttggtataggaaaaaaatgaagttgtaggagctaattacaatcatgtcagctgttttccgggatttttttctgt

SEQ ID NO: 101216 - DNA, 715 bp, Oryza sativa
catgctgtaaaccactccactacataccatggtgagggatcatactatcagataccactccttactttggcatgctagatcaggatgttcactagctcccagaagtcaccaccaaaagaggcattatcatgtgtttctatcttctctgcttttctgcttttggaacctctcgaaccaccgtcatggtgtggtttccaaaaatgaaccactatcattacatccccttttggtgaagtgtataaggatgctactttgggctgaacgacttcgagaatagacttgtaatttcagcttggaaggatctcctcttttcctcccttcgttctctaaatctgtaacgaccttgtaatgatcttgtacttctaggcacccttttatcaatgaaatacaggtggggaaactctcccctcctaatgacatatcctaaaaaaaatgttagatcaggatactaagccttccttttaggattatcttagcaaaactaaactatattagctgagttgatatgtatcgtgaggtacggaccattctggatagctatcaaaatgtgccttactaattgatcctctactcaataatgtttggctaaattttggattgaagccaatttttttatcaaatcaatattgatgtcctacgaaattattgataataccaataaatataattggatagtaaagaaccaaaatgaccattttattgaactgaatcaact

SEQ ID NO: 101217 - DNA, 610 bp, Oryza sativa
attccacaagccagttggtaaaccttgagtactagattgaggctgtgtatacttctacgtcaaaattagaagtttgaagaaattagaacgatatgatggaaaagttgtaagtttgtgtttgtaggaaagttggatgtggtggaaaagttagaaatttgaagaaaaaaagttagaatctaagggcccgtttagttcccaataagtttttcccaaaaacatcacatcgaatctttagacacatgcatcgagtattaaatataaataaaaagaaaaactaattgcatagttatggaggaaatagcgagacgaatcttttgagcctaattagtccatgattagccataagtgctaaagtaacccacatgtgctaatgatggcataattaggctcaaaagaatcgtctcgcagttttccggcgagttctgaaaattagttcttttattcgtgtccgaaaatcccttccaacatccggtcaaacgtctgatgtgacatttaaaaattttcttttcccaaactaaacacgccctaaatagggcctggtttgtgaaaatgcatttatgctccaccaaaggacgtgcagagccaatggtgcaaatagaaaagtataggc

SEQ ID NO: 101218 - DNA, 683 bp, Oryza sativa
actgaagtctcttcaaaccttgtttacttatgccatatgtattgagctatcaatttttactctggggcaaaggccaaaagaaaagcaaggacagcaaatgcagacagttaatcctacatggactaagaaatgccacttgttttagatgaagaagtgcctgtcaaataaacatattaatttttcacattacttgtacattaacagcttacataaatgttgcctcgaaaaaagatttggtctatcagataaatacatcgacctttgtgtagtcaattactctaagtataaatactaatgttacaaaaaaaaatatgtactatttgagaggttgatcatgtatctacagttgaaagaaaacatctaaagtgtgtgaagctgatattgaatttgtaatagttgtttagaaaacagagttgctggtgttacctctgagcgcacttctaaagcatatgttggtgatacagttgtcacaatattggaataaacaattccaccctgaaaccaataagaagcaaaaatataaaaatcatgacttttaaggtacagaattcaaaacaactgctatttctctattctataccttggcaacatttattcttccatgtgcattgtcttgcatcctgtctggtctatccaactgctcaacatcaaggccgcaatatgataaatcaggagcaggtgct

SEQ ID NO: 101219 - DNA, 768 bp, Oryza sativa
ggtgaagctgcatcgttattcctgcagccctacctatgctcatttgtagtagaaaagactgctctattctatgttttttcaagataccaaccatcttttgcatctcttttatctcttccccttacagagtatttccgttgttccagtggataaataaaaccactttgctgaactaaatgggagaaagcgatcaaaggcaaccaactcaccttgggatttacctgtgatgatttggtaactgaaagattcagacatgtagtagcctttgtacatcgcttttctcatcatttgaagttgaaggatcattgcttagcttgtgatgtgtctcctatcggcctcctcaacaacggtttggatcaacagacgcgcgcactgcagccaatgcagattctcgtccacaccctgttgcttccagtagtatcaagtatcaatgaggaaggatatggatctgctgataagatcaccaagaactgcagaaaggaaggtctccatggtgaactgttataaatcatagagggaaaagaggtgtttcaggccgtactgcaggagcaagacttacggcaatcaggcatgtttcttaaatagattagcgacaaggaattgtgatgtggacacattgaaatcattggaggctgctatctagatacaatgattctacaaaggcactgctaggccgggcattgagggcaagtgattgtggatttcaaaacgtgtattagcaagttaccacttaacactgcaagagagcttggtggcctaatctcactg

SEQ ID NO: 101220 - DNA, 918 bp, Oryza sativa
tcatcgacatttgtacttgcaatgagctctgagcttctctctctgatggagttaattattgaacctgatgatataccataatgggccgcacttctgtcaccatcatgttccggcccaataaaaacaggctgtacagtcatcgatacggaccacaccgacggcctagcataaaagaataagttcagtccaggtctcgtctttacgcggagtttgaatcacgaccataaaccacaatactaaatataacatgtctcccaactatcaaaaccagtataaaaataattctcataggatttgaatggcaatttttgctgacgtgacgcctacatgactagtttgaattagttgttgtctaatatgccttgacgagtcactagaaggaagactaaaaaaaaaaagttgaaacaaaatatttaagctcatgtgtcaggaataaataaaaataaaaaagtagtaggacccacatgtcagtgggttctactctcctttctatctcccacgcgaagaccgggcgtgggtggggaggaaggcgaggatgtaacgtcggccgatgtgtcgctcgtattcgtttgatcgtttcgaagaagcattggaggtgaactgtgtgggaggagtcagaggcaagctaccattgccccctagtcatcggctttagcctgggtggccaacatccacctttgccctgtgcgcgcagaggtaccagtggcagagagcggtaggaagtggcatggggagagatgatgggaggaggcatcaacggcagggtggcaggtggcggcgcggtcgccgtctttcctcccatacgttggctagctcctcctgtcaagttcttcattagcccctcgtgtggctgaaatttttacattttggtcctttttaaaaacttattttacaaatagacccctgggaaaacttaaa

SEQ ID NO: 101221 - DNA, 632 bp, Oryza sativa
ttcgtatttattttggtccattaatcctacatattcttctatatgtagcactaacgattctattgaatttgacctgattgttgcagatggtagtaactaaggctttgcttggacagaagcctaattatgtaagtgtttagtttaatttggattccttttcagtctagtttgaagagaggatcattttaacatacattggctaatatcatgtataataacaatcattgactttgtcttccaattcttaagtgacaccatttctttaccgtaggtataaacaacttttcatatgtaatactatccttcgctcaatgataactaaagcgagtttttattctgctgtctgacatgtagttttatatgatgtgaatacgaatagtcttttttgttttctcttgatcaccaaaatcaaatgatttatctcatttttacacccttctaaggaatgtttcattatgtacccaatagtactgttgttccctgaattaattatatttatcaatacctacgattgttgcacttattaagtattatgcttctcttgcagcgaagattaggatttggactcgtcgaaagcagatatcggtaaagtttcaaccggtcacattctcttttatctattctcaagatgt

SEQ ID NO: 101222 - DNA, 593 bp, Oryza sativa
cttgtactgtaggttggaaattcgagttgtgcagcacgcaatcggtgtcaaatattgttgttagaaactcctgacatttttgtgcttcgtgagcattggagctatggttcgtatagagcttttaaccttttgcttgtgggtacactttttttgaacaatatgtggcttgatgctatagtttctactcaaggcgagtaggcgacaacgacaaggcgtcccttgatttcatttatttatttgcgttgatgtttaaaacttttagtccattaggaataccttgaagggaaggtttttatcttttgcaaattaccttcgaatgaagtttgaaataagcattgtttgcctatgaatgcaagggattccttcactcaacgtcaaggatccatttgctttcatcggaggaacagcacactcactccctttctaaatgcagcactatttattttttttcttaaactttgatcgacaatgtttatttaattacttaggtaagtaaaaatgaaaagagtgataatagatgacccatcaaaagtacttttagcatgcttttttatatttggctaattatataaatattttttaaaaaaacgaaa

SEQ ID NO: 101223 - DNA, 540 bp, Oryza sativa
aaaagttgggaactaaaccaggccatagtagtaaatacagattagggtggtagcatacttttgatttaaaagcttcctttgatctgtgacatataaagcaatgctaaattttaaattttaaattttgataatttttcaacatagtttttttttcaagcattgtaattagtttttaagtcacaaaggatatagtaaaaaaagttctataaattattttttatcgctaatatgccgttatatcttataatcagccgtagacaatgaccttacttcatccaatttttatactacaagtgttttttttgtttgttataagttatttttaaaaaattgtcccatttctaaaaaatcgtaacaacatcaacaatgccatattagtttaataaaatccgttgtgggatatagttttatagtttccaaaaaaaacctttccaaatttaaccaatggcttatttagtggaaataattggatattatatatgtggctatattttcttaataaataaaatcaagttaaaaagttggactaaaaaaataaaa

SEQ ID NO: 101224 - DNA, 508 bp, Oryza sativa
agctcggtacccctaaaatattttagagtttaaatccctagcacttatattctgttggagctataagcattctaattttgtgatttagttggttctcaacctatagttttgtgatagttttatcactaaatttatagttttatgatactcagtcttaaatatatagttttataataaatttgatgctaaatctgtaatggattatacaacaccttaaatcttcatttttttataatctattatattattaagacaactttgaaagaagactccacgctcgctgtggaggctagaaattcctacattaatcggagaaaaagagaaaaaaagctacaccttagattataatagatccagattaaagggcatagatttatcataaaattatattattaagacagctttaaaagaaagcactacgttcaccgtggaggctagaaattcctacattaatcggagaaagagagaaaaaagctacaccattagattgtaatagatccagattaaa

SEQ ID NO: 101225 - DNA, 1242 bp, Oryza sativa
ttttttgttcctggattcgcccctggtcggatctcgacaacgccatgtcctaacacttctttttagagaatggtttttttttacctgacctctacatccaaccagatatatgatgctatttaaattggtaacttagccccgcaaacaacccaatctaaaattcactcctatggagatttaaactcaagaccttgtggtgctactcatgtcactgcaactactaggctacatgccctttcgcaagttcgaaacccactaggctaagtgccctaacccatattttcctttcaagttcggaaccggtatgaataacatatcattcatccgatatcctatcctatattatatttttagaattaaattcgggaacagatatctatttgtataatatatagggagacaattaaagtgttaaaagagatacattaaggaaaaaattatacaatattacatgtgagttcgtaaaatattgattaaccaatcttatattatatccgtaggtgaatttataatagatttacatttttagataatggaatcaaacatcctggcctttactcagaagagctatagccaattattacagtctagcaataaaaaaagagtgtagtttaatgaaacattgaaaaacccaccgaaccaaaagaaatacccaaccaaagatacggagtacacatttattgaagtatactccctctgtcccaaaatacatcaacttctggaattcaaactttgtcccaaaataaattaacttctaccttctcatcattatcggttcgtaaatcgaaaaattgtattccttcaataccccttatctacctatctaccaatactaatttgctattaatgatgggtattttggtcctttatcctcttctttaatcatgcattgggaagctaggagttgtctctttacgagacagagggagtatttgtgaatctccatctataattagcaaaaagttaaataaccatcgtttcaagcttccaacatgcaactcttctcgtattttaacctatatatccttacatatttgaattcgaaatcgaatggtaccagtatatcattttctcaaacataccatattctttccgcgagccataggtcagatgacccgtcgagaaatgccgtaccgttttcatccagtagaacttacgttgagaatagctcatcattgtccctgaccatgccgctccaggcccagtttgggcgaggcgaccttatcgacgtatccgaaagag

SEQ ID NO: 101226 - DNA, 551 bp, Oryza sativa
  unsure (1)..(551): unsure at all n locations
tttgagatttaatggaaatttcaggacatgnccagttccaaaaaaattctatatcaacaattacctgaagtccatctcctaaacatggggaaaaaaaaaaaaaaaattttnttttttttttttttttggggggggggggttttaaaaaaaaaaaaacccccccccttaaaaaaaaatttttgggaaaaaaaaagtaaanatccatnagttttcacacattgtcggaccagtggattttacgagacattttaactattttatagatgatgtgagctaaatatactagacttcaataaaataattatatttcctgtggttgcattggaatttctaacatgttgcactgaaatcacaacatgtcaggactatcctgtggttgcattggaaaatataaaaatatattccatgccactaagtttgctcttgttcaactaatcttgaaatcatgatagcagacaggagtgcaggactgcagggtaacataattgcaatttgtaaataaaagaagaatataatatgaattattcgtcctgcactgattctgatgaact

SEQ ID NO: 101227 - DNA, 692 bp, Oryza sativa
aaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcatttcaccttagcaagatacaatcgagaatagtatgtatcatggaccatttctgtaatcagcacaaaacgtacctaaagggaacagatctgaagtaatcaagtaactgataaatgaacatattatatgacatttaagagaacagatctgcagaccgtgaactgtggaaaacagctttgcactagcacactttagaaaagatgtatgtattgtccgagtgcatgatatccagcatacagtaagtaataatgttaaaatagtaacacacataagcactcccatgaaacactaaacagaaaacataggccatgaagccacacgaaagttgcaaaagaaagtctgcttataagctctcatattaaactcaccgcatatcccatccgttcagtcgtgtcctttaccacattatatatagttggcgtggctggatagacagaagagtcatgcaaatcatatatagatcattaattctatctgtcaccacgatcatgtggatgctccccatctcacatatatttatgatttccacatccaactctttcagttct

SEQ ID NO: 101228 - DNA, 635 bp, Oryza sativa
tacatagtccatcagagatggaatcaaaagcatgcaaccgttgtggagaaattggacacattgctagcatgtgtctcacactctgccctcattgtggggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagttagctccaacagcaacatcgacgatatcatccacagcaccaatgctcctcctgctgcacctgactctgcaataaatcatagcaataataccttcagcaccaaccattctctgcaccgacagcctcagcaaagaattgtcatcgatggaagaagttgtgtctctccccgacctactccaggccgagcaaagggcaatcaatctcaggagggcgataccaagcagaagaccgttctctgcttcgaatagcaatcagaaggaagcttctcctgtgaatgatagcaatatgcagtcctatcacatcatcacagaaccaatcaaggatgcagtcactagaacaatgccagctatacctctccagaatcagaatgagtagccatgttt

SEQ ID NO: 101229 - DNA, 509 bp, Oryza sativa
accacatatatggttaaaaaaatcgtgacaccaataagtacattgcaaacatgtagcactacaacaagccaatcctaagaacaaatgctaaaaatcacaaatttgggtaaaaaaggggttctagggttacccaccgatctacaaattcaaccactaaaaacaaaaaaaaagaggggtgaatgaaagagtctacctttctcttcgatttccacaaaaaatctcgcgaaaaacgagttcaaatggagtggatttgaggtggggaggtgagggggagagctgctgctgctcagctcgggctggtgcttgggcgaaaatgggagtggggaggagataggtggtggggcccacggggtttaaggggtcggcccacagaggaggggcgcgccagccatgctggcgccgtggtaggaggggcagcgccagtgtggctggcgcccccattctgcccagtcagcacctctacgacagccctagtgccacggtggcacgggcacggcgccagtgtggct

SEQ ID NO: 101230 - DNA, 788 bp, Oryza sativa
ttcccaaatattcaaatcgattttaagctatcgcaaacgtggccgatgccatggccctagtcctaattaaggccagtagcaccagtgtggggggtggtttggtttgataacgtattccttctgttttcctttttaatgcacccgtacgtgaccggtcgtaattagccttcttccgttttatattataaattatttttaccttttttataattaaaattctttaaatttaatatagaaatatttaataacatatagaaattaatatattttgataatatatttgttttgtgtcaagatattgtaattttttttataaacttgatcaaactaaaagaagtttaattagaaaaaaagtcaaaacgatacaacaaacgatagactaggaggtgattaagaatacaataacgtactctctctgtcccacaatatccagattcagcatactagcatatgtcacattcacccaaaatcccttatattataggacggatggagtattactcacttggatggagggcacagactcgctaggaggacaagagggaagtatgacaactccaattcatttctatagtagcagaaattatgtcattcatttctagacaagacatttatttttcatcttgtttaaaaatttgatataaatatatgaacatataagtcatacttgaaatatctttaatgataaagtatgtaaaaacaaaataaaaatacatacatgtcttataaaaagtagaaacaacataaataatgcttatataacttttttttataaaacaaagcaaatg

SEQ ID NO: 101231 - DNA, 629 bp, Oryza sativa
ttcctgcagccccttggctgtaaccttcatcgctgcatactttgcatatgcaggcaaaagaaacgaagagaagtaaagaaaggaagagaagctgagagaaagaaagagaagagacaggataagactgtgggacccacgaaaataataaaatatttatgttgagtaaacataaaatttcttcatggtacatatggactataatgtctactccctccgtcccagaaaggagaccttctgctcctaaccatttgtcccataattcttgacgctggcagcctggcagcctggcaggcactaacaaactcctagacaagcacacataaaaaaaagggtaaataaaaaaaaaaagtggggccatctaaaacagtactagcgaactctttcttctccaaacgatttttgctctgaagcgctaccttatcctctcctctggtattctcttcttacccatcgctcgactctcgttttcttctccttccacaccgcgtcttccacaccagcaccccgcttctccttaccatcagcacaccgcaccaattgccatccatgccccctcccccacccccagacgagcaagccatatccggtgtgcgacaacatgctcaacggccgcggcaacactgagagcg

SEQ ID NO: 101232 - DNA, 524 bp, Oryza sativa
ttacctggccctgcatatctgtagatacttctcttgatttattttgttttacagagcctagcaattttttacacttattaatttccaattatttctcaaacattggtgtggaactacagcgaaactaaactgcaagagagatgaactgcccgcactgtacaagtaggggcgtagggctagcgtgttaacgtgttcttgtggatcaaattctgggattccacaagccagttggtaaaccttgagtactagattgaggctgtgtatacttctacgtcaaaattagaagtttgaagaaattagaacgatatgatggaaaagttgtaagtttgtgtttgtaggaaagttggatgtggtggaaaagttagaaatttgaagaaaaaaagttagaatctaagggcccgtttagttcccaataagtttttcccaaaaacatcacatcgaatctttagacacatgcatcgagtattaaatataaataaaaagaaaaactaattgcatagttatggaggaaatagcgagacgaa

SEQ ID NO: 101233 - DNA, 611 bp, Oryza sativa
  unsure (1)..(611): unsure at all n locations
cgtcacacatatatccagagcaaactccattgctcaagtcaatgccatccacatccagagaatgcaaactttataggccgtcacaagaattttggttaacttggtaacccggaatttaagtttgggctttttggtagatgtccactaattaacagtgattgagcaagggttccaaaaaagaaaaagaaaaagaaaacactagctggggttagctcttacatttcgatcctcttgctagctacttactatacatcttatgcttcgtgtctatatctttcaaccncatttntntaattaaggaaaggntttggggcccccaaacccccaaaaaaaaggggggttttttttatttttttgggggaacatgttatcggtcgctctgtgcaggaattgcttggggccaggccggcggccagctcaaggaaactttcgtccaaattgaaatgtcatacttattcaaaaatgaatttgtctcagaataaatatgcatatgtatcttcaatttgtcatcaactctgatgaaattaatcttgcccttttcagagcatgagaagccatggttaaggtaggggaaaaacatttcgcaagtgtacaaatgcagcgttcaattt

SEQ ID NO: 101234 - DNA, 2418 bp, Oryza sativa
gctgtcctccgccgtggagcgggcggcaggcgcaggtgccttgcagcaagtgcgaccaggggtgcaagaagtcgtgcaagggctacggccgcgactcgtcgtgcagcctcccctgcggcgacccatccaacaaggccggctgcgagagctgcctggacgcctactacctgaagtgcctcaactactgtggccagtcgtgccgtgtgaccggcaccagcgggtgaaaaaaaccgttcacgcttcaattggtctctgagctcacggcgccggccgccgtcgtgaagccttttgatgtgtcacgtaaatgtatgtactgtctcgatcatatgtagttctgttactttctccgtttcatgcatattgcaagttatttttgttttgtcctatttcagagtactccttcgtcccaaaaaaactcaattaggaggggtcacatcccgacccctcctaggatgataggatgatgaatctggataaagggtagtctagattcatagtcctaggaggagatattgagttttttttttagaacggatggagtagtttgtcactactagtactctagtagttcaaataagctagcgtgtggtgatgcacgcagcaacgcgctggctcggctcgagctcaactacagagcttgatttttaagtaaaacaatatatatttcaaagataatcttttaaaaataattaatttctagttcatcatattaatagaagaggaaaaaaagaataaaataaatatatgatgtcaatataagacatacaaataatatatttgatctcctaatttattaaataacaacaaaaaatcatatattattaggctcgttggaagctcgagctcggctcgataaagctcgcgagcttagggagaggctcgggctcggctcgtttggagctcgagccgagcttgaatcgagtctagaacgagccaagctcgagcagctccagttttcgagttttttgacagccctacggccgggtcggctgcaagatgtgttgggggcggtaagcgatgtatcaatggcttaatgctttgtttcgttaattgaaactcttatcgacgtcttcgattttctcactgctgcgtaagcgaaactggctacattctttggtgagctcgattctccgattatccttgtaaaatttaattaatcacacttcgagcgctatttatatgggggaagttttaccgtgcttagtgctgaccgtttatcacatccgatcaatccaatattggctaatatttacctttgcctttttaaagtgggtcaattggatctatattattacaaatatgtcattctagagaaatatcattactattcgtctattcgtatcctatcattcgaacacgaacaaaattaaaaccatgctatcgccatcacattttctatcacatatccttttctttccttctcattttcttttcttctcctccccgccagcaagattcgagaggctgattcaagcgtccatgggatggggtcaacgacaacgacggctcttcctccttctttcccctccaccacaaccaccgctgctccaagtatagatgcgctgccggctagggggagggaccaccaaccatgggcgctagcgtcgactcggactctaggaggggcactatggccttgctatcgaggacgaacttagccttggaagagacgttggcagtgttgaatgcttggggaagataccgaggtcgatggaggttaagcatgagctacccatgaaggaagacgggtacggtgctagaagcggctcagatcctcaccggcgagctccgcctcccctctcgtccatgaccctccgcttctcaccggcgagctccttcgaggcgcggggtaggagtagcaagcgggaatggcttctccaagtctccgagaggcgaggggtgggcttagggttgggggaggccggagccggtgaagtccgcccaggcatttcatgtggatttggctgccggcgacccaggattggtggaagggtggatagtgggggagagagagtaaggaggatctggcgatgttgtggatcgacggtggagggtgatagcaacgacgatggagttgcagcgcaatggccctgatgcggtgacaatgatggtgcggaggattcaacggtgagggaggcgataggggaggcaacagccaaggctgcctttgcccggtcgctcctccctgtgtccccacactttttttatcagaatgtccccacacttcattgtgggggcggcattggcatcgacatcgctgttgtggttggctagctgagaggggaagggaaagagaggaggagaagaataaattgggggaagaagatgaaaaatatgatagcgatgacatgccaacgtctctctgtgatgtgtgtaggcccatgcacatgtatgcgtctatgggtacatgctgccatc

SEQ ID NO: 101235 - DNA, 1269 bp, Oryza sativa
acgccatgtttgctttgcatctgcaatccagtgacaaaaacctgcaagttgaagtatcgcgtttactgcctataaatagcgctggtaatctgccacaaatccaacacatacgcatatctgcatcccctgttcttctctcctgtgacttgcttgatccacatcaaatccaacgacaacaccaacagaccaaataatggctgctgcttccggccgccgccgtgccgcggccttcgccgtcgtgatctgcgccgccctgctgctgctgtcctccgccgtggagcgggcggcggcgcaggtgccctgcagccagtgcgaccaggcgtgcaaggaatcgtgcaagggctacgggcgcgactcgtcgtcgtgcagcgccccctgcggcgacccctccaacaaggacggatgcgagagctgcctggaggcgtactactccaaatgcgtcaactactgtggcccgtcctgccatgtcacctgcaccagcggctgaaaagcccagccggccgtcgtcttgggccttgtttggatactccgtaataataattagccctcccaaattttactatttaagagtattaaatataaattactgataaaactcatttcataatctctggactaattttatattcgtcttgcaaattagcttggtggttataaaataagttttatcagtaatttatatttaatacttctaaatagcaagattttagagggctaattattagcccggaggatcctaaggccttgatgtgtgtcatgaggatgcaccgtgcatgtacacgtactgttagtattgtatactagcaatagttagtactgctatttcgaataagctagctggcgtggatgtacagtatatggctatatgccgaccggctctgtatttcatatattgtggtcaatgcttcctttcgttgttaccaaggtcttctaagacagtggtatggtcacgaagagaggtactctgtctggttttattttaattaacgtttcggataatggcactgtttacaaaatattaccttaattttctattataatatacataataaataaatgcatgtttatttttattatagtgttttgaaacacaaatctatatatctatatatgttattctagtttctttaaactttattaatggtcaaagttataaaagtttgatttgaccttgtccaaaacgttaattattatataaccggagggagtactcctaaaacctatcaacaaatatttaaaactgttttaagacaaatctaaccctatgag

SEQ ID NO: 101236 - DNA, 691 bp, Oryza sativa
ttctcgaatgccttagaaatttcggccaatgtatgcgcttatattttgctcactttctgataaacgtttggaatttgattttgatttacgttacgtactcattttgccggttgagctttagttgttcgtttaaaaaaaatccattttacccttaagtacggaagaattatagaaattcatggagtacattgttggtacttggtagtgtataagtttattgtatagtatgactttatattcatgagtttgttgtgcggaatattatttatgataaaaatgcatgtcttatattataaaaccactttaaaaattagttgtgcctttaaaaagtaatagaaaggttaaatatttatttttctatttttcatattaaaaagagtaatgtggtataattttttatgatacatacaataggtttgtctaatactaagactttgtttggcgcctcttgttgtggctgcaagcgattgaagaaatgtaagttttattctatagtagctggttgtacaactatagtcataacttctgaataagttctaaggttgtgttcgaatataaaggtctggaacctactctccaacatgaaaaataaggtggcttattagcatataattaagtattagctataaaaacctgaaaattaatataatttagcttttaaaacatctttcttatagaatttgttgtaaag

SEQ ID NO: 101237 - DNA, 1106 bp, Oryza sativa
ttcctgcagccctagtatttccattattgttgatgataaaacatgattaatactttatatgtgacttatctttttaattttttataatttttttaaataagacgaacagtcaaacgttggatacggaaatccaaagtttgtctttttttttacgagggagtagctgtggctcgttctcgaggtggtgctgtcgcatcctttgaattaaacgcatgtgtaatcatttttttttctaatagaaaagggtaaggtgacgcatgctaatgagtttgtgccgattcttcgttagtttactcaagtagatatggtaaacaaccaaacaatagactgaaacatgcataaattgcatacaagatattgagttttacttttccatggagttgaatgccttggaaggagcaggcattttatacaagttcgtaaaatattcaaaattcgcaagaagccaaagcaccgtgtccacagcgcgcctaatgaggtaatgccaggtttgatgcatcggatatttgtaagaatgaattaaccagctgacgggacactgacgttgtacgaacccagcaaaattcaacattctgaatagtacccgaattcaattcctttccgggttcaaattctcttttgaactttgcgatgcatttatccttatccatcacacgcacacacggcacacgggtgtttatgctggtgtgcggcgaaacaccccgagtatttccccttcgttttgatcatttcgatcatttccatggttggggttccaccatttaggacagtcaaccccggcattgttggcatcaaccccggcggatggcaccaaccgccgaccggtacaccgcccatgtgccacagcccacccgcccgcgcgcgccagcggccagcccttcgcaaatcgatcccaaaaccacaacgtttacaaaaactattatgaactaaagtggattttaataggaaatatttataatggtttacacacttaaataattaaaaaacataggtaaaattaaaattttgagaagatatattaccatatgatatatcaaattttaagttataccatttaaaaaaggtaaattaaccattatttaatgcatatttatagtaaatttttt

SEQ ID NO: 101238 - DNA, 954 bp, Oryza sativa
acacgccgccggtcgccagtctccccaatgatgacctggcgccgccatcggtaccgtccgcccaagtaacgatgccagcagcgtggctgcaaccggtgaccgactacaccttcgccaccggcgtcctggcgcttctatccccttcgccgcaaccacctgtcccagtgtcaccgcgaccagccgccgacctcacctccaccgttgatgacatatttccctggacaaaaaaaataccatgtacaatgagttaggggcaaataggtctttttagagaggtaacagatgttaactggactgtgatggcacacagtagatgttaaagaaaactcgatggtatataattgaacttgataaagtcagtggtacattatagaagtgcgataaactcagtggcactgagtggattctcttaaaattaaagggtagtgggtcctttgtggtggagtggagttgtggacagcacaacccagctctaccccctagtatattttttaggaataactctgctaactacactcccaaaaacagaggatctgaattgtttggcacaactccgattctaattaagttgaagttgggagctataactgtgtcaaatagaaccaaacttggccttgaacaccttcttcgtactttaaatacgaatctaacaacataaatatcacaaaatcatatgcatttgtcaaaggttcatatcctaacgaaacaaaataagttttatattttttatggagggagtgacaaagtttaactaaaaccaaaggttccttggtactagtatgatactccctctgtttcaaaatgtttgacaccgttgactttttagtacgtgtttgaccattccgtcttattcaaaaaatttaagtaattatttattctttttatatcatctgatttattgttaaatatacctttcatgtacatatatagttttacatattccacaaatttttt

SEQ ID NO: 101239 - DNA, 876 bp, Oryza sativa
tttcaggggtagacaatgtacccgtcgatagcaaggcccctgtggtgacttcgtcaatctccaaaatttgcgggctcagttatcgaaaatgctcataagggtagggtttacgtacgtgcattcatagggtgagtatgcgtgcattgtgagtgtttatgttgtaaagtgtaattttaaaaaaatattgtaagcaaggcacaaagattgagtaatcccctacgtttgtaaacattcctcatttggtcgctattatttttttaaaacgatcagttacagacaacacgatcattcattgaatagagcagaaagaaattacaaaactattgccttaggagacattcgccaggaaagaaaaaatttaaccaccacgcaccgacagcgtctacacacatccaaagagaaggctagcaccaaatcaaccacttttaagcgtaacttatgtccctcttattgaactatgttcgtggctattattggttttcttccgtggttttttcaaagggccgcggtttttcaatgtgtagaactatgtcttgatcacttctttgtctgtccgtttatcgcatatatctatatggtcagagcacccgctttaattctttgatcttaagctgttctacatatattagtggtatttgaccgtcctaaattacgtcttagatgagccatgcatgaccaagaagttagattctgacttttggatatagatatgcatgacagtgaagacacgccacccaatgtgtattctatagaaaccagagtttttaagcagcacgaaaaaaaaaaactattacttcagtcctagactagctttttttcatgcagtagtaacttcgacagcagggaagagctttgttgatagtcagggctgcagga

SEQ ID NO: 101240 - DNA, 1037 bp, Oryza sativa
atccttgtccataagtctatacacaaacatgtatgactaaatttgatctacaattaaagaaacaaaaataataaaatcagacagtgaatagtatccgtactccctttaaaactggacagatcaagaaactgtgcccttttgaaacaggacagagagagtatcacctatgtcatctatgaagcatcctgcataagtaatctatcacacgttagcatctatttaccatagacagatctaatataatctttctattggacagattttagcagcattcttttttcttttctgggcatcacatcactatttttgcttaacctttggtcctctgctatgtcggtgagttttcaactagagatatatactgatatgaaattgattacgatagcatagacaaatctacttggaagggaaatattgagatggatattgaaaggtttttcgatcgtaaggtcaagaccagagcataccagtatctcgatgcggcgaaaccacagggatgcaccaagactcctcatgaacgctatagttgctacattcagcaaagaagagcgttgcaggatcattggcagattgggggtcatcgcaaatcgccagaaagttgatatgagagtgattatatttgtaaatcctccatgggctattgcttctgaccgggccgtactccaggccagatacgcactcattgacaccacagataaaatgaagcctatatttgtgcaccttcaactaaagacacaatcgaagagagttaattggacatttgaggctaagcatatacaacaaaaatagaggggggtcaacttgaagaaaccaaaccttgtcaaggttgaatgtggccaatgcaacttccacgttcttgcagactaggtcatgatgtagccaaaacttgaaacgccggtgacaaagcgcaatgtaggcatcattgcataaccttttaggctctggctgctgttgatgtcgcaactcgaagtgacgcttgcgaaacaacaaggaaatcaaggtgacatcgtcagagcagagcctgtcaccgtgctgca

SEQ ID NO: 101241 - DNA, 517 bp, Oryza sativa
ttcctgcagcccttccggctcaatcggagagaaatttttttcaaaaagacaagaatgaccctagggtcaaaagctttttgagccgagactaaagtgaaaataaaataatggtgtatgctagtgatgtactttgggctatggcaaatttagagttacataatttccaaatttttactctaacaccatgtttgaagcatgtggctagaggggcattctcgtcttttttaggaatccatctcttcaattgagccgaaagtgtcctctagcaaattaccagttttttagaatgtctttcagccatgacacgttttttcgatgtatatcagcaaattacacaaattttgggtgtcctatagcaaaatttaccattttagacattctaaattttgacattattaatattttttgacacgacattattaatatttgattgaattgagatgtgtagattgtatttggtttgttacctttactaagtttttctttttttaaaatagattctatagttgccaaattt

SEQ ID NO: 101242 - DNA, 578 bp, Oryza sativa
aatggaaaaacaaaggaaaaaacatatgattttgatagaaatacaaatgtaaaacagagaattacaaaacatagaaaaaaacataggaataactgtttaattgaactaaaaaatgtaggaatcagatgagagagatagtatcggaggaaattttccaagaagttgaaactcttactaagttttcttcaaaatctctatgggattatcagttccatagaaatttttgaaggataaaatattatttaatcttttattttaaaggttttcataggaaaattttcgataagattgaaatcctctaaaatttctatatttttcttataaattaaagtggtgctcaatcatttggttgctttccctaatgacgtactgatacttcatctaggggtgtacgacagatgtagtggaagatggatgacgaaacccaaaaccacgaacgcagtggtaaccagccgttgggcattctgttttcatttaccactaccaaagtatcatcaagtgccagtttaatactcctaacatcgacgccggagcgtcatacatgcatgagatcatgtcatattgtcattcttaagcgt

SEQ ID NO: 101243 - DNA, 587 bp, Oryza sativa
ctttctgccataaatataaatgtatttatatatcccaccatccgtcctaaaatatattaacttttacctatagatctcgacatgcacttatgtagattcggaactcaaaatagttatatgttgagacagggggagcatattattattaagatagctctaaaatgagtttcaccgcgtttactctggaggcctaaaaattaccacatttaatcggacaaaaggagaaatatgttaaccgttaaattgtgttggtctagaatacatcggtggagatttattgatataattgtatacaaagtacaatgttaaatatggtagcataaatcgacccgtatagaaacagaatcaaagttgtatacaaattcaactcaatttttaaatctagctccgtgcaaattgcacaggaaaatcctctagtttcgttaaccagatcgaacaatctccccagcctggcatatatggtttataacttggtatcattcctagtatttgaactcacatttgctatctgatactctcttttttcatattataagtcactcgtcccaaaatataccaagccaagattggatgggacccggtatatt

SEQ ID NO: 101244 - DNA, 561 bp, Oryza sativa
agggatacctcatgccacatagaaggatcaaatcttcacataaacataggccattttagtcgttccccaatcaaactccaaccacctcgatcggtaatgcagcaagcttctcgttcttgcatgaccagaaacccggtttggctccatctgaccccgcaccggcgttcccaactataagcatgcgaggtttccctgaacaaactagctacttagccagggtgtcccattccgccttgtggttgcactttgattatgttcgatgagtttcccacaggaatcggtccttatatgcgaatacggatcagtgccacataggcacaacccccgcatcgcgagttttcacaattcattttattttcaaacaccctgacaccacatgtcgggttttgaaggcttcacaaccctatttcccaagttttcgacaaacaacggtgtatgtgggatatttggtatacgcgctcagagagcccaaataccgaggtaccacaagggtggagcgacaaggaatcagggtagtccgacctacggaaattagtgcgcctactgggtaggtccgcccat

SEQ ID NO: 101245 - DNA, 628 bp, Oryza sativa
aaaaaaaaactttccaagaggttgaagctattactaactttccttcaaaaatctctatatgaatgtttattctatagtaatttcaaaaaaaaaaattagtacttcctccgcatctagattcattaacatcaatatgaatgtggaaaatactagaataacttaatgtggaaaatagtagaataacttatattgtgaaacggaggaagtagtgtagattatctaatctactcttttaactgtttaacttaaaaccatgaatatgctaatataaattatggacgactaaccgtttcctcgaagccatggatgttgatgtagcctcctaaatcaaagtggaagtagaggttgcagacgcaccttgaaccacctctcatattgtctgtgtagaagaacaattggcatcgctagcttgagtctagatagattgtcggcagtcagcggggtagcggtgtccttctgatcgtcacctgcactgctctagaagtgccacacgttctccctccagcgtcttatttatcaaggttggaacattggaatgaacatcataaaaacagtgtcccgtttcacggccggactctctttttaattttgcgctatggaagatcgagggagatccagggctgcagga

SEQ ID NO: 101246 - DNA, 597 bp, Oryza sativa
agtcctaacaccagtcttgaaaatatagaatggtcaatcaaacatgacagaatcaaacggacaacttgaatacaatgaacctatttaactgtcacgagaatgtactcgatatgattttttttttcttttggaagatactttcagaaattaaactgcagacagttggtcatacaatccccaattcctacaatctcgtggatcaatctaccataaaaagcagcaacaatgaggagaatggaatatcatactgaatacgctaataaagataacataaacatatatgcactagccattcatttgattcttgtaagctgtcattcattttatttttccaaagttgaaaacatgattcttacactagtgtcatttttcgatacacaagtaaacaaccatgaactatgattgtacaaaaaaattaactcggaagataccctacgcatcctcaattttgagtagcgtgctgcaacatcaaattaacttgcacttgctgaattcaggtttcagtaaagtaaagatccatcatacacttgacattcaatttagcccctagaccacactacacatctcattggtcatgggagaaacgtaccagctaga

SEQ ID NO: 101247 - DNA, 521 bp, Oryza sativa
ctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttgcatataacataaaaattcagactcaattgaagaatatttcaatcagccacctgtggctaacagaagagatg

SEQ ID NO: 101248 - DNA, 631 bp, Oryza sativa
cgatatcacaaaaatccttatatcctccgaaaaggactctaacaccttctattcgaagaggatgatttccttatagatcatccgatttcctcatttcggaggtatcttcccatacacatgagggtatatcgtattcgtatatttcacaaccctaaggataagaggtatgtcttatctataaccctgacaaacaatacaatggattgggctaaagctttgatgggatggcccaaaccttggcccatttcttggtccactcctctgctgagaagaaaagacttcagtgccctcaataaatatgtggtgagtggaggtgagagggtaggtaggggacaaaataggaataaatttgaataggaggtgattgatgagataaatagtaagtgaattgggccaaagctttaatgggacaacccataccttggcccatttatgggtccactattgtgctgggaggaaaagactttagtgccctcaataaatatatgatgggtggaggtgggagggtaggtagggggataacatgggaataaattttaaattgaggtgattgatgagataaatagtcagtggtttgggcctaagctttgatgggatggcccagaccttggcctatttcttgatccaccct

SEQ ID NO: 101249 - DNA, 2190 bp, Oryza sativa
taataaatcgttcagaacacgcgaaatctgcggtgttcataaaatcgaaagaatgcacccaaatatatacgactaggccgcagcaaagatattttttagataagcagggaaacataactctagaacttagttataagtctacgattaaaacgtcatagcacaaaaaaaacagcaaggtttaaatggtagaaatattttcacaaaccagtaagcacaagtacatacaaaatttaggaaattgagatttcaaaactaaaataaagttttaaagtgcaaagttaagttccaaaaagagagtaccaagttgaaattcaagtgtgaaaaaacaaccgtccctcgagaaaccaaaataaagttttaaagtgcaattacaaaaaagccgcaaggtttaaatgcaagcaaatattttcttttcacaaacaagcataagttcaaacaaaattacagaaattgccatttcagaagtaaaataaagctttcaactctaaagagaagttccaaaaagagactttgtaattgaagaaatcaaactcaaagcaccgagttgaaacttaatgttgaaaaataaccgttacaccagaaacaaaagtaaaagattcaacgaaaggacgggaaatgaaacgtcgagaaacctaaaaacgtttgataaaaaaaagccgcaaggtttagatgcaagcaaatattttcttttcacaaacaagcatagattcaaacaaaattttggtaatttacatttcagaactaaaatagcatgtcaaaagttttaaagtccaaatagcatgtcaaaagcatgaatacaagagaacattcgaaaataaagaaatccaacaaaaagcatacagtttaaatgaaaggatgtaaaataaagcgtcaagagagaagcctagaaatgttttatacaaggaaactgtgattttcagaaaagattgaacgtgcaacaaactataagggtccagctcacaaaaaagttagttgttttcaataaactgggagaggcagctctacaactcaattaaaagatcaatattaacggcagagcaaaacaaatcagttagggcttaaagcaaaagaatattttgttttttaaaccagaaaacaaagttcaaacaaacttaaggaagatgaaccgtgacaacaaaaataattggaaactccaaaaaggatatttgatgaattgatgaagaagaaagtttcaaaatcaaggaatccaattaaaagtggtacagccaaattacgattttcataaaatcaataagatgcgaccaaatgtagatgtccagctcgcaaccaaaatatttttttcgataaaaaggaggcgtaactatttaatttaattataaggccaaagttaaaacgtcatagcaaaaaaaaccataaggtttaaatgcacacaaaaatgttcttgtcaaaaactattaagcataaattcaaacaaaatttaggaaactgggatttcagaactaaaataaatatttaaagtccaatgagaagataaagaaagagaaactttgtcattgaagaaatcaaactaaaagtactaaattgaaactcaagaacgaaaaaacagttgtctctcgagaaaccaaaataaagttttgaagagactaaatagcatgtcgaaagcattaatacaagagaacttttgaaaataaataaatccaacgaaaagcttaatgtttaaacaataggatagaacatgaatcgtcaagggaaaaacctagaaatatttgatacaaggaaaacttgactttcaaaaaagcttcaaggtgcaacaaaatgcatgggcccagctcacaacaaagttatttgttttcgataaacaaggagaccaaaatctacaactcaattataagagcaaaataaatcaattagtcctcaatgcaaaagaatattttgtttttacaaactagaaaacaatgttcaatcttttcacgaactagtaaacataaatacatacaaaacttaagaaattgagatttcagaactaaaataaagttctaaagtccaaagagaagttccaaaaagatagtaccaagttgaaattcaagggtgaaaaaacgaacatcactcgagaaaccaaaataaagttttaaagtccaaatagcatgtcaaaagcattaatacaagagaactttcgaaaataaagaaatccaacgaaaagcataaggtttaaatgaaaggatggaaaat

SEQ ID NO: 101250 - DNA, 674 bp, Oryza sativa
ccccatatgagtgtgctatatatatatatatatatatatatatatatatatatatatatatatttgtaaggtatagcaccgactgcaaaactgatacgattatgaccactgaaccttgatagaacttttatcaaacaacaaaccaaaaagatcaaatccatgaaacttggtactcaccagaccattgtaaggcaccaaggatgatagctcaagtttataagacggatcacccagcctagtgatcactgagacttctccttgtcgctcctgaaagtcaacaaaaagtcccattagaaagaaagaagtatttaggttccagtaccacagctacatgtgaaaagctgatcaattttaccgagaaactgtctaaatgaaaaattgagaacccctttctcgcgattagtaaattaacaaaatgcacacatactatatcataagcaacggaacagctgaacaacacttgatgggtaaatgcgggtgactaaggattcaagccagaaaaagaagaagtgtgccatttaccttgacatcgtgtgagccgcggagctggatggcgccgccggggagggagccctgcccgctgagcagcgcgttgcgggcctcgacgtcgtacagcacggagaaattcttggcgatgagcccgaccacgggcgcgacgaatagctgccgccgcg

SEQ ID NO: 101251 - DNA, 549 bp, Oryza sativa
atgctattatatgagagaaaatataataatgctagccgcgcaatctgtgcgggccgctatattaaatctttaaaataagatatcggatgataatattttgataaaaatatatatatgacaaatgggccgggtcccactaacttttagcttttcccatccaagctatatccctccaaccaaacaagaaatttgatcatcctatccatacaaaccaaacaaaaaaaattggatcgccatatcgaataaaatatgtttggtcatatcccatccatacgtaaccgtgagccaaacacaccctacaatggttcatcatcctggcaccgatgcaaggtggtctccgctacaatggcagcggtcaagctctcttttcaccgagacgattggcggccaagctaagctaagctagaggcaacagcaaaagcgaattaaagcaggcagcaaaaggccgtcgtgccgtgcggtgcgagaagggctttcccttctccctcccgtcctctccccacttcaccatcatccagcgaagtggctaagtgattccctcgaaaagat

SEQ ID NO: 101252 - DNA, 542 bp, Oryza sativa
tagttcgtagaactgaccaaaagctacttttttttttcgcggggagaccaaaagctacttacgtcctctaatgaatgagtcattaaaaaaaatcgaagggtgtacccaatcccatctgtccatattcgtagttaggattaaacttttttttggacggagggaatactcaattagggtgtgtttagtttacgctaaaattgtatgtttggttgaaattagaaagatgtgacggaaaagttggaaatttgtatgtgtaggaaagttttgggccatgtttggttgcaaaaattttcttcaaacttctaacttttccatcacatccaaactttcctacacatataaatttttcaacttttccgtcacatcgatccaattttaaccaaattttcaattttaacgggaactaaacacacccttgatgtgatagaaaagttaaaagtttgaagaaaaagtttggaactaaactctgctttattgggaaaaaaaacggagataagtatgtattttgttttgaaaacaaaaacactggatgcatgggttgt

SEQ ID NO: 101253 - DNA, 590 bp, Oryza sativa
aatgctccctcctctccccccttcctcctcccctttttctcttcctactacaccataaatatgtaaatttaatatttgacttataaactttgggtctataaactaatatttgaattcaaattcaaatttgaatcgggtatgtaaacttttgacttataaactttgggtctataaactttaggtgtataaactttagatatatagaaatactatatatagaaaatatttgaattcaaattcaaatttgaatcgggtatataaactttaggtctataaactttatgtctataaacttagggtgtataaactttagatgtatagaaatactatatatgaaaaatatttgaattcaaattcaaatttgaatcggatatataaactttaggtctataaaatttaggtgtataaactttaggtgtataaactttagatgtatagaaatcctatatataaaaaaaatatttgaattcaaatttaaatttaaataggatatttgaattcaaattcaaatttgaatcggatatatttcaaattcaaatttgaatcgggtatataaacttttaagttataaactttgggtctataaactt

SEQ ID NO: 101254 - DNA, 537 bp, Oryza sativa
tcattcttcatttgttagggagaataagtctgtaactgcagcaactacttttctgtacagacaaaacgttgtggatggggtgctatttcattggagccattggaaaaaggtgattttataattgagtatgttggtgaaggtacaagttactctaccatttaaacttatattatacaaattagcatattctttagtaaactgtatgcatgtcattgtggagtcacattatgccattacagtacaatccaaatttcttgacatgaatatttcctgaagataaatttgaagcaacttattggtagttagcatgaaaaagcctgtttagtcattgcatctgtttaacagaaaaggtacctcagctttagatgaaaacttattatattaatctgaaaattggataacgagtgtacattttgttcccactctattttataacataacatagctacgaagcctacaattatgaacaatggcagttcttgttgccacttattcttgtgaccttagctctttgtggtttttattttattactccct

SEQ ID NO: 101255 - DNA, 573 bp, Oryza sativa
tcaagggctatgaatctagagagacatgctacattactagactcgtttattttaaaatagaaggagtactagacatgttaggcatgtttggattgaggttgatttttgtcctaccaattttttttggcaacttcaatagtaacgggctgttttggtttgaggcctaaattagccataccaatatttggtaatttaaatagtgtttagtgtctatttggtttaaagccaaattggcatgagtaagaaaataagccatttcaatagtgaacttaggctattttggctttaatccaaacacaactttgccttaccaaaattagtcatgccaaaacttaacaaaatttggcattgacaaaatttgataaggtctatttaggccacaaaccaaaccaacccaacatatagatgtttggtttgctaccaatttatatccacgctgctaaaagtactatactatcaatttggttagtgtcaaaaattaccaagattttagcgctaccaaaatattgattgggcaaaattggtaacaatccaaacaaacccgtctgcaacttgcgtagagtgtatatggag

SEQ ID NO: 101256 - DNA, 610 bp, Oryza sativa
ttagtgtgatgcttaagacggaatgtattagtgtcttctcaaaactctttgttgattaaacctcactggatgaatagtttgctggtgtccggtggcttagggctactttggtttgctaccataccaaattttgccctaccaaaatttggtagggtaacaaatcaagtactgtttagttttaaaaaaaaataaatcaagtactgcactaccaaaacgttggggttttgttcacatagttgtctctcatagtcacattttggcatcaaatcaattctactcttctcaactttcctctaccaaaaatttggtagtcccaaacttgcccaagcattgggctttgcactactaaaaattttagcaggtcctcaaaccaaaccagccattagttttctgcaatcagcattcattgacctggcccggacagttttctgcaattagtttatcatcgtcagctatttttatctccttgaaaatattctcctcggtgactgtgtctttgcacctttaatagtcaatgtgcgggtatgtacttgcacatgcgaatagtggcttgagcatgcacatctaatataggcacttacagtgtacacatttaccctctcttccttta

SEQ ID NO: 101257 - DNA, 735 bp, Oryza sativa
cataatacaaattgcgtctaatttaatactaattatattattttagaatagaaaaggtagcattttataataaataaggattttgttcatgtaggtacatggaaaaaatcctttatattcaggtagtgatcattatcaacttatcgttgtcgctagctcgctccaggcgtttcgatcttctgaattgacgagagagtacgtaataatatagctcacctgttgggaggaaagaggggaaatgccatatcaatttcatttgaattatgttcggattttgccggaatcaagtcaaaggcagcctaatctcagtctgacgcaactttgggggagtattttaggtggctgcaccatcggaaaatttcaggtcaggacagcaacgagttctccagagagttgctgacgtgcttgctccctctaggagtcaacgacccaagcgtgcatatatgctacaagtagtataatacacagtagtagtaccgcacaaattttgacaatttaatcatttacaaaaaaaactatttttacaaatgaactgctgccaaaacttattttaaatctgacccttttgctcaacgctaactcgtgtggcgctgaatttagacacctcagcgtcaaatagcatggcgctgaatgtacgttgacacactgacttactctctcatccaccgtggcacggcattcagcgccagctgacgtgacgtgacgctgaggtgtctaagtttgatggactactgt

SEQ ID NO: 101258 - DNA, 1707 bp, Oryza sativa
attccactcggcactctttagatttttaatacataatgtcattaactttaaaacattttaattttaagacatatttttcactatttattatattagaaattatataaatatttttagtatttattttaacataaaatactttaagcgttatttctgtttttcatatttatatatgtctgagggtgaacttctcaagcaagggaccgtggagatccctttctggttcggtctaggggcacgggtaaaggtctcagagttgatggggagaggcagagggggtcgggcccctcgggagtgatggagatgtaagatgtttatataggatcggactgctatgaaaacgtaataccctactcatatgtgtggttgatttaggtgggagaatacaagtgcttttcttctctaggattcgtccccgtctccattagggtatgaacctacttttatatcttaagggattaccataaaggctcaagacctagcttcaagggtaaggaaaacattctttacaggcaattaatgcttgtcttgtcttccgacgtgtggagccacgcgcgccttaccgctgcatgggcccatcccatcacgccgagcgtcacgggcagacgcctgtgtcattcattcttaattatcgatgacttctggtcgtccgttcccaccgttgggtggggatctctcatacggaccggtgtaagaagaaccggtccgagctcaaatgcaaggcaaaaatcccctcattaatggcgattagacgggcagccgcaggccacgtccccttcaagcaacaggtgcatgcgcagggctccctgaccgccatcacatcggtcattccggccacaagtggccagttagtgcgcctacacatcgcattaaatgcgacgtgccgagtaagtactgcctcaataaatgctgtaggtgggcgctgggagtgcccgcccaagcgacacgcgcgagacagagcgtgtagggggtcgggggcccggggcagcccgacccctggcatggtaggcagtcgccgctccaaccctaggcccgacccccgggggggcacgtgggtttggggcagccttctccctctgtacgtggtacaccgggtccatatcactgacaatatacaattttagataaggcatatatggtcaaacacaatgtatatttaaaagtcgtgtactttaaaataatgggaagtactgttttttcatcatatctctaatcaccgtccagaaaaaattgctacgaaaatgcagcacaaagggaaaaaaaacatctcaaaagtttgcttttgcgccgcgcactacagtgaagcgaaagcatatgtgtgagagacagggaaaaggatcggccatgagaatgagggtcacttgcaactgatggtccaatttgggagaaaaaaaagtttgacaagatcattacatgcttggttaaagagcaacctttgatgacaaaagggcattactttgttcatctaatctgggcttggaattatatcgctttctacactttgcagaaaatgatcgagcgttagatcgctccttttggctgtgtgtgatttgtgaaggtagcatcagagaaatgtttaatagtagtactagattgtgtcaatggagagtagacagtaaagtaactgagttattaatagcacgacacggtacttccacaaattttgagaccctttgcaaaaactatttctacaaatgaactgctgcc

SEQ ID NO: 101259 - DNA, 541 bp, Oryza sativa
tatatagactattgctacaccaccggtaacttctgaacaatacaaagctttaacatatcatatgcacaaacatctcgatcagtacaacatgcacctgccattaagccaaaaaaaacacacgaatgcccaaaccctagaaccctgtgggaggaagggtgaagattggggggggagaacgggtggcttaccatcgagagcgcgggcgggtcacttgcgacggacttggagaaggcggcgcacaggtagggaccttcccgacggcacaccggactcaggaggagtcggcgcgcaggtcagaggaggtggagtcaaaagcggtaagagaggaccgctccggagacggaggaggcgagctttggggggtgggggggcgagaagagctaggtacggggcggaggctcgccggaggcagctctgagcggcgtcgagttcgtcggagtagccggcggcggcggcggcgtgtcggctgggggatttcacgagtcgcgggggaggggggaggggggagagcgtcgagcggtccgggtcggtggatggaaaa

SEQ ID NO: 101260 - DNA, 687 bp, Oryza sativa
attcccatgttatccccctacctaccctcccacctccacccatcatatatttattgagggcactaaagtcttttcctcccagcacaatagtggacccataaatgggccaaggtatgggttgtcccattaaagctttggcccaattcacttactatttatctcatcaatcacctcctattcaaatttattcctattttgtcccctacctaccctctcacctccactcaccacatatttattgagggcactgaagtcttttcttctcagcagaggagtggaccaagaaatgggccaaggtttgggccatcccatcaaagctttagcccaatccattgtattgtttgtcagggttatagataagacatacctcttatccttagggttgtgaaatatacgaatacgatataccctcatgtgtatgggaagatacctccgaaatgaggaaatcggatgatctataaggaaatcatcctcttcgaatagaaggtgttagagtccttttcggaggatataaggatttttgtgatatcgtgtaagggcaggtgtctctgagttctactttgaggtcaagataatcgacagtataaatagaggacccccggagggggggggtaaggcatcgaatcttagggcagacacccgccatagcagaagcaatctggaggactcgaatccaactcgtcgata

SEQ ID NO: 101261 - DNA, 668 bp, Oryza sativa
aatcattttcccctttttctcctataaaacgtgaatagtgcatttaaaatatattataagtgtatgtaatttaatgtgtaagatatggacttacagcataagatttaacttttactaaaactgtcgcaccacagtagataggcagttaagtgaaaaaccataaaaatagagaaaatctataaaaaaaatataaggtaggttgtgtgcgtgacaaaggcttttggcggggatgaagccagccatgtctacgacgtagatggggagtaacacacaactccgatgagaggaggaggagataaggtaaaaccgttacgcgagagcttgtgagaacagcgaagatgagggggtgttttggtcctactctacttcaattttcatttttttacttgaaaccaacgctcttaaacattaaaacccatgaaagtactaaatttattcaattagaattttgaagttttgatacaataactctcatttgaaaaacataaaaatattttaatgttgattttttttatttattcataatattatgattttgttagctattattgttatgttttaatatagcaatactactcaaagttgcacaacaaagacataaaaaaaattaattgtgtaatatatttacataggagcctttttggaaggaaattcgatatgaaatatat

SEQ ID NO: 101262 - DNA, 548 bp, Oryza sativa
ataaccaaacccaaattttttccccaacttaaccagggcttatggttatttctaagtctaagggccagcttaattcaccaaccaaaatttttggcggggcacattagattttccggccccgaaaaattcgtctcgccatttaccccccatctggattacttagttttttttttttttaattcctcatacattatccaaccattcgatgtggcatggggaaaatttttaattgggaacctaaagagggcctaaatgtatactttctacacttctttcattctaaagatgagtgtcttttcacactaccaaatggctcagatgcatttcttcctcttccttaatttgggctatatggggcataataccctataatcttcgacagagggagtatatactaaaaatacattaaacttcttaaaaaggctctcaagcttacatgtggcattaaaaaatgctctcaagtttacatgtggcgctttaataaattagataaaatgctaagaaaaaacaaaacatatcacttgatttcacttaaattggtgggtcta

SEQ ID NO: 101263 - DNA, 523 bp, Oryza sativa
aaatacaaatatatatctttttatgcatagcaaatatagttatcaaagtggtattataatctgactaacatgattaaatagttcaaatctcttttttcttctttaattaacgtgttaatttcattctctaccttatgagagtggtattacgttccttttctacgtctcctaaaccttgcaggcttgcagcctgatcatttctagctcaagtaataagtgatggatatcaaattaatgtgacattttcgtgagttggtttgaatggcaaatactccgtcagaaaataaacccaacctggctgacaactctatcggcacatcacggcgatacaatgatcgaatttggaattttttttcggttttagattttttttaaatatttacagaaataatctatcggcaaaaaaattacaaaaataggccctgccgcccacctctggggcggcaagctgacgtggcaaacgggggaggaacgggcggtgacggagggagggttttttgcaggaaaacccttgccgccctct

SEQ ID NO: 101264 - DNA, 530 bp, Oryza sativa
gagtggctaaagacccactacccctacatacttgagaaaaattacccacctatgccatcaaccgaacagatagctgagggcattatagactttagccattcaaacccaacaatccatgccttcaataatccatacaaacaaacaactcacagcttattctatgcctgcttattataatccagcttatagtaatctggcttaataatctatattataataatcataagttgaaacaaatagggtctaaaatgataatccaaaattagcgattaccgaactcgaaattaccagaaagaattaggtcagggtgcgtcaggcggcacgaccgcatgagagagagaggtgaggcgtcatttactcctctcgttcgttgcgattggcgattggctaggtccacagtaggaggcgattcaagattacgaaccagcgcaactgtgcgaaccggcaaaaggcgtaatcgaagctataacgacaagaaaaataacaaattttcggaactatttagattaccaatttacttattaagttgt

SEQ ID NO: 101265 - DNA, 878 bp, Oryza sativa
catagctaaatcctggagcatattacagcttaaaaaattggtgataaaaaataaactaatcagtgtgatccatgggtagcctactgggccaaaaaaaaccaagatttatgtgaaaaaattgaatgaacaccagatagttgttcgctttgaaaaatttaattgagcaatagactaatagggctctgtatgaacatcctaatatatcttctatatttgtgaaatacaaaacagatatttgggcctggtaacttatggttctggtaacattgagtactgacgcagaactaggctattcttagtcctgttccagattttaaagaaagtatacatgccaagtaaaaaaaatgctatagtccagaatgaacatttttttggactggatagattggtgttggtggtagggaaattttgcttagcattggcacaattatttgatctgttgtgtttgtgtgctatttgtctaaaaagaaaatttacaaactaacagaataataacatatacctgtagggggtgctcctttgctagtgctagtgttgttgatgttagactttgttttatgctctgcagttgattttgtttgtggtgtttttggtagttgggaacatacatcagtgttgtttgggtggttttgttctaggggtggggcattaccattatgtgctacattgttgccaccctgcttgcttccccccttgctcttctcttctccactcttctcttctcttgttgtggtggtatctttttgtgtgaataggcttgcttttgacatgtagacgcaatccaaaaccttggcagctagttgtgcattttttccgtatgttgtgtcagaatgttctcttgtgaaccacttgcaaactgtggaaatgtcatcaatgag

SEQ ID NO: 101266 - DNA, 620 bp, Oryza sativa
gtaaaaagaactggttataagcgaataatgtagggttttctggtttacacatataaaataattaacaaacttgaagtaccacgcatattaataatactaatttcaacaaacaaacctcaagttttatcttctcttgaatggaatttttaagtttgttctcggtctcttttaactttgtttttgttctgtcaagttcctttcgaatagactccttctctttcatcaaagaagatgatgacaagtatccaccttccttttggagagttaggagctccgatagaatgctatctttctccagctcattttgaatattacaatcctgagtacaagcaatgattttagaacataaccaatacataaagaatttaatcaccaaatagggcttaagcagtcacagacctccatagctttctcacaactttctaagctagatttcaaccgttgaagttcatctttctgatctagggattgttcatctaatattttctgaaatcaatggaagccaatgagagctgcttagaatgaaaatcaaacaatgggtaaaaagaacttaaacatgcataccttctccatttcaagtttgctgagtttttctcgcaaacagtttgaaatgttctcgt

SEQ ID NO: 101267 - DNA, 571 bp, Oryza sativa
caatgtaatggcattgcatgaacagagagctcccataattcaaagaatgaccacaagagaacaactacttgaaccagagcagttttaacagttagcgaatcaagatattctgagttgtgcactattagaaattcagtcaccctattgtgcataaggaaaagcagacactctgcacaagatttgctatagttgactgcagtattgcattacaaccacatgaaaaaatagaccagatcaatattgtgttgcttatgagcttttatataataaagttttgtgcagggaagcagcagaaaacgcagggacagtggaaagggaagaaaagcaaaaaaaaaagagagaaaggaagaagaggttaaactagagagaggggaacacaaaacaaaaaaacctccatcaattaaatttcctccaagttttcctgttctatcctcaacacacgttgtttttcagaggaagggagtggtggaaagggaagagaaagcaataaaaattaaaagatgggaggaaaaggtgaaaaggagggagggggaaacagagaacaaagagacaaacccccatgaagtaaaaa

SEQ ID NO: 101268 - DNA, 513 bp, Oryza sativa
agtagtccatcagacatgtagacgcaatccaaaaccttggcagctagttgtgcattttttccgtatgttgtgtcagaatgttctcttgtgaaccacttgcaaactgtggaaatgtcatcaatgagctgcatttaaaaaaaacacaatagaaggtgggtaaaaaaatcatatatacaaaactagggattaacaaaaggaaaaaagcacataaatcattataaaaaatgtattcatcatttaagtgtggcgaggagagggattgaaaagggtgattataatctgattggtaggattcatacaataggagtgactatattggagcatacatatacaaactaggaaaaaacaatttttttaaaaaaacagagcatttggaggagcaaaaaaaattactcgtgggttaaatgatttgctatggtattgccagagagcatcgttgcatgacatgttgctattgttgccctgttgctcaatgcaacgggcccctgaacatattgcgtcataacttaattt

SEQ ID NO: 101269 - DNA, 735 bp, Oryza sativa
cccctctgtcagcttcagcagcggcaacgcccttcgctgttgcaggaacgacacaaaccttacaagcaagttaaaatatattataaagaacgagtaagtcagtaatttctcaaaacctatggacgagtatttcaggtaatgtttaaaagaatgttatcctgtgagcaaaacatctgatcggagagaatatcgtaattggatgggcaatcgggcacactttttcctctatatttatatgttgtgtgctctttgaaatatcagcaaggtgatatgttggactgcgatctctcttatcacaaagtatgctacgaggcacagcagatactggaacttctatagactactgttcttgtacttgagtggtttgcacaggttacaagacgtttcgactttgattaaagttaaactactttaaatttgactaattttataaataaatatgataatatatcaaaaggaggtagtatgtcaaagttaaaatatcttattacctgaaacggaggtagtatgttattacaattttcagagatatatacatgtatcagacaactatactcgaccataaggatttggactgggaggatccaagagcagtcgccctacatacggcatcagttgttctcgtgaagttctagctaaagatgatcacatatgcattctaaccccagaaacagtaagagtaataacataggagggggtctgtcttcggatctcgtggatatgtgatcatcttga

SEQ ID NO: 101270 - DNA, 721 bp, Oryza sativa
  unsure (1)..(721): unsure at all n locations
acatcacttggatattatcagggacactacacatacaaataatttaattactgagtgatatgttaattaatatgacatgaattatctattattatatactaaagatccgttagatatcctacaaattctctcaagctaccacgtggcttcccataaacgttcctaaatcaccacatgacgctctaatatatctttatataaaaaattttgagaaaaaaaatcttacccaaaccggtggacctattttaaaatgttagatctatatcttaaaaataaaacctaccgatcgatcaggctgtcaaaatccatatgtacaattcacatatccacttccctcctcacggatgagacgaacccactagctttcgcctcttttttcttccttacgacaattaagttaacaactgaataaaagaaaatcctaaaaagaatttaacaaaaatggtaggcacattactttataccattagacatctaacaacttctactaacttaattatatctctcaacatgtatatgaggtctatttacctatataaatatgtaaagctaaatcaatctacaaacgtacaaatgaaatctngtaaatccatctatgaatgaagctctttttaattactatgtctgtcctataatgaatcctacaattttataggaattaagaaagaatgtaaaaatatactaagattcccctctctaaataaggctcattaaatatgtg

SEQ ID NO: 101271 - DNA, 650 bp, Oryza sativa
agggcgaattcgagctcggtaccccattacattgtacaaaggatgtaatgtcatttttttttcatctatccaaatgtacagggcacagagatagaatcaaatgaagactatgggatgttataggttatcacaggagggaggcatcacctatacaaatttaatccagcaagtctctgtcttacctaatgcaatttttcctggtgctcaggtggcagtgagtagaaataaaacacatattaaatgaaaatgtttaaactaaaaactttatgtgcacagtcataacccccactgtttttttttttttgcaaaacagggtggtcttaccttgctccaaaacacttgtggcaatttcatgcagctattgcaagctcctattgaatcacaagtggtggtggctgctgatcaccagtgcttcagtggtgagattacagagatctgctagcggtgatgagggatcagatcagaatatcccaactagtggcccaaattttgacaatttaaggttttttttaacttattacaacaaaaagaaccgtgccaagaaattattttagaaataaatcacaattcaacatcgtctaggatgacgctgaaatataatgtatccccgcacataccttttagcgggtagaacattatcacattggcac

SEQ ID NO: 101272 - DNA, 741 bp, Oryza sativa
agggcgaattcgagctcggtacccgtctaaattcgtagtactagcatatgtcatattcagtactaggttggttttttatgggacggagagagtagtcaaaatctgagtggatattttatcatatcacattgttacatcgaacttgccttgaggcatgtaaaaactaaatgatatgccctgtttagatcccaccctaaaatttttcaccctgtcacattgaacgtttgaacacctgtataaatattaaatataggctaaaaaataactaattgcacggattgcgactaatttgcgagacgaatattttaagcctaattactctatgatttgacaatgtggtgctacattaaatatttactaatgatagattaattagaattaataaatttgtctcgcggtttactggcggattctgtaattagttttttttattagtactcaaacacccccatatgacaccctatataatacccgatgtaacacgtcaaaactttacacccctggatctaaacacccccttagttctttcaaatgcctagctccaccactatttacattccatttcctcgtttcaatgtggcttaatatgtaggggtgaaaaccgagcggatttggacggacagtggtcataccatattctaaaccatattttttaagcggattcggagcggtgtggatagtgtaccgatgccgatgcggagcaaattgtttctgatgtcagaaatggtgtgggagtagtgc

SEQ ID NO: 101273 - DNA, 653 bp, Oryza sativa
  unsure (1)..(653): unsure at all n locations
acagtagttcatgataaaataagaaattagaaaaatgaaaaaagttaaagtagaaattaaatttaaaaattacttaaattcggatttaaaattagaggtccgattattatttaccccatttggaatttatttaaaattcggattaaaaaattaactaaaatacgaaatttggaaaaaattccgagaagttcttgtccgattttaatttaaaataacggtaattcaaatttataattacccacctttgaaagaggagtccttagagaaaaccattacgagattaataagatttcagaataaaaaataaattaaattctgaaattagaaaatttaaagtagagttcaagtaggaataccattttggaacaacatanagtgggaaagaaaaatagaaatataaaataatagtccgtataaaacacagtacgagatcaagtaaaattcgaaataaaaaacaaattgaaattagaaaaagaaaaataacattttaactaggaatacaatttataaataaataaattgctaataagaaaataaagactattggaagaagagaccatctagaacccacgatgagattaattaaattctgaataaaataaaaaattcaaaaatataaaacaattattaaagttcaggtggaatataattat

SEQ ID NO: 101274 - DNA, 571 bp, Oryza sativa
tagataaaaaaatgtttcatagttcaatttgtaatttttgtttggataactattgatttgattcactattcctggttgccaaaagaaggataatgaaggaatattggccacccaattggttaaaggattttcaatcttatttggatggtatgccaaaccccccaggctgaatggggccaattgtattatttcgttttagaaaaatttaaggatccggatcttaaattcttagttaattattaaccaaaccaccattattttaaaaaataaaacttgtacttaaaaaatcttggtggtttaaccaaatggataattctcttttaatttaatcctaacccaaaataaggaatggaatggcaagggtcttcccccattgtaaaggggccaagcggtaaattggaattatttttataacttctccaaataatgtaacttaaaatcaatgatgacagggttaattttttctcaaaatttctaagaatatttatgattttcaggacatgacacgtggcggcgtaagattttttttggaaattaaatctaatggttgaaaataacgggtctatcgatt

SEQ ID NO: 101275 - DNA, 560 bp, Oryza sativa
acagtagctcatcacatattttgtatataggaaaatataaggatacggatcttaaattcctagtttaattataaacagacaaccattattttttaaattaaacctggtagcttaaaaattctgggtggtttaaccatatggataattctcttttattttagtcctaccccaaaattgggatggaatgggcaggggtctgcccccttgtcaagggggcaaggcggtaaatgtgattaatttttataccttttccaaataatgtacttaaaaatcaatgatgacgggttaaattttttctaaaattttctaagatatttaatgatttcaagacatgacacgtggcggcggtaggattttttttgtaattaaatctaatggtttgaaataacgggtctatcgatttaattgaaatattttataatttaaaatgtgacatatggtgacttaagtgggctctaaaggtggttaattggcttttattgcgtagattggttaatatgaaaaatacatgttttcattctggtataaattttcaatttcattcaagtgccctgcgagga

SEQ ID NO: 101276 - DNA, 748 bp, Oryza sativa
gcacaggcgggcacgcaagggagctagcgaggccggcgacagagggaggcgcggcgggcggcgacgtcgccgtggtggcccgtggccaacggcctacgccttgggtggatttgaattattttttttaaaatttgggaattccaatgcagatttgattttgggaataaatctaatgaaggaatttggaattgggggccgaatgtgattttgtaatgttttgggaataatattttaaaacctggtaatgaaattttttttaataatttggtgatgtgggtgtggaaaataatcgattggaggattggagaagatccttttggtctgggatttgtgaagatcgatttgggatttcacaatttggggatgattttgggatggagtgaaatcaattttcaatgttaaaaacaatgaaagaaaagaaaaaaactggcaaccggacctggcttggctccatctttagtctcgattggtaacactaaccggaactaaaaatgaatttttaatcccggttatttcacctcccggattcatggtgccggttgcataccgggaatattgggggttaccaaccgggagtaaaaccccctttctctagcagtgaactgtcaaaattttggcaaaaactttacggatattttaagtaggtatctaatccgttaagattaaggataagaattaaattaaccttaaaattaatttgatcctcgacttgtggcaaacataaaattcctttatttaggatggagcc

SEQ ID NO: 101277 - DNA, 709 bp, Oryza sativa
actcatgatgtttttaagcggccccattgtaatatcactttctatagaaggaaagatctcctgagagagagacatttttatgacagattcagatgccatcatggctaggccatttcaaattttcaatcccttctcttctagtactatactgcagtttttttacccaaccctgatcgtgcagtgtgtacttgttggaacttgtcaaacttttatggcaaattttagttgttgcagggttgacaaatggggagatgaatggttggtgctttggtgggcacctgatgtcttggccatttatacaggtactgtggttttgctgtttgtacgtagtatagatggtagttagccttggtgtccatgtgccaccgtgtcatgagttggctggaacatgttacatgtatttggcttattctaatttggcttgtctgatctgatcgccaccaaacgctcaacatttaggcgatgaaaacagcgagagatcgctggagataacataaccccgtggtgttaatgaccatcgggtatcaagctcaccaatcttgatttggtcatggacattactaatcgtactcttggaagtttctctcttcgttggttggtcaggtctattgggacccacttgcagcgagaggagtggtgggcccacccctcgtggcgcaggtcgatgctggactgggagtgacgggcgcgaatttttgggctgcaggaa

SEQ ID NO: 101278 - DNA, 731 bp, Oryza sativa
ttcgctcaatgtactaatacttctccatgttttttttgtcttcatatttattggaatctggggtgcttattttttttcctaggtagttttcttttgtagtttgcgagagatgaaattcgatcaattatttcctatttacattagtattgtttgcaaaggtatgctactatttgaaattcatgtatatttctattccttatatttttacctgttttcagcttttcttacaactcatctcaatagttgtcagttgtgacatgcagactgtactgtaataaagtactctacagtcatttgttctgttcatattgctagctttagcttgtagggaacacaccagagtctgtaggaagtccttatatatcatatgctgaaattcatccatttgctactagaaaaagttttttttttccttttcttgatataaccacaataaacttgaactatttcttatcttcattatttgttgcttttaccttctctgaaatttgtactcactagtgaaatgttattatgtttgttcctcccaacagttgtgttgatttgagtaagtgatttgtttatgaggctatgtgaaaatgtatgacaaaaattcagttctgattaattggtaggtagatgcttcttgtatactttatttagtgcccatgtaattggtggctcaaaatacatcgcaactctttaatatcagccatacttagttactttatggcattaatgattaataccaa

SEQ ID NO: 101279 - DNA, 686 bp, Oryza sativa
cccgcgttctgctgccgcggcgcgcacggcacggcggagacgtgccgcggcagcgcgtactcgcgggtgttccgggacgcgtgcccggcgtacgtcagctacccgtacgacacggcggcggcgaggtgctacgcggaggtgtacgtgctcacattctgtccgtccagatggggcgcgggggcagatcgtgtggcccaggcttgacggatatgatgtgagacgtatcgagtagacgagtaacactccggcatgcgtgtatctaagtaggagtagtatgtactatatacggagtatgtatttatacgtgtactattacgtatttacattcattatcgggcgaacactttcgttatagggttaattaagtgcttcctcagttttaaaatataaatatttttagctacaaaatctaaataaataattatctatagatacatagctaaaatgctcatattttaggacgaatgtaataagttgttaaagttcagtagttctctgtaaaaagaatatcacgtacgtacacatggcatttcatagtcgcatgcatagtagaattaaaatgcctattatatcctcacctataccatagaaaaaataaagggaaaaaaaagcttggtacattaccatgcaattaattaagtaattactataacgaattaaaacactggatttgatagatttcttat

SEQ ID NO: 101280 - DNA, 519 bp, Oryza sativa
ggcgtcaaacatttaggaaaggagggagtaataaacatgaatagcaagtcgatcataaagttgagtgattctttatcttggttataatctgaaattccgaactgtgatcttctcccaaacaatatgcttacgtgttcactttcatttggtggcactattctgctgcagcagttcagcaaaaataggaaacctcggcaaatagcaatttcagaatcactgcattatagccaatagcagtcatctgatcatgcacacgacacatgactggatatttgcacatatggtttatattgtgatcatggattatttaattaaagtaatcagaaaacaatggtttcaaacacatgactggaaattgactgcaacttaagcccagtttttgcaccaattaagcactgcatccaactcagggccagtcaggacacaatttacccaataaaactcaaataatgacttgacacaaccaaaaaacaggaaaaaatggaagaatatttgactcataaaactcaaataatgttg

SEQ ID NO: 101281 - DNA, 657 bp, Oryza sativa
caatttttaagaaaaaatcggaaaaaaaatcttacgatggcacgattaattataagaaacgggaaaagaaaacacgaggaagaaaaaagcactggtcgatctgccattaactcctggagcttttgggttgttggcggatgtggcttcatcttctgctgctgcttcttcttcttcttcagctgcgaagtgcagtggccccacatgcagtagaaggaggaacagtggtacagtactacagtgtagctgtgtagtggctgctgctagctaatctgaatgtcgaaagggaaaaaaaaaagggtcatggcagtagtccacccaacgctatggataggtagactgttgttgttaatggctacttcgaggaggaggaggaagaggacgacgacgatgatgacaactgccagcggctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgaaaagttaatttgtcggcccactttaacgctcggtcgctccgccttcgggggc

SEQ ID NO: 101282 - DNA, 530 bp, Oryza sativa
cctttttttttttgcatggccccgttgctgcatggtttatatatatatatatataaaccatgcatatatatgtttcaatacatatatatgcatatatatatatatatatatatatatatatatatatatatatatatatatatatatatatatatatatatatatttatacatatatatatatatacatacatcatatatatatatatatatatatgtatatatatatatatatatatatatatatatatatatatatatatatatatatatatatgaccaaaatatatttacattatagaaaatgtttacacatgcatatagaaacatatgtagtcatgtattaattacaatccattatatgtcctagctagctacgatttcgacgtagtagtagtcactagctcagaagctaaggacctatgaattgtgtttccgtcgtagtaaaattcacccttgggatcaaggatttcttcgttgctgaatcccatgagttgttcttgaaccgccgcgataaattgggctgcagga

SEQ ID NO: 101283 - DNA, 925 bp, Oryza sativa
tattccttgtcccaggaggcaaggtacaccaaaaggtgatacaattcagagtttaacaagcggaagcgtaaatagttaattattacatgggcagcgacggcccagcacactcaaagacaatgaaaaacaacggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcttaaatacaaaggagtacaatggagttatagtataggggctaggttttgcaataaacagcatttaaaggacccttagttgctcaaagctaaatttaaaacacgatcctagaactatttaatattattaaacaaggctgtgaacccacacgaacctgccttaacccaaggcctacgatgattcagaccgaactggcaacccgaccctgggtcccagctcgtcccaagccaacccaggccaaccattccacattttagttattaagcaagttttaagaattaaaaacactaacttgggtacattgctaggcttgcccataaccgagggcacggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtactgacccaacccacctacggctggaacccccggacaggcaggcagaattgagcccctagcagcaagacaccagccctgtgccatgacatctcgactaccgggccgcagcccgtgtagccttcatttgtcctagagatgtccatcgacccccgactt

SEQ ID NO: 101284 - DNA, 853 bp, Oryza sativa
  unsure (1)..(853): unsure at all n locations
cagatcgtacagtagctcatcatatttaataaaccctttaagaagctcttaaaatgtgcactcatattttctggatatttcacaggatcctgccacgacattatatagaccatatgtcaattttgacaatgaagataaggtatttgaaaaatgaagtcaatgagccaaccttgacaatgtgccgtataagtgcatagactgaatttgtataaaaagggggctgtccaacaaatagttcatacctgaccaaccaaccagaaaagttagcttgaggtgtcaggcaagttggaagtggtggaatattgttttatatataaaaaagagcagagcaatgcatttgccatgatcattttctagcagaaagccaccaaccttgctatgcaaggctaagtaagggtgagaaagggaagcaaatatacccttaagaaacagattaagtagatgagtttttcattgaaaaattgtgcatggacatcttctaacatagtaaactaaagagaagaacaaatctaggcatcatggcttgcaatttatgtacatttaatccacaaggagtgttatgccttgcttacatcatctgggaacaactgggatgtgcanactgtattgcgatgtaaaaatgaaatggattgtgggtctcactcttcaaatcatgcatgcgctagagaatgtctgaatcaaagaataatatggtggttngtctattatctctaacgtgggtgtgctacagctagccatacagtacacaaaggaacaagaagttgcactcatgtcaaaagtcatgacagagatactattagtacagagcatcgtcaaaatagagcacatacagatgacgcaggacacaattgtg

SEQ ID NO: 101285 - DNA, 665 bp, Oryza sativa
tatactaaaagtccattaactttctagaaacgctcttaagtcgccacgtggtatttctacaaatactcctaaggtgccacatggtactatttaatctcaccgtcgtttttcacttaaattgttggacccattattttacaccattagattagatctattattaaaaaaattaataaattcctcctacttatatgaatacacagagtataactgttctctcgtacgtatgtacacgtacgattgaaagcaattacctactattcacaaaaagaatcatacaaacttagatgaaaaaagacagtcaaaatacatgtatccataaaaatcgatggtcaacagacgtacgtaggagagagaaaggacgactaaattctttattcaatctaatgtaatggtttaaaacactaaacccatcgatttaaataaaaatcgagggctatgtttttttaaaactatctatttatctatctattatatgctaaaagtccattaaattttctacaaacactttaatcatcgtatgtcactcctacaaacgctcctaagatgtcacatggcgctctaataaatcaaagaaaatcataaaaattctaataaaaataaaatctaaccatcgattttcctctaaataaggtggacccatcatgcattgtctaccattagat

SEQ ID NO: 101286 - DNA, 1584 bp, Oryza sativa
taaataaacctctaggaccatgtaatggggggatccccaaaaaattttacgaatcaatacaattacttttacattccaactactgttgagagaaccacgcctttcgacgtggcatagttgtccattcgacaacaatatcataagacaatctatctatctatcatatactagaagtccgttaaacttcctagaaacgctattaagtcgccacgtggcattcctacaaatactcctaagccgccacatggcactgtttaatctcaccgccaattttctattaaattggtggactcattattttacaacattagattagatctattattaaaaaaattaataaattcctcctacttatatgatacacagagtataactattctatggtacgtacgtacgtaccaacgattgaaagcaattacctgctgttcaaaaaagaatcatacaaaaacttagataaaaaaagacagtcaaaatacatgcatccataaaaataatagatggtcaatagaagtacgtaggtgagagagagaggacaggaagagactaaattgtttattcaatctaatctaattgtttaactactaaacgcatcgatttaaataaaaatcgagggctatgttttttttaaaactatctatctatgtatatatctattatatgctaaaagtccattaaattttctacaaacacttctgaatcgtcatatgtcactcctacaaacgcttttaggatgtcactcggcgctttaataaatcaaagaaaatcataaaaattctaaaaaaacaaaatctaaccatcaattttcctttaaataaggtggagccatcatgcattctctaccattagattcatcttaataaaaaaaaataagatagggaaaagacccatgtttttctaaggtggactcggacggtctatcatactatacagcacgtccggttacgagccggtttggccgtggcggcaagtttatcgctaattaacttatctctgtatatacgtagcacaagcggattagctcccatattgtgttactactaactcatagctatatttattatatacacggcaatatatataaatggaagctaggagattaacactaagattatacatatatagctaattaaattagttatatatgatttgtcaaaggagattaacagcaatataacgtagctaagtaaatcagtttgcatgctttgcagcaacattacatagctaatttgatccaatgcatttggcagtctctagataaattgtccagcttaaatcagtgtatctaagatctaatccgttttaaatcaccgtgatgtctttaaaatttaaaaaagattttttaaaaaaacaaaatacatgataatcggttttaacttaaatgtttagaaaaattagaaaaacaaagtcccctccacctcaccctcaccatcacatacgcactaacactttccgccccctccatttttgggcttgatttctcccctctccacttctctctatatctttgggagtaacaatgataaaagagaaacaagcaataatatcgaaacatccatagttatattaagctacatgtctcatatc

SEQ ID NO: 101287 - DNA, 1027 bp, Oryza sativa
caaggagttcacagttactagaactcttatgtgagtgtctaatagcttcaggttcagatatagtatctgggtccactaacatggtaccagcagcttgtgaggcatgcaaggccatttggtatctagctcatgctgttgacattatgtcccttggcacacataatttttcatttccattagctaactcatggagacaagttcatgcaaaactggatggtaaaatgcaagatcaaggatcattgccagcctcacaaaaaaaagattcattatcagatatagactctacccatctgataaatatatttgtcaaatcattcctggcttcaaaaccgatgcacgttgctgtttatcactgctgcataatggtttggagtctgctattcatgcttctcttcaggtaattctatcatgcttttaatatacagaccaatacattatattgaaatgtctctcttcaatgctatgggtctaacaaaatcttaaaaatatgggattaaaaattgccttaattctatcaatctcaattgcgatgttggtgctattatccactccctcctttccatattatatataagtaattttgagtctgtcctaagtcaaacctcttcaagtttgaccaggtttatagaaaaaatgtaccaacatctacagcaccaaatctgttgtgttgaaaatattcaccattttaatctctttttatagcatattcttttgtgttgaaaatattgctgtatcattatataaacttggtcaaacttgaagaagattgagttaggaaaaactcaaaatgacttataatatggaatggagggagtataatccaatcaattagtacattcttcagtgctatttctgttctcatcaacttttggacaatatcatccattgcctttttctctgattctaccatgtttcatcatcaaactactttaactatttattctccctaattctgattttatcatacgagattgatgagtaagaataaaatcaaaatggcttgatttcatttttttttaaaaaaaaa

SEQ ID NO: 101288 - DNA, 571 bp, Oryza sativa
agctcaaagtgaactgggcaaagttgtttatgaatggcttatgacatacatagcaagttcaaaaagagagtaatcaaaggacaaacatcaaaacccttgccggctgcggacactaacttgctgtatgcatctcttttttattattaaaaaccctcttaagtcattttttatacccataatatttctaaacattgacttattctttttcttttgtgttgttcccttagattaattatcttgattccaaagattttggaattagaagtattccaattggtcccccaccaagaatctctgtttggaaaggcggaatgataaaagagtattcaaaaatggatgaatgcaaaacaggagattttggaaagcgactagtaagtaaaatcaacagaaaaattttattgtgtcaatttgtttcttttttttcttagatcatactttgtttattttctcagatcaaagcaatggagaaattaagttatgacgcaatatgttcaggggcccgctgcattaagcaacagggcaacaatagcaacatgtcatgcagcgatgctctccagcaataccatagcaa

SEQ ID NO: 101289 - DNA, 529 bp, Oryza sativa
tgtgtggaatataggatggacttttggcattgtttgatgtgtggaatatgtgatggacttttggcattgtttgatgtgtggaatatgtgatggactatgtgaggactatgtgatggacttttggcattgtgatttgtgcaattggaacttgttttagtccgtatgaatttgtgaattgtgatttgaattgcgaactgtgaattggtacatttgtgcaatatggatcttcaatttgcagggaggcagagcgcggcgccaaccaccctggcgccgcggttaaggagggcggcgccagccagtgccgcgaggcagaagggtttcgggctggggggagggcggcgccaactaccctggcgctgtggtccatgagggcggcgccagccgaggcccggaggcagaagggcttcgatggggggaggaggggggcaccagccaccctggcgccgcggtctgggggggggcgccagccgttgcccggaggcagaagcgaaaattttgagggggggaagaaagttggtggggcccgtag

SEQ ID NO: 101290 - DNA, 507 bp, Oryza sativa
ggctatggccggccagagctggggctggagccccgaccagccccaacgatggattcgccgctgatgttagcctgctggagtgctggtctttagaaagttctgcctgggcattgcaggaaatgcaatgcaggtactggccctgccatgcagcaaatcttggtggacagctggctaagttccttgttattgtaacaaaatattttttagttactagaagtagtatattattggaaatgatcttgatatttttgacgtacaaaacactaactttaactatctgtttctctttttctcaagaacacaattttttttattctttttaattgatccaaggaaaaactttttcgttgtggatgtactttctatggttactacttacgccatttggcctttttcatatgtaggtgcaagtcctgagttttattctggttctccttaattatgttggggacgacaggatcattccatttgtgagcgagctatcacaattttttctaaaggtacggg

SEQ ID NO: 101291 - DNA, 596 bp, Oryza sativa
gtgaatgaaatggggcatgccctccaagctccgaggggtggtgaggacacggagaacacactctgcaatgttttaaaggtaaaatttatttagcactttgcattacttgagttatgcctaacaaacttctttttttttttgaaatgcagaaagttcgtcaaaggtgccggagactttcagcaagattaggttgcaagtcggttggattggacgacgtgtaccagccgcgaagactactaccaccactacctcactccgggcgtccaagtaccgctcgacactccatcaggatagaagagcgtgaagaagttggtggctcgtcgtcgtcacgcattccgcaagggaggggaaaggggaaggcgccggctccacctagcgacgacgatgacgacgacgaggaggaggatgaggactacgtcgcaccagacgctgaggagatagacatgtcgcagcttcccgacgcgcctcaggggatgcaacccacgcaatacaacttgcgatccacttgggcagtgaaaaagaggtaaaatgagcttaccattctcaaatgttatttgatttccctcattttgtttttaaaatgttttaaacattgg

SEQ ID NO: 101292 - DNA, 1889 bp, Oryza sativa
agagagagagagagagagagagagagagagagagtacggttacgtgaagaaactggctacttcagcgagaacaggttgcacaactctgctgttgcctcgccagcttcatggaatcaatcaacgccttcttttttcccctttgacagatgggatgccaaaatccctgctcaattttgtaacagaatttcattcatatccagttttcctgggctgaaattgaactggaaacttcaatccacgagagcttgatggattggatgttccctcttagtttgggaggatatggctttgtaaaacgtggagaaaaaaaaaagcttaataagtattgtcggataaggaacaatggtcccgtcacactgttctttctttcttgcctatgctctttttggttttatcattttttaaataatatgcaccacttttaacatatatatttttgcaaaagaatcgagagctggaatcggtcatagtagtataatactaattaaaatattagacaataaagttccattctaacaattatgaattaatgttaataaaggaaaatgctatgcatacgatttatatgtacgatcctagtacgttgcgaatggatggtgaacagaccatgggtttcttcgttgtaaaacaaaccatgaacatagaccatgaacatcacgagctagaatagaacctttacgtcgtatgagcattgtacgcaagaaaatcgtacgtatagcagctctagttattaagtaacaaatgcaacaatgtaattttgtttcttagggtagtaggtggataacagtactatcagagtgcatactctgttctcttttttcttaaagaaaatgtggattgtaccgtgaaaaatgggacggaaaagaatgagttttgatatatgcagggacctaataaatgtcaaaatctctagatctgatgaacttgcgatgcttgtgacctctgtatagtgatgggtataatggcatgtatgagtggattgggctcatttgctgattaatagtatctttcacgaagatgacatggatagctcaattattctgccaatttgcatggaccgtcgataattgctcagtgatcactcagcatgcatgtactacaatggattggagctaccgtcccaattagctagggcggacacttcactgcttcgtctcatcgtctattgcttgtagaagggtgagctatttaccaaaaacatagtacctataaggtaggctctgtgcataaacgaagacgtctcatatgtggtgtctattgtgacctatttgtccccagtactaagctcagcatgacggacaaactcaagtggggaaccatctacatataaagtcaaattgcaagttggtcagtggtttgtctagaggcaccaattgtacacgcactttttgagtgaaaaggaaagattgctgggtgaaatttctcaaattttgacaatggtatgaattatagtgtatggacaaaagttctatataccatttcttctctagaaatacctttaatttgtaaaaattaatgcggacaacaacagattttatcctaactatatatatactacctccatctcatgcataattacaaagataaatcaagtgtgtatggccccctttgaccatatatatagtacatgcttgaataaatcgagtgcatatgacctgaaagaacagaaggtttctttgattttaccctagagagggcaaatcctaaggataagtttcagacctaatcccaagagtcctagcatatgctttgaagtttaaccaagaatctacttccggggatggattctaatagctcgagtagacgtccacccgtttattacatgtcaactaaatggctacgaaaaattttcaaaaaaattggccagaaaggtccatatataatatatc

SEQ ID NO: 101293 - DNA, 720 bp, Oryza sativa
catagagatcataatttttcctcttctcttcatcagacagaatgtcatatgctgcaaaggaacaccaatacacttttaaaatgagaactccaactgatatgaacaatttgagtttgaagagggacaccagtaccccttattactttgagaggaaacacctaaatactaagaataattgtttattgaagaataattcagctaggaatattctttgttgacaaaataattcaatatcacagaaagaacaataataacaatttatacaattgtacctaccaatgggatgcaacttattaccaagaagagaaaagaaaacttgttgataatagtggtaagtaaattgtaatgaagcagatgcaaattaaacactgaccacaaacatgttggcttacataacttttctggacctaaagatattcaaaaggtaatatgcaacatttataaaagactcaggattaactgtaacaagccagctagcttgttcaaagcaagaattagcacatgtaaacgaacccataacaatgcagaaagcttttgccaacacgtgggtaggttcgttatgatcttgctttgagatttgataacaccattgcctaacatctattagtacagggtggcaatactaaatgcattattatctcattctcaccatcacataactaaaaatgcaaaatgaatatagctgaaatacaggcactgtaatgtacttaagtcgagcgt

SEQ ID NO: 101294 - DNA, 627 bp, Oryza sativa
cccaccgccaaggcgggatggacgaaatggaggcgtgttttgcagcgtgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtggacggaggagatcgtcagtgagggacaagcctagagccagcggtggaggtgcgggacaccgagctctgcgctatgcacacactagaagagcacgtccagacgaggagcactctcgccgcgctcaacggcctccacctagatctctagcactggcgctgacgggctaactcccgttgggatatgagcccgagcgtcgtgcctcgtcatgtgcgtgctc

SEQ ID NO: 101295 - DNA, 505 bp, Oryza sativa
gacatgtatggctgtatgccctggaccttcacaccatctttcttctcacaaaaccacatatcctttctctgcttgaaaaggaagtaagggagtgatagacgtactgaggaattctttatctcaccaacaccgctatttcttttcaaataagtatagaataatagaaatacctatatggcaccctttggtaaggattgctgatgccggtggtgatggcgtgatcaagccgctgaagaaaaatgaggaggctgtgtccaatggagaaatagggcaggtgagtaggtggagagacggcgacaaaagaggtggtggtggagcttggaggccaagggaggaagacagtgggaaacgacggcttttagggctggtttgctttgtgacctaaattgaccttagcaattttggttaatgctaaattttggtaagttttgacatggtcaatgttggtaaggaaaagttgtgtttggattgaagccaaaacaacctaatttcactattgaaatga

SEQ ID NO: 101296 - DNA, 567 bp, Oryza sativa
ttcattttaaagctgaattacagtggatataaaataatccaaacatataagtggatcaaatattagtatataatttagatgttatgttgcttaattgcttaacgcaattccttttgtttttctaactaataaacattaaaatagaagaaaaaataggtgaaaaagaaaggaaagaattgagggaatagggggacgtacgtaacgtacgtatatacttgcctacaggtctaggtgcgcccagtatttgggagatgatatttttagaagataaatctaatggttataaatagtgggtccgcgaaattaaataaaaatcaacggtgagatgttttgcctttttttagaaattttaagaatttttttatttttatgcccatctcgtggttgaacggaagggttacagggcaaacctacaaagggatgatcgcactctcacggcaaaggtggacgttttacaacgcaaatcgacaaatatggatgaaactagggtaacgtaaaagacatggtctaaaaggtaagggaaaagaatgattcaattgtgtagggattgagatattgggggctaga

SEQ ID NO: 101297 - DNA, 648 bp, Oryza sativa
taaattaattgagaggtgtgaagatgatgggttgaccgtgtgttaacagtgaaaatggtaatcgacaaaggcgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttagaaaagtgtgtttagtgtccgataaggactttatgttttccttttatctttaggttagtttctttcttgtccgataaggacttgtatcaacccatgggtataaatatgtacacccggggtctatataatctatcttcacgatcaatacaattcggtgcattgccaccttttaccttttctactttattttatcatccggcgggacttggcacctgacgcggggctgcatcgatgttcgatctccggcgaaggggtaagtccaatgttccatcggcctaggcaattgtctcatctacgtcagcgtcgttcaagactgcatcagtacattcgacctcttggattgctctggtttggacatctaccac

SEQ ID NO: 101298 - DNA, 695 bp, Oryza sativa
tcttacatagtataaagtggatatatatatattaaaggatggttcaaataaagctttagtaataaaggcactctctctatcccaaatatagcagaggggcattttagagatattaaggattggaaagaaatgtctaaaatacttattaatgcatggtagagggtaccgatgagaataaaatacttattaatgtatgggaggggttgctggtgttgagggtcggtgaggtgatgggccctatggtagcagtggagtaaaatcaccttttatataccctagatatatatttgagataacatttaaatttcaattagctatattttatgataaagattatcttaaaaaatattttaggatgaagagagtagtagaaactgcaattcacttaaggccatgtttagttcaggggtgaaaagtttctacgtgtcacatcggatatacagacatacatttaaagtttaaacgtagtctaataacaaaacaaattacagattccgcctgtaaaccgcgagacgaatttattaagcctaattaattcgtcattagcaaatgtttactgtagcaccacattgtcaaatcatggcgcaattaggcataatgattcgtctcgcaatttacacgcaatctggataattaaattttttttatattcaatactttatgcatgtgcccaaacatttgatgtgacaagatga

SEQ ID NO: 101299 - DNA, 587 bp, Oryza sativa
atgccataaaaagacagatggtatccaatctatatatcctatatcctatatagttggaaccaaaaaatctagcctttggatcctctcatgctttgatctcaaccatccaatatcatgtgtatttacaacttgcttattttagttatctatcttctatctatctatctatctatctattattatatactaaaagtccatgaaacttcctacaaacgctcctaagccgccacgtgggagtcctacaaacactcctaaaacgccatgtgtcactttaataaacaactggacccactatttttaattaccattagaattgttttttccacctccctctcctatccctacaggcccacattcaagcatccctgcacgtacgtacaaacatacaaacgtacgtaagaatctacctacacactatttgctaaaggaaaacaataaaaaactattcatcagaaaaaataaaaaaagaacatacatgtatgcacatttgtacccacggttggaaaagaagcgatcaattgttacccctttattttcttcggttgttcactacttaaaattttataaagtatatgatgtatcttatc

SEQ ID NO: 101300 - DNA, 534 bp, Oryza sativa
cccactgaatgtctaatttagtcatgtagggttgcaaaataatatatgatggtgcaacttatgttgttgagttatttcatagtttttaatggaaatttgaataaaatgtaaaaaggaagggatgttgtgcatcattaaaaaagattgatgtataattacgaaatatatgtcgataatgttttttatattccatcactatttggataacctgcaaagtgcacggtggaatgtgcccaaatgtcatatttttatataacaaaataaagcataggaagatagaactccataacttgataggcacttttgtactcagattatatcgcaagcaatcaagataaatattatgaaaattgttgaaaaaaatatgatataacatctgtagccccccgactcactagtcaacggcgaaccagttgatgtagtgaggcagagtaaaaggaaaatatcatataaagaataaaataaatgatgacttagcttttagtattcccgttgatgacagcagaggtagcggatgtaggaacaaagtcatcc

SEQ ID NO: 101301 - DNA, 595 bp, Oryza sativa
  unsure (1)..(595): unsure at all n locations
tacgtacgtttgtatgtttgtacgtacgtgcagggatgcttgaatgtgggcctgtagggataggagagggaggtggaaaaaacaattctaatggtaattaaaaatagtgggtccagttgtttattaaagtgacacatggcgttttaggagtgtttgtaggactcccacgtggcggcttaggagcgtttgtaggaagtttcatggacttttagtatataataatagatagatagatagatagatagaagatagataactaaaataagcaagttgtaaatacacatgatattggatggttgagatcaaagcatgagaggatccaaaggctagattttttggttccaactatataggatataggatatatagattggataccatctgtctttttatggcatnnnnnnnnnnnnnnnnnnnnnnntttaacccgaaatattaagatggtgaaagaatgtgcctaattcacttatactatagcattactaacaaattaaaggaatactctgataaactagcaatgttcagagttttggccgacatacccaaatccatctgttctggggagaacttcgagggcattgttatcatcatcctg

SEQ ID NO: 101302 - DNA, 581 bp, Oryza sativa
caaaaggaggtatggcaaatggcataattctggttctcattcgactaacgactgcaaagttttcaagcagcaaatccaggtggccattgagggaggaaagatcaagttcgatgatttgaagaagccgatgaaggtcgatggtaatcctttctttgttaacatggtacacacttctgggaggacagccgataggggaaaaaatctaaatttccggatgaattcggctagagttattaacaaatatcagaggaagcatgataagcagtaggaaaagtattatgaagaagatgatggtggttttgatcatcattgggattgtgaatttttcagattttgctggaatgaaggtatgaggctaccgtcgattgaggattgtcctggatgcagcaatgatgcagggagttctagccgatcctatatagaggcaatcggctgagtcagaaaagggtacctattcatcagaggttgggcccggtaaattaagattatcaccataatgaagatgatgataggaatacacaatggtgtcctacaagtattttcaccaagaatcagaagagaagggttcaaaggatgaggaa

SEQ ID NO: 101303 - DNA, 712 bp, Oryza sativa
aatcgtgtcgttaatgccgaaacaatctgtgagaatgaatcgcgtcattaatgccgaaccaatctccatccgttgcgctgttggtgttgtccgccgacatggtgaggatcgcagccatgcataatccaagaaaagagcagtcgcatggaagaacgctgcccaaaaacatgattgcccgcctacccatgctagcagcgcagtaacagaaggaggtaactagcgacgggaggagaggcatagagaggagacccgagaggactgactggcgaccggagagaggtagagtctctaccgagagtaacgatcgctcgggaattaatcgcgtcgttaatgccgaatcaatcttagggaattaatagcgtcgatgatgccgaatcaatctccgtttgttacagaacatgagagagagagagagagagagcaccaatatgagcagcctgcctcgtcacgggcacgggccgaccggacggtgctcgctcgcatgtggcagtgcgcccactatctgaatccggcaatagggactctcctctagttatctgttgaagttgagatctctccacttgaatttccgacgtggatttattaccctcaacatctaatgccggcctatggaatgcaatagaatcatagtcgtcctagagcattgatgacaacagtccctgtcttgaaggtgtctggagaaggtgatgatgatcaagtaccccgtgcgcaa

SEQ ID NO: 101304 - DNA, 669 bp, Oryza sativa
actgaccacaacatgtgtcatatgatcttgatgacatgtccatggacgtttgtagcagcctgtaatgagaaccctggttcccatttatgtgacaggtgggtagggtgttgatgtgaacctttctggagacaaaacgtgagtgagagtatatacaatgagcgtaatcactattcgtcattattatgcaaccccttctgctacatagtagtctaagagggattgcataattctagaaaaagggttgacacaagatgtaggggtgagacttttccattgcatataactagtgtgcaatacatcacctccttccatctattgataggcatagcctcatgaacttttcatatttagggatggcccattagtagataacctaggccatgccttcatgggcctgtcggttttctaacaatccctattgagcttacattgcatgatgcctatgcctcatcaaaacttcacaaaaacccaatgggaaaaactgcacaaatatgcctatgcctcatcttgatggcaatgattttttatatcaagatatttgaatgagtcagtgaaattctccgctcgaattttgcatttctatatgtatcattggtccgaatactccgacacatctattcaagaaaagatgttcaacgatctagtgggcaaatctgcaagattttacat

SEQ ID NO: 101305 - DNA, 2464 bp, Oryza sativa
caatggttaatgtgacaggacaaaacgttatcgagataaaagcgatatgtcattttcagtttttcacagaaaagaaatgcaatatggcttgttgcattacagcggattctgtgtctattggattatcaatctatgaagccaaattagtttgtttctgggcaataatgtgtgagctccacagtacatcacttatgaaacaaagctttacataacaaattagtgtttgtttttttttagctttgatctccccagtggctgggatagttattttattccgtcgtgtagcttcttttaaatgcgatatgccatattcacaaaggaatcatatgccatctcatgtgtcttgtgtcgcagttgcttgataaaatgggttaaaaattaaagatcgtgttatgccgcaacaagcaaacaaatggagaaaaactcgggaacctactgtcagcaggctcacttgataacaagcttgcaacatgtgcagctgaggcatccagcccctcagcgttcatcaggattcaggagcatcttctgaaagatcagtaacatcaaaccctacaaatacagatgtcaaagttatggatgaaataatagtgcatgcataccagacgagagatttgatttttttttaaaaaaatattttttgacacactgtaaattagagttcgattatttgacatcctgacataccatcatagactgagatggtctcacgtatcattgtcataagttttaatacaatcaaagtgacaataaataaagtgccaaattatcaaattttaccataatatatagagcaatccccatagtattgcgagaagtatgaccaatagtaaaggagggaattggtcataatatggaactttaacatgcggttgatgcaaaatacgccatgagaggggaatgggtttactggatttaatggtatatgcacaaacgaaataaatgtttaataatcacaagaagagcaacttggagtagggactgtaggatacacatatttaggctgtgtgttcgacatccattgttcctcactcacctctcttgtttttcatgcgcacgcttcacaagctattaaacggtgcatttttttgtaaaaaaaattatagaaaagttgctttatcaaaatcatattaatcttttttaaaaaatagttaatatttaattaataatgcgctaataaaccgtttcgttttgtgtgcacaagggattaactcccaacctcaacagccgaacacaaccttaataatcccaacttagaatctcccaaattttaacttctaagttgtaactatgcactacagagaaatattatctagtgcatggtttcagagtctactccatgccaacagtattaatcatttttgtgcgcgttaacaagatcattacactacagcaatcagatattcagatactccaagataaacagagcaggatatttatgtactcggtacactacaccaatcagatattcagttttgacagttacttcctggcagttggaaatggtgcgtgggctttttgttcatgcatctagcgagagcatcgatcacaacaagaggatgaccggtggtggaattggcggctagtgaccttttgagctcttcccatctgtagcaagctcacgtcgaaatgtgctgcttaacaaatcacggacattggcacttgctacagccctacacaaattctttctactctctcattccctaaatgtttgacaccgttgacttttttaaatatgtttgaccgttcgtcttattcaaaaacttttgtgaaatgtgtaaaactatatgtatacatgaaagtatatttaacaataaatcaaatgataggaaaagaattaataattacttaaaatttttgaataagacgaatggtcaaacatttttaaaaaagtcaacggtgtcaaacattttgggatagagggagtataaagttcaaactacttcaaacgtccactaagtttcacaagtcgacaaggcccagctaatagcgaaaatgacaagctaaggtacatcacagatcacagcctgagcacgaatgcaaaatatcacacacacacaacgaactatagagaactagagaaaatcagagaccaccaccctaaaacaggagttgaatggttccataatgtgaccaccatgatcaatatcagataatattggttactactaccttgcagcataacgaccaataccaagctcagataaatagagatcccaaaatacaagttcaggcaaggcaaatactgatgatgccaccacacaacagacagtggactcggataacataagccgcacccagcttgcatttgcattaacaccttggcttcagtcctgggggaatagccatgccaccggacgcatctcgtcacagcgctttcaggaggcctttggcagaggggagtcgacctgaccgcctctcatatcacacacacagaaagaagtgatctccgtgctgaaataatact

SEQ ID NO: 101306 - DNA, 600 bp, Oryza sativa
atcctttactttgggtgtgtttagttcacgccaaaattagaagtttggttgaaattggaacgatctgatggaaaagtgggaagtttgaagaaataatgtggaactaaactcgggctttatcagactgttgttttcttaagcttgctgacagttgatcgtgtgcaccattttttttttgctacccacgtgattcgttggagctagctttcttgacattctgtgatggcatcatatttagctggtgcgtgctgggtggtcaatctgcacaacttgcccaaaaactgaacctgtctttgcatgacttggtggtgatctgaaacaagcggtgaggctcattcatactagtacaacacagtgagagtatatgactagacatcattgtttttggcgaaaaacgcgccaacgccatacattctttgtagcttgatggcatagctctggcattgagctacgtaattgtgttttgacttggctgttgatgcggcgttgacccctgttggacatgtgaacttggctgtgcataatgtgcaattaacatgtggtacatgaacaagcccggatgagggagaggcaagctcactaatggtttatatctgtcag

SEQ ID NO: 101307 - DNA, 566 bp, Oryza sativa
aatatcagcttcttcaacatgggatgattctaaagcactattcgaagatagccaagagtacaagtaagggcaatcctctgaaaattactgtattgtgacaaatgtttaccatgcctcctggttatactaaactggttggtgtactggctttgccagctggaaggaagttagttccgtaaataggatacttgtgttcaacctggtggtaaataggatacgtgggttcaatcttgcaattttgtggggggaagcaatcagaattggtagatccatgtatttcaaggtgtcgtttagatgacgctgaagccacaaggcaaggcctaagaaacctggtctgcgggacgagcccacattccacgtcgtcgtgacgcatcatagatcgtggatgggtcgttgcctgatcatcgtcccgggcgtcaattggtcgctgcttggtctatgaagtctccatggcgttgcctcagccattagatggggaacaaactgaagaggggagggagtggacaagacagaaatggatgggggcgtcaattggtcgctgcttggtctatgaagtctccatggcg

SEQ ID NO: 101308 - DNA, 541 bp, Oryza sativa
aaaagggggcctaattctgataactgaaatgtctgcagctatttgcaatgagctgcaaagccagttattacttactccacactgcatgctcacaatgagtccgggaaattgagcctttgaaatggaacagtgaacctgagtgaaaagattaatcttgtttttgttctgtgtgtgttcaggggatatctacggaccgtgttctggacgtgaggaagctgctgggctcgaatgtggagacgtgccacctgacaaactactcgctctcgcacgtggtaatgcttgcttcttgtctgctaattcaatcaattgcagtgcttgcagtatctactgataattcaattgcagtgctagtactagcatctatcattccactcttaagtcaaagtgttaattactacttaattatctgccacttctttgctactcttctggaattcacccgggattaatttgaggacagtaacttttaatgtatgtgtgctgcaatgctgttaattctgtaactaattctgtataagctgtgttcggtgaagtctgaatt

SEQ ID NO: 101309 - DNA, 1062 bp, Oryza sativa
cccaccccctagggccggccttgcaaacgcgtaaaatattaccaaaatagaggagaactagtgatgcttgtaatgcataaatatgttagaataataatattccactagtattaggtatactaaccttttgcagaaaatgacaataaagtggaggagaatcgacatcaactcagacgataaatcaatcggacgatgtctacaatcagacttatgtatgaatgggtcaagaactcagaattggcacgatgaattgggccaaaattcacaagtctgcatatgagagcaaaagaggaggctgcctgtcacgcctggaatttctatccaaaattccaaacgcttacatgtgcgttaaatcctcgtccaggaatcagccgaggcacacaataacaaattgataatagagtactatcaaacagctaattaatattcgcaaaataaataattattacagaggtggatagttcctctcaaaagaataaaactctacgcagcggaaaaaaaacaaaagactaaacaactatggcgactccactccacaagcaacttgacccgcacaaagcataatcctccagatcatcaccttcactgaagtactcctcctttgatgaatgaatattgcaagaatgagcatatgacatactcaacaagccacacagcaaatatgcaagtgcacaggataacaaaggatggcataatacagctcaattgcataaacaacatttaataaacatttgagaaaatagtaaaacagttaagtaattaagcaatattaaatatacactatacaacacacccgtattgcataggcccaaccttatctgaacaaccaacccagttgtataaatcaaacctccataccaagaatataccattccaaaccaggagtcaatttaattatcacaaattatcaccaataatgagtagtgtgagactaatcacgaaaaacattgttagacccactcataaccgcgggcacggctattcgaatagttttactctggccagagatgtaccactgtacccacaagacacgattccacacatgttgccatgccccgaagt

SEQ ID NO: 101310 - DNA, 612 bp, Oryza sativa
cccatgttatcccttaaaaatttgtccattgcccccatctgagattctattaagtcatccacccttttcctttttttccttttctctctaccaagatgcatactttcttgacgacatggcctgataattgaaaaaaagttaacattattatagtggtttaactcatataaattacactacaaaattacaaatctaaatttaaaatcttaccaattagttgatcgcaagcatccagatgcacatgacaagtgagtcggaaacacacactactgcctttgtcactttgtccaactatcaaaacaactgaattaacctaacataggactatacatcagtacacgagcacatgacaaaaagctaacacatgatattagatattaacagataaaatcacaatgttacaaaatttcaattttccatttggtgatggaaaattagcaatgatgtattgatgtattggtgttgcacttacctcaacagaatcctcctcatctagtactcgagggcagccagcagcaagcaagaaagactgcaagaagcaggcaagcagccactgcagtgccaacacattgtgccgtactacagttgtgcagaacagcggaaaaggaaaaa

SEQ ID NO: 101311 - DNA, 2136 bp, Oryza sativa
atgattagccacatgtaaaactgaaatgtaattaacatataattattaattattaagaggtttaaaatatatttgttttttttcaaattaactgctatctccgttccaaaataattataattctaaattgtagagcatatattaagatattaagatttgagaagaaagattagaattgtgtaaatatatataggtaagaatgaaagattggttgagagtagaatatgaggaaatttgaatgagaaatgattaatgagataattaagcaaatattttataataaattaaaattttataatataattattatgggacggaagtggttctaaaatgattgtttttatactaaacgtattattattcagctgttcaataaacgagacgtcagacgtgcactgatcagtttctcttgcgccgcccgttagttttcccaacggctctgcactcttgcgggtggatggtgcgtgccactgggcttggctgggctggaaagctgacgcgccaccgccacggtggactggaatcgtatactttgggcgttttcgagcaatctccgagcgatcaaaagatctgacacgtcccgtggtccaatgtaatccgattgcagaggtagtagaagtacctactttttcagttcaaatttaaaaaagaaaagagaagggcttttttttttcagttcggtactttggcaaaatattactccctacatctatcctacatctacatatagtcatatttcatcttggcacacagaccaaggataagtaactctacttatcatttatttaaacatgctactagttattcctcgtaaacaagtaatttattaatatttatatttctcgatgcctatgtagccaatcttgtgtgaaagaattgagagtcacgaattaaatccgagaaaatcattaagaggataggttgttggattaaaatatgcctatcaaaaatatttttttcagatttaaaatatgactaccaaaaatagatggaggagtattgtactcacttagctttgcccgatgcttagctttgccatgtccatcatgagtgttgcgttctttatagtttgtacaaaaagcgtttggttgaataatagacctagattgcaaaggtggagcaattcaaaattcgtacaagaacatctggctcttttagcccagaaaaaggtacacgattcagcccaccgtcacctgttataaaatatggttaattggatcatcctattataaatttacccgttttaaaatatatcattactatttgcgaaattggaaccatgccattaaaatttcacatatacttcagatataccactacttacctattcactgcatttttcatatttttaggaccaaattatccattctccatccatccccttcttccttccccctctctcctctcttctagccgatgagctcacatagtggaagggttgcaacaagccaccgtcaccgggggagctagaagagagtggcggttgcagtgtccatgagctacaggcgaccacaatgttagagcctgtgtcgagggcgaggactgcagccagcgctaatctccctgtgcaccgccgcttcttggcttgttgctccagcgacgctgagtcacgtgggtgagtaagctctaggtgtgagatctcggcagcggcaaggtcaagccatcggatctagaggcaccaccggtcctctccagctccaccagtggtgcccctgcaacagctcttccagcactatagctgcttgctccacaagcctgttgtggagtgaaggcatgccccataggggcaacgatcggccgcagctagaggtgagaggttagacagagaggaaaggaagaagttgatggaggaagaagacaagggtattttggtcaaaaaaaatttagaaattgcatcaaagaggtgattagttgcatatctcaaacatctgttaaattataatggtagtttcgattttgcgaattgtagtggcatatttccaaatgtgctaatttataatggcatggatccaattaggaataagttcaccggaggtcccttaacttaacagcgagattttttaggttccttaaccataaaaccagaaatatgtacccctaaactcacgcaaccgtgcaaaaaaggggggatccact

SEQ ID NO: 101312 - DNA, 1140 bp, Oryza sativa
cttaaaatcccttatattgtgggacagagtgagtatttcatttacacaagcggctctgatactcccccactgcgataagggtccagatcacctagagttggctacaactccacctgatggatttgactaaatccgtgtcatcaattgtaattctatggctaagatgaagcccacctattaacttatcctaattaactctctccatcacattggcttgaatgaaaattacttactttcttcttttttatgttcctaatgggtaaatgtttctgccaacaaaattaacaaagtatatatgcacgttctcttctccaaacaagaagctatggtcatgtataaaacaatgttaaccgcatagtacgtgcaaacatacacataccgtatacacacacaaatattgctaaaaacgagccacaagcccagtacgtttttatacagtggatgaaccatggcattttcgagttatgcaagtaaaatcagtttgtatattctctagatatatattatttgttgatttgttacaaaaattaggacaagttagcttatttaaaaaagactagtgggaatttgttatagttcatctcaaccgttgttatatatagacggtagagatttgatcaaattcaccgggtggagttggagtgaactccaggggatccccacccctgcgataagcttaaagcagaggttttgcctttttctccgcccgtgaaattaaggggaagggacgaacgaaaaattgttttctaatgtgtaatgtgtcgttgatggtccttaaatatcaaatttgaccatcaactcctccataaaactatatcaaatgaaacatcagacctagtgataggatttgttactaactattttcataaatgttagcaaatatttgtatggattagattttattcgacaatacacctgccatacaacaaaatatacctccggccaatcaaacacggaacatagattgagagcccacaaaatactgcaaaaccatcatatttgagacctatccgatgtgcattgtcatacgggcccacatgtcatacactgggaggaggtcggcggccataggcggtttgccttgtttggccaagctgagaaaatggacatttagccacgttcaaaaagcggtttcgctag

SEQ ID NO: 101313 - DNA, 712 bp, Oryza sativa
ttcctgcagccctccttggtgacaatgctagcgaccaagtagcctccttcactccttcagcataggcgctggctagtcctcatttcatccccccttttctatttacccaccattgcaccatggaggcgttggcatccattcccctccccatccttgattttgttgttgtcaccgttgaggagcaaggaggtgaacaccaaacgaatgagtgttggagaccaacgatggttggtagtggtcagggtctaggcagtaagcaaggggatgcggcagaatgaggagccagcaagggtgaggtcaaggtcgaggcctaggcaatgatcaatggggctcttcagctcaatttgtttgccttgcttccccgttgtggccttctcccacaagtggttggggatccatggtgaggagggaatcatccaagtcaacaacgcggtcattgctagttaagttgcaactcttttttagctctgtcggccccttgaatctccctctttggcaccatgtccagcctcgcctctcatctacctccaccctccttgtcgccaccagacaccgctttctttcctcccctactcgcttccctcgtccacctcacccctccttcctcggtgttggtagtggcctcctgagcacgatgaggaacacatcagtagccaccttccgatccaactcagcactctacctccatagtagaaccacatcatctctcttt

SEQ ID NO: 101314 - DNA, 626 bp, Oryza sativa
catgtatgaggatacatgttcacttctaaagtaagtcctagactttcttgttacctagattttgagtcttattatctctgtctaaagctgttttttctcttcatgaaaacaggtatacattattctggatactattgctcatatgcaagctcgccttcagtttctatgttgaggttggtataatctgaacattacagttctctgctaatttaagtataggtcagatttgctaccatgtttccatgggtgattatatgatttattattgactaacatgtaacttctttttgccaaaactactgcttcaaagaactcccttttcttgctgtgctttatagtaaaaataaactagaataaaaaataaaataaaaaagagaaaaggattgattttgggtaggttttctaaataaagaggtgactgaaactataggcgagtgcctgttactcatccgaatgaatttctattccaatagtggattttttcagtccaatctttgagaaaatgcacgtgaattcaagagcatggcttgctcaactgaattccccagtttatttatagtttgtttttcactagataacagttacctcttttggtgatttggatgtatcttgtgtgttaaagatat

SEQ ID NO: 101315 - DNA, 508 bp, Oryza sativa
caagctctgtttagtttctatcttgaggttggtataatctgaacattacagttctctgctaatttaagtataggtcagatttgctaccatgtttccatgggtgattatatgatttattattgactaacatgtaacttctttttgccaaaactactgcttcaaagaactcccttttcttgctgtgctttatagtaaaaataaactagaataaaaaataaaataaaaaagagaaaaggattgattttgggtaggttttctaaataaagaggtgactgaaactataggcgagtgcctgttactcatccgaatgaatttctattccaatagtggattttttcagtccaatctttgagaaaatgcacgtgaattcaagagcatggcttgctcaactgaattccccagtttatttatagtttgtttttcactagataacagttacctcttttggtgatttggatgtatcttgtgtgttaaagatatattagagtgccaactctgctgctcagat

SEQ ID NO: 101316 - DNA, 2252 bp, Oryza sativa
atctgaaagaaacaaaaggagggcagccagctcggcggcaactaacggttggggtggttgcatcgcatcatcatggctctcccttctgccgcagctgaagaaagcggcatcgatcacgatctgcttccgctggtccccgtacgttttccccaaaatcttgttgcgttccggagcatttaggtaaacctcatgtgtggggcccgctctccctcgacgtgattgccggccacgtgacgagccgagccgagccgaggagtttgggaccgttgctgcggccgccagccttgcaaaatgcaaacaccaagatttgattaataaagaggaggccgtggttaccgttatttgtgcgctactctccacgttttcgtcagctgttaagtttagtaagggtaattgtgttgttgcacctgcttttgaattgtaagggcatccacaatgattatctataggctctctacaagatatccatgtcaacatattttcttacctagaagagattaaatgaagagagagagaacaaagctatctactaatatgaagatagtctatagagaaaaacgagacaatggattagagagctatagatacccatgtagacataccattgaagtgatttactattaatctagtctattactgagatgtacatgttttatagatgacaccttactttattattgcgggtgctctaattgtgattttgtctttttctctttggagtttgtgagtttgtttcggatgaacggcgatgtatgtttggaaaagcgagagtaaaatcgcaaaccataaaaaaagataaaatcacaattgaatacaattattccgtaatagtagtataatctgatgtaacttagtaagcttgagatgttaattacacacaaaaatacaaaatcattggaatatggccattttttctattaattatccaaaaatatatgacctgttaccccaattaattagcagtggcaaatgcaggttgggcttgattagttgattggtacgtgggcaattggacctgaaaagaatccatccctcgccttaatcatggcatccctgtactacgtcgtcgtccccatcttttcgttggcgccaatcgaacgatcgaccagatcgatcgcgatcgacgtgtgccggctcatgaccgagcaccgatggtgacgcgcactgctgctgatacatacattaacatatataatcttgggcaatttgggaggagcgaaaacgaaaggtttggagggagatatcgaaacgagcggcgtatttgtcaaatggaggaaaggtacgcagtgtggctttaatcatacgacaataagatggatattaaattacattattcatcttgctgataaaaaaaatatcagcaagatatattcatgggcgccacttcgttggcagcgtgtatttgcctgtgcggtgattggttggtgaatatgtaagcgttagagcaattaccgtgggcatctaaacataaaccaacataaacctctaagataccacgtatgactaagtggtatgtggacaaacataaggttaaacttttataactttgaggatcaataacatatttagtttataagaactataacaacatgtatggatttgttttttaaagttctataataaaagtaaatatttatttatttattatatatattataatagaaaacaaggttaaaaaaatatattttgaaaatcatgtcattgtttaaaacgtaaccgaaagaagtaagatggaggagagaagagtggagagagaaaaagtgccacccttctagcttaaaatggcaattgctccgcaagcagctgacatggcacactctggtctcgtttggctgtccaaatcccggtcggtccacgtgtggccttatttggatggtgtgttaatcccagcccatcattgtgtactgcatatgtgtagggctatttgggagcgaaaacgcgaaaggtttgtgggctaaatgaaacgagaggcgttttgtcaaaatggagaaaggtacaggcatgtgcctttaattaaaaaattgattaatgcggaagaaacgaacaaacgatcgctagcaagatctttaattacatgcatgttgctataaaaagtctatttcaaagatttttttaggtttttcttgagacatacatattccacaaagttgactagcgtataagttgatgagacatacatatggaaactttgttgctggcatgtaatcctgcggtgatcgtactctttatattcttcaaagggggaataaatc

SEQ ID NO: 101317 - DNA, 567 bp, Oryza sativa
atccgctgttccttgcgctaatctaacgattgaaaaaatcgacaaatttcaaggacagaaaattggcgatagatctattgcagaaccgatcaaagggagtatcattgtggttgcagataatacacaggtgcactctctacacgctgttgcttcgtcgtatcatataagtagatactccctccgtattttaatatatgacgctattgatttttttatccaacgtttgaccatttatctcattcaaaaaatttatgtaattactatttattttattttgacttaatttatcataaaatattttttaagtatgacataaatatttttttatatatttacacaataattttgaataagataaatggtcaaacgttgattgaaaagtcaacgacgttatacattaaaataaatacggagggagtacatacagtccgtaacatttaactgacaagagtgtgctaagtgggaaacttcagatgagaagtgacaagagtgttcaggcgagatgtatgatgtctatagattcatataagctggcatattaccaatttaccatacaggcatacatgg

SEQ ID NO: 101318 - DNA, 566 bp, Oryza sativa
cgacatagtaacgtgatatttatcgtggtcttacttgcagtaacaatgttgaaatgtagtcataatatagtcatgacggatctacttttgataagcattttttttctaacatcatggtgcaaacggtttttaaaagtagtacatgatgtgagagattttacccttcaagaatgggttttttaaaaattgggttctccacgagcagtaatactatatcataagtattactgctgatctgctatgcgttactgcaatcacatcacatcgttactacatgatgtagtaatgattataagtttcatagtaacatagtgtgttactacgattacttgataacgttactgcaagaatatgtatagtaagaaaaaaatgtgtagtaacatggaaagagagatgaattggctcggttaactcatggggcaagggtagagagaaccttacaagattggtcttttgaaatttaactctccacaagtagtaatactatatcataagtgttattactatctactgtatattactacaatcgcatcatgacgttattatgaaagtgtggtaaatattat

SEQ ID NO: 101319 - DNA, 566 bp, Oryza sativa
gtactagctacttaatttgaggaaacaatttacaaatgacttatcagtgctgtctcaaaactgctaaatgctcataactcaattttagagaggagagatcagggtggtggattctaacaaaaatatacaatagatacttcttctgaaaaaatgaaagatgcatgttaggaggtcccatgatgatgtcgtgttttagtcccatgaaaaagatacggacattttatgttttgccatcaatgagaaatagttccaaaaaaatactatcctatcgtacaagcaaattgtttaaaaaatgtgtcattaccattcatagattcaggttatgttagcccaatccaaattaaatgccctcagcttgaattggtcactcctgcaggaagattctcctcatttcacagtagctgggttgccgaatgctatgtgggaaatgacatccgttgagtctctgcatctcacgccaaatatccaacaactcgcacaaaccgtcatcaccaagggattcagtcttataacctaacaagctgttcttgcgcgtagaaaactccattggcatgggcaacaaaatg

SEQ ID NO: 101320 - DNA, 738 bp, Oryza sativa
tttgttttacctacaaacgattctcctcttctaatccccaagattttcttgcattttcttgactcggtggcgggaggaagaatggctgtggcgggaggggaattttcgtgggcacaatgaggatttctcggtgggattcggcgcgagggcatgtgagggcgaagcaacgccgcccacagcgcacccgactcgcttctccctgtccacttgcgccctcaaactggtgaggttctgcgtcgctttgtttggggacagaaacctacctgagacacggtcctgcactctacgtcgaccaaaatctgagctggcgcaagaaagttccgcgccagctcagtgcactgtgagaggccttagacttcccgacacctgctactcctgaaggtggtgaggtggtcagagagtggcctaaaacataaggtgtgtgtgtgtctctctctctatatatatatatatatatatagggtgagactattctacacccccctatagaataactattctataccccctcccctcaagagcccaccctatctctccctccttttattgggctcaaaacccacctcccaccccagtcaaagcatggtcaaaggacggtcaaatcgctgccacatcagtcaaacccgtgtgctaacttcctcccacgtccacctatttgttgtcctcgtctcgtacgaacggtgcaataacaggacgaacaccatgccgtaacgatgtagcttacttgcaataacacta

SEQ ID NO: 101321 - DNA, 594 bp, Oryza sativa
ccgaatcttatcataatttaaataatagatgttacttattactccactgctggccatttaaatataatagttggtataaacatattggagtatgagtcgataatgaccataccaggcagtcgccactgttggccaacagtataaatgcgatgatcaatcgattagcggaaaagtcttcccaacccaaatcccagctaaactcccttctattaatataacgttaatcaatctatttggtcgtttgaaaaatgttatggtctttcattttattcacctttctaactctaatcggctaagtaagtttgataagtagagaactccttagactaagcttaagtgcaaagataaaatcatggtctctcattttagtcacctttctaattagataattaagtttgctaaggcccctttgaatcgcaggattgagaaaacgtaggaataggaaaaacgtaggattttgataggaatgtaagtataaaatagaggattgcaaaacacaggaatgaccgtttaattgaaccataggaaaaacacatgaattggatgagagagatagactcaaaggaaagttagcaagaggtcgaaggtcttgct

SEQ ID NO: 101322 - DNA, 626 bp, Oryza sativa
taggctaatctaagcatatgcatggacatggacatatgcatattcagatttgtaccaggattggattttttttttacatgttagatggagtcacatgcaaaagagtatatagagttcaagcatgtaaaatttcttgatccgtgctttaacctcatgatactgcgaatcaactactcctatgaagttagcggacgttgacaattgagtgtcccgaggcagtctatgtcagaatgtcagatgattgtagtgtaccgactcaggggctcagggcgatatcactgacagacagcaacaaagcagccactgttttctgctgttaaatcgtaaccaccggctggcgtctgcatttcagatcgatttctgtcatcgcactcaagcaaaagccatttttgcagcgtcggattcgatgttagtgtttcacgggaaggcgtacggtacttctttttgggacagtaaacatcggcatttgcagcagtgttacgggtacgtcctgattcctgatggctaactggcctttttcgtcagtaatcgcaggagtcaccaacataatgatggtgcacaccatacgtaccagtttaccatgggaatgtgggagtcgcatccaaagtatttccccattattttga

SEQ ID NO: 101323 - DNA, 723 bp, Oryza sativa
catttcagtcacgtggagaaaaagaatatagattatgaatcagattaggcatgcaaagggataaagaaaaatcagttatactgctctcccaaactatttcgtcagaaaataccatagtgagattaagtcagtatttttctaaacaataatctgcagcattattagcacctgtaacgatactaaaataaaaacaaaatcagcaaagttgtgaatgggaaatgatcggtgacactaaggctcagttctattcttcaacttccttatttttcgttagcacgattttcaaacggttaaatagtgtattttttttcaaaaaaagtttatatatacaagttgttttaaaaaaagcaaataattcaattttcaaatttatgatcgttaatatttaattaatcatgtgctaatgaggtttctcattttgcgtgcaacaaaaatccaactcccaaaagagagatcaaacggggcctaagttaattaagtagtgtgaattggaaggtgattgagtgaagatcaagagagggtttccctcccgttataattaaggagataggtaggctgtcaaggcaatgagatagtaatggcaacgtccagctctgtaaataaaactaaggaagaaaagtgcgtggtaataaagaagtacagtgagaagaaggcaaagttttcttacgaagcaatgataacctaaattatagtcgttgtagataaaacaggagtatgggctgg

SEQ ID NO: 101324 - DNA, 608 bp, Oryza sativa
tctatatcgttagatctatggtagaaaaccaaaacctcccacacctcccacgttcccatatccgtgcgaccaggctccttgttcctttctcttttttttatccctatcacaatttaaattaaaattatgattatgcaaaacaatctcataaataggtgttaaagtccattaaacattctataaatatttctaaatcgttgtatgacattagagaaacatcgatccattggtttccacttaaatctggacacattaatttacatcgttattggatcttttttttactaaaaaaacacctcaaatcatcttcccttcctctcttcctctccatccctatgggcattttgccaagctgctacttgtctcacttaaattagaaaagattataataaatctgagaaaaaaaataatatccaaccatcgattttggcttaaacttcaacacattattttatgccgtcagatcaatcattttttttctaaaaaaaagaaacataccaaacctccctccatccccgtccccatgcggggtgcagcgttacttttctctgttttttctgtctctatgaaaattaaaattaaaattatttttatgggcaaagaaaaga

SEQ ID NO: 101325 - DNA, 621 bp, Oryza sativa
atgcttggtgtatcaaattattggactaaaattccttctttctagacatatgagaaaattataacacccaactaatatgtctagatgaataccaatttaagtggcttttgaaacaataatcatcaaggtatcaaaacacttagccacttgaagtatgatcaataacgaatcaccaaagtcatatgcctctcacacatgaactctaataaactacaaatgttagtaatcggcttgagcatgttggcaaaatattaaaacaaagccaatgttcgaaacataacaactctagaacaaatcatcacattgaccattgacattagacgaattactaataagcaaaactttcatggtgcaataaatatgaattatatatattatatggtgatccataaaaacacatatgatttggctttaaataaatatcaaagactcatgagccaaattagactttaaacaaatcatatgccaacttaccaattccactacttagaactagcatttgcaacatgtatgtataatatcaatttgataagcaaaaacacacatgtgctagatagcaagcaatgttctaacatggcataggcatataatataatgatgaacacaataaacccatacctt

SEQ ID NO: 101326 - DNA, 613 bp, Oryza sativa
tggattttatgtggctaacccacgtgtctttcttgatcgatggagttatcatactttgacttactggcggcaagaaacctgaatgcgttaatttactgtacatattgcagtatactctaccttggtttagggcttggttagttcccatatttttttttccaaaaaatcacattaaacctttggacacatgtataaagcattaaatatagataaaataaaaaactaattgtacagtttgcatgaaaatcgcgagatgaatcttttaaacctaattagttcatgattagattatccataagtattacagtaacccacatgtgctaatgacggattagttaggcttaataaattcatctcacggtttcaaggcgagttatgaaattagttttttcgttcgtgtccgaaaacccattccgatatccggtcaaacgtccgatgtgacacccaaaaattttcttttcctgaactaaacagctaaaccgggccttaattgattcaccatgttccgagttctctgagtaaactctgtaaaaaaacgtcaacacatcgacggtttcaagctgaaacgaagcaaaataacccacttacctgaagttatgaactcatattctgt

SEQ ID NO: 101327 - DNA, 624 bp, Oryza sativa
ttattttttattagaaattttaactaatctcgtattggattcttatatggattcttctttcaatatttcttatttttaatttcgaatttcagctaattttaaattgtattcctacttgaactctttatttattttcttttgctaatttcggggttgtttttatttttattccgaattttaattaatctcggactgggttcttatatggactcttcttttaatattctttatttttaattctgaatttcagctacgttaatcgaagaaaaagaaaaaaaagaagagtccaagtagaagtacaatttaaaaatagctaaaattctgaatttaaaataaacaatattgaaagaagttttcatataagaacccaataagagattaatcaaaattcgaaataaaataaaataaaatctaaaattagaaaaggaaaggagaagtttccatataagaacccaatacgagaaaggggtttctaatcataaattcaaaataaaaataaaataaaattccaaattagaaatcaaaatgagattccaagtagacatacaatttaaaaatagctgcaattcagaattaaaaataaccaatattgaaataagttttcatataacaaccgaatacgag

SEQ ID NO: 101328 - DNA, 643 bp, Oryza sativa
gctcaattctgccaaaccaatttcactcatatgcccaagacgcatatgccaaagattaatagcatcggaattagataatgaatcagaaattgtagcaacattacctaatatagttgtacctcgcaaatggtacaggttggcagatttaatatcagctttcatcacaacaagagagcctttagttaccttcaaaattccatctccaccggaatatttgtaccctttgcgatcaagagtacataaagagatgaggcttctcttcaaatttggaatatgccgcacatatgacaatgttctgatacagccatcaaacatcttgatctgaactattccaatacctgcaacctcgcatggtgtatcatcacccatcaaaacagtatcaccttgcacagcttcataggtggcaaaccaattcctattcgggcacatgtgataggtgcatgcagtatcaagaatccactggtcactagtttgtgcacaaccagcataagcaacaagcaattgtgcatcagacttctcatcaataacaactgcggctttaccttcctcttctttcttaccttttggtacatattttccggttctcttgtctttatcctgtagcttccaacactcagagatatcatgtccatctctcttgcag

SEQ ID NO: 101329 - DNA, 530 bp, Oryza sativa
attcctgcagcccgctccccctcgggctgcgacgtccgcgcggccccctccaggcgccgactgctggcacgcgccgccccgccccctcggggaggagatgggggaggtgttcctccacaactatctcttcccctgcgctgccacaggccggctgataaccaaacccccatacctgcagtgcataaacaacaccccctcttgatgcatacagtgccatctgaaaggcctcctcaacgcccatcacaatcttaacctataactaatctaaacacacatccccaataatcataggcataatggatgcacgcaccaaatactaaattactgaggattgatatactaaagaaagcggcaccccattcctgagataaaagagaataatattctaaatactatgaaaagagagcacaaagctagatatggaattgattcttcattccactatgaacggagaataaagtcatttatactatgactaactataaacacgcgtacaattgccgcatctgcgaaaaatgtatgtgatgaga

SEQ ID NO: 101330 - DNA, 554 bp, Oryza sativa
ctaagtaacaggcctataaaggagtagagtggtgccggttgatacgacatataaaaattgttaataaagcatcaaatagaatcctaatgacgattaaaaaggagggacgtcaggcaggccgtgaagcaaacgagtaaggcggttgccgggacttcttagacagtaaaaaaacaaaccgcattgataatcgtattcgatttttaaaatctcaatgataataaaaaggagaagcagcgggcggagtgtataagagtatagttgcagagccaccgacgtttgacgggacttctagaaaataaaaaatgaattccaacgatagttatgttcgatttttagaatcacaatgacaataaaaaagtaggcggcgaacatgctgtagaggggcatagtggcatcgtttgataggacttctaaaaattttaaaaaatgaaactacaagttatgttcgattttaaaatctcaatgacaataaagaatgaattacaatgatagttatgttcgattttaaaatctcaatgacaataaagaaggtaggcagcgggcgagccgtagag

SEQ ID NO: 101331 - DNA, 607 bp, Oryza sativa
cctgcattgcttcatttttgacgcctagtttcttggcatgtttactgctctaattatactacctctaattcaaaatatggcttacacagttacactacaagcggacatcaaaatggaggatcttttacacggaaaaaagggacttaaaaatatatgggcgtgcaatatgatcacattttttctttctttatactcctaattatagtaatgcagattatttttttaaaatatactttttttaataattcatgtttatatacatgcatggaaaataatagtagaaatatacacttgaagtggagacgctcacaccgcagtgcggatttgtgagcgcaccctcgtgatcgatctatgacacacgtatatttatacaattcctccccatatataagcgtaaattattaaaaaaaagtgtattctaaattttgttcgtttagcttaattgatcctccaatgcgcattattgcacctttgaattatttggtaccttctgctaagaaacatgaggagattttatcatgaaatctacttccttcagaacgcctagcttgggttcaatctattatttatgcaaatcctcaacaaccctgccttgcaataaagccac

SEQ ID NO: 101332 - DNA, 612 bp, Oryza sativa
ctggtggtggtggtgctgctccgggtcccgcggctccgggtggtggtcggtggagcgtaggtgggcatcggcggcgcgcgtggccccgaggagcgcgttgatgagatcgtcgcgctcggcggcctcgcgctcgaggcggtcgacgcgggcgcgcagcgcggcggcgtcggcctcggcctcggcgaggcgcgcgcggagggaggcggcctcgtcggtggcggcggtggcgcgggcgaagaggcggcgctcgttgtccatccaggaggcgcggtggccggcgaagatctcggcggcgcgggcattggcgcgggcgtcgtcgcggcggcgcgcgcgcagctggcggagctggtcctcggcggcgaggaggcgcgtggcgaggacgcggccgcgggactggagcgaggcgaggtggcgcgcggcgggggtgccgcccgggagggaggcgaggaagaaggcgaagctgaggccgagataggaggcgagggcgtcgccgccggtagcggggtcctgcggtggcgcggggctggacgctgcaggtggcgtcggcggtggcggagcagccgccgccattttctctaggttctactcctactagtgtagtgtagtagtgtg

SEQ ID NO: 101333 - DNA, 715 bp, Oryza sativa
aagtcattaagatgataggttgttggattgaaatatgcctatcaaaaataaatttttcagatttggaaatatgactatcaaaagtagatggaggggatatatagcaggccagtccatgcattcattaaaattcaattttgtcccttttatgagtttactgtagcactacaaacaggtgcttggtttattttgaaaaatggatttatgttctttcaaatagtctacatttaaccgtacgcacaccacactcgcgcaccagtgtcaaccatctgcaaattcatagtcacaataaaatccaatagaaagcgcactgtgaccaaagtaatgttagtggtggacgtaggattctaaaaatgcttgggggcacaaagttgaaataggtagcatcaatatatgacaaaacctaaagcgtatcaaaggaaacaaaacatttttatgttgaaaataataaattacgtacactaagaaaattacttataattaattgtagttgttttttattgttatttgcaattctgaaagcaaatacagcgtgctgttaaccatatatatatatatatatatatcacacttttaactatctatcaggaaataatgtgaacatcacatagtatatatatagcactaagctaaaagtcaatatttggttgttttcacttttcacagacaaatgtgtagcactttcgtggaacatgtagcttaattattcaacgca

SEQ ID NO: 101334 - DNA, 761 bp, Oryza sativa
gtatgggcctgtcccattcaacgggcaaatgctactccaacttttccatcacattgtttcaatttcaaccaaacttccaattatggcgtaaactaaacacacccctaatatcaatttcgcacatccatatttcttgaaatatttaccaagacttcaccgtacagaagatctacttatgaaacacgagaagaaatcagtaccacccatgctactcaaaatttcaaaatgagtggaaactgatatctcgcaatatgaaacatcagaatacttcatcacaaaaacatcatgactgcacttcgcgctggttcatttcaacatctatagtgcaagtgcggaaccatgtactccagcacccacagaaatttgaactgcgagcagggttgaatgacaagacactagacaacaaaatgaccaacatgatcatcatccagcccctgcccctagacagtagacaacctagtagaacaaatccccaaataacaatagaataattctgacaaacaaccatgacattttaatcatccagtatctagcagacatgaattttccagaaaggacagctacatgattgatcctatccaataatttgtgaatgaataacataattaatcagtgctcacaataggtgtaaaatcggctcctatatatacatcgggaaccaaatgcataaaacgaacctatatacgatatttgttaaaatgaacataaacatacgatattcatagaagggtacagagctcgaattcgccctatagtagtcg

SEQ ID NO: 101335 - DNA, 1383 bp, Oryza sativa
ttcggttacttgcaattttgaagctgtgcattggcagggtagttatcaatttcatacacaaatgaaaacatagggaaaaggccgaaaggctaacgggcgatcgatcgctgccagcgatcgttttttttttcttttcctctttttagtaagtttatacctaaagtttacacatctaaactttatccacctaaagtttgtagagcgaatgtgtataagtcaaaagtttatatacccgattcaaattcgaattcagattcaaatattttatataaaaatatttctatacacaaagtttatacgtgcaaaatttatggtataaagtctatgcacatgaatgagagtattagattctaattgtcttttacttttttttgaaatttatgatgtaatagaaaagtttttgaactcgtcattttgacggtttgaaggatagatatatgaggaaagatgatacaaacaattaaagttctttgattaatataataaagcttttagaatgaccctttttcctaggggctgttagtgggcgggtaatcgtttccctctcctcctagcgatcatacgtccctccctctaatactcctctttcatctctctttttttaacaaacagtgcccctaattgaagtactcagttgacacttgacagtgtacctaccagtgtttaaactaatcaactccttcttaatcacttagacattttctgtcccatatctgctagcacgctcctcctcctcacaggctcacacccgtttgtactcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcgagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaaga

SEQ ID NO: 101336 - DNA, 560 bp, Oryza sativa
catgtgccggctccactcgatgaacagataggtggttttggttcaataacatgtcttgatagtgtggaagagagatcgatccaaaaagatcttggtcataattggaattgggagaggcaacattagcattggaaccatcatcattataatcatcttcagtttcctcaatttgatggggtgttggctcgactcgaggaacaaatatgtgttttttgttcaatagcatatcctcataatgtggaagagagattgatccagaaggaacacaaggcttgggtattggaatttcattgcatttatgtgctatatcaagcatctcctgtccaaagtgaagatatccgtcatgttacgacaattttttcatgtgtatatggacgttatagcaaccaattaaataatgattgaacataggatcttataaaattccttaagaatagacccacaaaaagcccttaatgggctggcttattgggaaaaaaacaacttgtcttaagatgattttgttgcataatataatagaaatgttagggtggctagtttaggtcactttctcgaccttg

SEQ ID NO: 101337 - DNA, 549 bp, Oryza sativa
accgttcccttatttacgaagttaaatgtaagtacattgtgttgctgtctcgttgataactggttgacttgccatcaaaatgccatcgaggtttgggaagttgttagtaccatgatggagctctagtttatttgttgtggcttatatgagagagcaagtatttagcatttaccttcagacttgagtaatgattcaatgggtaattatcatttgtttgtcgtattactaaagcaatggtgtttgttctatggttttattacaaacaaagtaataagatgctgacataattcaggaatttgtaatctgatctcttatctgctgtatcaaatttaaatttttcacttttacttttctccatcacagggaaatgatatcaaggcattcaagtcattttatgaatcacttgtcatgaaaataagacaacagcagaatgggagtcttgtcttcagatagcgtcattcaattattttaaatctgtttgccagtgaaagattcctcagttctacaatttgaatataggtagttatttcattcttttcttggcttatc

SEQ ID NO: 101338 - DNA, 773 bp, Oryza sativa
gccatcgacttgcttatccaatattcacatgcctatcaccaccttgtaactaaccttagaggaactagcctacgctctcaaaagaagagcttcctagtgagtaaagaaacattaaaatttaataaaagggaccaacacggtttacaaaaccaacaaaaactgcttgattttcatgcaattttgaggttttgaactggcttgagttaacaaaacagctttgttaaccagtcaaatagaaaaccaagtgaatttccaattttaaatgaaatatatctgaatttcatcatttctttatcaatttttcacaaaaaccaagaaaactgctaaagagcggtttccaatttggtattgcggctttgtgaattttggagagcactcgacaattaagtagggttagaagctcaagtattttaaagaaaaaatcttgtcagcattaatttagttatatcatcttcttgccaaaaaagtataccatccacacctattaaagctcctttgaaacattggattaaaaaacggagaataggaaaagcacgaaatttgataggaatgaaagtataaagcacaggaaaacagacaggaatagtcatttgatttataaaccacaagaaaaaaatgcatgtatcagaagagagaaatagactcgaagaaaattttccaagagatatgagatcttgctaatttttttcaaaatctatatgtaataagtcattccataggaattttataggatttaaaaagctccaatcctttatatcaaagggccaaatagg

SEQ ID NO: 101339 - DNA, 768 bp, Oryza sativa
cgaaagttgcttaaaatattactccctccattccatcgatctacatatagttttttttgaggttattcctaaatgatctacacatttgtgtttatttattagagtctattcgttatttgtgcattggagtaaatggacattgatgcatgcattccatgcacacaagtatttataacacatatacaataccttgatttattattggctaggaaatattggggatggtgcatgcattgagtttgttgctagagtaaatatagtatgagagagttattagcttttcttggtcttggtatacctatgaaatatgtagattaatttggaatggatggagtatattgatcaatttttttaaaaaaaaaatagctaatacttaattaaccacgcgctaataaatcactccatttttcgtgcgtgggtgatgattcccaacccccaccaccgaacaccgatcaatcatctattggggtcgggagcacttcacagaaatagcagacatcccacaaggattgacagtttaatagatgatcacaaaaaatcgtcacattgacatcccacaaggatcaacaatttaacagatgatcacaagtcagtctcacatcgacagagtagacgtctagacgagcattaacctctgaaatctcaccccaaaaaaaatgcaaacaggaaaaggctaacacaaaaatataaacaggagaaaataaaaaaaggaaaaaaaattaacgacgcctgagagattcgaactctcgcggggagaccccatgtact

SEQ ID NO: 101340 - DNA, 941 bp, Oryza sativa
attacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaat

SEQ ID NO: 101341 - DNA, 763 bp, Oryza sativa
caatgcgtgacaaagcaatgcgtcaagccgagttgcagacaaaaagcagctagtcagaaagaaagaaagaggtgatgctgacaagcattttaattgcacttttgttcttcattccttaatgatcacactaatacgattttgcatcgtttacatatcatgtcagcaaaagcatcgcgtctcttgacgccgccgcacccgagcagagcgtattcgatcaccacccgcgccaagagcgcttgtcgatccgatccggtgcaggacaacttcttccatcatcccggctgaggatgcttgctttgctgagctaattgcatgcaagagagcaattgaaacaggccaaggaagtcagagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatatcatatttcccacttttatctcaaaaggtacaagttttaccctg

SEQ ID NO: 101342 - DNA, 727 bp, Oryza sativa
cagataaaaatgctaaaagcgatgttgcaaaacaaaaaagaaaagacagagaaacgatgaatgagatgtttaatcgtgcgctaatgagttacttcggtttacttgcgtgagatgttagatcctactccctttctaggttaggtttttttggatttgggacggagggaatacatcctagccaagtttgtcaggccattttagattaatgccaaaacatactctaccaatatttaaatagttttctagatatattttggtatttggaatagtgcatacggtggtttatatcattggcattaccaatgtccaatttaaaatttctagattccactcaaagctttgctctaagttgacattaaaaaggcaactctacctcagaaaaaaaaattggtggtaccaaaatttatctaagttttggcactagcagggtatacaaactagctcgtcatttgtcaacattgacaatctttcaaataaaatcttagtgccctataaaaaataatcttagggagaagaaaatggagaatttaaaacatttagtatatacgcctaactgcaagtccaaatatactttctctagtcaacattactcgtcgtttccgagaagcaatttgcactgagtgtagtttaattgagttgtctgaaacgacgtatatttctgtccagagggagtatatatttatggcaaaatttgctacgggactcttaaaaaacgtgtaattagctg

SEQ ID NO: 101343 - DNA, 619 bp, Oryza sativa
agcagataagagatcagattacaaattcctgaattatgtcagcatcttttactttgtttgtaataaaaccatagaacaaacaccattgctttagtaatacgacaaacaaatgataattacccattgaatcattactcaagtctgaaggtaaatgctaaatacttgctctctcatataagccacaacaaataaactagagctccatcatggtactaacaacttcccaaacctcgatggcattttgatggcaagtcaaccagttatcaacgagacagcaacacaatgtacttacatttaacttcgtaaattaagggaacggttcaactttttaaaattgcaatgatagctatgttctagcttttgtgcagttagcaacctcaaacacagtggaatcaaaagaacaagcatacctgtaacttttggtagtactgttcagcaaggtctggtgggcagtgtgcttctcgaagttttgttacaaaatttacaacaaagttctcgccaaatctttcatacataaccttttgagccatcatgattcaccaaacagggcaatctaagaaagaagcagattagactaagctcttgaatgtaaagaaatacatccatcaccacgcaaaag

SEQ ID NO: 101344 - DNA, 537 bp, Oryza sativa
ggagagatcgctatagcttccacgcgcaaagcgcagggccacacgtgcgtgtcgacgtagacatgacacggcggacaggcgaggcggcgcggcgcggcgcgggcgggggcgacggcgccgaccagcggacggcgtggtgggcggtgggcgcgtcgcgtcgcgtcgtgcgtgggcgaagttggtcggcgtggcagcgcgcgaccgcgtctcggtctcggcctcgttgctcacggcatacgaagccttgggcttttacgcacgggagaagcccacatatactgattcttttgggccgtcaatctgaggcccaatcaggctcgaacatggcatatatgctgcgtggttttatattagtcccacctcgcgccctagacctgattggaagaggagacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttag

SEQ ID NO: 101345 - DNA, 523 bp, Oryza sativa
acagtgtaatctgaaaagtaccttgtacctagcatgttctactatttacaagtcgtatgaacagatctagtgaaaatcaccaagcatcaatcaaggacgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggccttgccgacgagccctcttaccaccaccttcaccccccgcgcaacgccgccgccgccgcccttcgccggaacagccgcacggccggcgactccgccatcacccgccgccgccaccgccgccaccttagcgccatgaaaacaccgcagtgggagctccatctttctcctgcaa

SEQ ID NO: 101346 - DNA, 643 bp, Oryza sativa
tcagttgaagatttattcaacatttattgtgatataaaattattctctctcattttttttccaagccgaacaagaccttagtttgatgttggtacggaaaagcctactccataatccacagtttggtgacaccttaatctgagagagtagttatctaggttatgcgtgcttcaggtccttacgctctcagggcaaataataatgaaattcacattacccacataactgtcttttagtgtgagcgtcttcatggcttaataagcccttgtgcaggcgaactatattttcgctttccacaatttataaaatttttaataaacaactaaacaaaatcattttagtattgattaaactacatgcggctcataactaatcatttaactatttgtcacttttaagatgtaatgataataaatttaccactcattttctatggcatatggtgcctatgacatgtgagtccagtgataaatatgttatcatcacttgtaatagtggcaaatataattattcctttatttttagccttccacaatttatagaatttttaataaacaactaaacaaaattattttagtattgattaaactacatgccgctagtaatctataggtgggtcccgccccgcgccccctatatgact

SEQ ID NO: 101347 - DNA, 1174 bp, Oryza sativa
agatgctggctgggcatgcctgtatctgcatttcggtagtactctgcgttgtttgttgcattcataagagtattatttagcagctagtgctacatatattgcccttgtctgaagtgtttccactctcaactagtactggttattgccttttgtcttgttttacatcttctattttcttttgtactcagccactattgtttataaattactatacctccgtttttaaacgtacaacaatgtttaacttttggacattcatcttattaattaaaatgtgagcatcatttattttgttgggactttaagcgtgacttatatttgtgcatatttgcactaacttttcgaatagggcaaatgatgaaaccaaacattatatccaaaaatcaacatcgtcgttcgttttagaaacggagggagtataagggtggggcactgtaaagtagaaaatcttgtttggcttacagtacatccgatgcaaatagcagtatagagaaaatatttatacattcccgttatctcctgcagcgtttctaagttgagactgcctgttaagagttaaagactgacatctttgtgtcgtgctcacctcatctgggcatgcctgttagttgagactgacatagtgacatcttgtatttctctctttttctagcaaaacagtcaattgtttcattgctcatctgaggcaatttgtcaactaccaacaccttgagagaattcaacctaaggtcaagaaggcaaatgtacatacgaatagacaagtgcctaaaatttgtcgattgactgatcacatcgggtaaaagccaccaccctaccaatgagccaggtttaacatggttgggagtatatgtgatgattctgtgcatgctaacatctttgcccgagggaatagcgaaggttaatctctgggcagtatcaagctgtacatcaaaatcgggaggctacttcctgatcttcatcagagtatcagaccttaagtttaaacgttcttcttctcgttgttaaagcaagtatgataagtgcgatggttattgtgaccccaagaccaaatagtacaaccttccaaggagagcaactccaggaactgcagaccatttctatccagccctgaaagagaaaaccaaaaaaattataagattagataaaccttgagaaatattacatcacggacatt

SEQ ID NO: 101348 - DNA, 663 bp, Oryza sativa
tttttttatgggagggaggagtagatgttaatcgtgcgtgcatatttattcatataatacacatgcacaatctacatccctataatcatctcatctcagatgattaggtcattatatcttcatatcgatgaaatcaccataggtttctcgctctcaatggtctacggtttatcacagaaaaaataattagtataaatacgaatatccttatcaagcctagaacttaaactcgaatggacatgtttcactatgagagacctaaccagttgaggtacgtttactttgttcatctcacacatttttgtgcttgagaaaaacacacactagtacatactacatactacagttctcatcccctgaagcaatatttatatacacatcacggtcgttttctggagtcgtcatcgaagaaacacggcgcaacgatctgatcctgacagtgaacggaagaggtaaaggaaagagcaaagggaaattagccaagccaggccaaagccgcccgtttcatctccggcttctgctgatgcttttgccgaaccggcaagcaacacctcgtccgcacgcacaagcaaccgagacgacgccgtccgtctctagtccgtccgtttcccccggcgaaacggccgccgtcctctttcctcctatcggtccatgatgcgcggg

SEQ ID NO: 101349 - DNA, 1001 bp, Oryza sativa
cttttcttttaatataggcattttaaccagccttgctccaatagcaacatcaatcagctatatgtagtcattactttaactagcattgttaactttctaagtaagtggtttgtcttcacacattttcaatggacattagaccagcagcaggcatgtgtgctgatcaacaaactctcatggtaggtgtgattaaaacagggtttgaaggcatagacaaattaaactactgtccaaatagacaagaaagttaatctgtcttcaaatatctagtcttctcaaactgattagctggccatattttactactcttgggtgagagcacttggttccaacctccaagtgccccctccaagaaaaacagctaaagtggtatgaaaaagttgatgagcatggttagctcatcttggtgagtgcttcttttgtctcttgtgtattttggatgatgcagggttttttttttttgtcaactcttttggcatttgtgttctttgttttgctacattctctattggactttgcaactgtcccattcttttgtgtggcattttcctttgtcaggatccctttctagctgtgcagtgcagatgaacaatccaattccagtgcttcaattcccttcccttttttgggaggtcttcactccctttcactaccaagttagtgcttcaatgtgtagaagctccagaaattatcaaaaaattgtgagaacagtgaaatcacttttcatgctctttgctgcacctccaaattagtatacgagtattttagaacttctgtaatgtggggattcttgatgaaaggaagcagaccatggtttagattagagtcaacttttgctcacccaaattttttggtaactaaaataatatcacaaaaaatatttagtttgataacaatgtttgccaatactgttacactaccaaatatgggcagggcgaaaattggctccaaagttccaaattaaaaccccatatttcctcgtgcggtgcggaatgtgcatg

SEQ ID NO: 101350 - DNA, 538 bp, Oryza sativa
cacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgtta

SEQ ID NO: 101351 - DNA, 790 bp, Oryza sativa
tttctcgtcgagtaatatcactactattagtttatcttttcaacacatgtgtttgatgagaacaataagataatatggtaataccgttacctataataaagaataactgttagggatactggtaggtcgaccccaaggcttgacccaccatcagggtttcttaaaccgccggggccggggttaccgcgccccggcggtaagcacggttaccgcggtaaccgtgaaaaaccatgaaaaaccgtgcaaaatttatcaaaaattcaaattattttttaaatttatttgaatttaaggaggttaccgcggtatttatattaccgtaccccgcgataagtccggtaaccgccggtaagggaaaccctgcccaccacgccccccgtgctagattatgggtcatgggtcatcttgcccccgcaacgttcctaggcagttgacccatgggtcgacccataacccaaaagttgaataagcatatgcatgagtactggcactgcaaaaggttcgatctcgtctagttacatggctttcatagtggcgatattgtccaacttgtcgcccacaacgccgatgcccctgatcctctggagcaacatcttgattttgtcatagtctatgccttgttggatctctagcagaaagacgatgctagcaatgaggaacacgatgaggacactgggccgtcaagcaagcactactaagagcctctagcctcagcctcccgtgatcttctctatggtgaaattcacaaacatggtgaccggagctccaagagacacatgttgaattggat

SEQ ID NO: 101352 - DNA, 616 bp, Oryza sativa
tatagggcgaattcgagctcggtacccgtgtgtgagatggaggagtttggaacggtacatgcgaatggcatgcgatgtactggatactggtatctgtccgcctcctgcatcggccaaccgtgtgcacagtatagcagcagcatgattgcgaatggttgtgattcagtgtcggcggcaatgatggccggccgggccctgcgcgccgacggaggaggatgccccggtgaggccggccagcgatccagcggcgctcggttgcaacctctccaacgctttcaaccaaacgtgcaggcgcatctcttgcgagcagaagcatcaacggatcaaaaccaccacgcactgacgttctcgattctgcaactctcccccagggagtttgtaaggccccctttgattcaaaggaaattcatagaaattttagggcccctttgatttggagaaaaaatataggaattttagaggattttaatcctataggaaaatttcctataaagccctttgaaacaaatgattgaatcctatccaattctttgaaattcctatggaatggataatcctatagagattttggagaaaatttagcaagagcttctaacttttctttgagtctatctct

SEQ ID NO: 101353 - DNA, 1239 bp, Oryza sativa
ataaataagtagtacatgactccactaaagcaatgacgtaaaaaaaggcaaacaagagaacacatcactatatatacatcaaaagcaatattttctgtggatatgctctgaataaactatgaactgagaactcattagccctaacagccacccttttatacggggaagaatatagccaaaaagaaaagaaatattgatgtcaaaagaatggtcctgcatgtttgtgtgctctgttctttttgggatgatttgctgatgtgatgcaaggttccatgatatgactttgcaattttgtacctttcttccctggccgctagttgccatttcaatgctgagaggtcatttccaagaaagaaatattaataatatcctatagcttatataattatcgttttgaacgagaacatggtattgaaaaataacttcgaccactattcccagttataatgtatatagaaatatcaataaatatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaagacataaaatctataatatatatattccttcaacttgtgcttcgagtattttttttccttggagtgatgctataaatcgaaaataataatgtaatactacaaaccgcaatttagatgtaccaagaattttctatggtgaggctcgctttgccaaaaacgagtgaccatgtggggtagcctctgcctccaaacatgctgaactagcagtgtaacttcaagaagatccccaaggaatcatatccctttcatctgatgctctacaaaacctagaagcagtgtgggagcaaaagtcactagccacccatggttttggctatacgcctagaatatgcttcttgtatgcttagaattttagtcaccactcttcgtctatccgtgctctagggaccccccatgtcacaccttttaccaaaaatcactaaatccacactagccatcctgcctatagcgacattct

SEQ ID NO: 101354 - DNA, 511 bp, Oryza sativa
tcctcttgttttcgaatgttattgggttaggggcagtttgacagagttaggcgtcaaagagagaaaaaaaagaaatacaaaaaaaaaagaagaaaaccacatggacgatgtcgctgcggcggcgaagcgttgaacaaaaaatcatttgtgatttgatacgctcgagtggccgtgatatatactcctatttcataatcttcagatcatgcaacgagtcaacctcaactgttcgcagcgatcctcacctgcaaattagtgctcggtgacacaacgcagcgtagaaattcttcatgttaaaaacggttacaataataggcaggcatgccaattgtcaaaattcaaatcgaaagctatgcaggatgattctcttggcccggacggatatacctcacatgtactacaggagttactcactccgtcaaaaaaaaaaaatctaaactggatgtgatatattataatataacgaatgtcatatccaatactaaattaatttttattgaacaaaatgagt

SEQ ID NO: 101355 - DNA, 688 bp, Oryza sativa
cgccgccgtggatctcccggcgtcgcacgccaccgggtcgcgcgggaggcacaaggtgatgccttcgtcgggatcttcaccgggttcggctccgtcgggcggcgacgcgcgctgcggcacgtcctccatttgcgcatgtcgtcctctatagaattataatagatgaatactccctcccatcccaacatatagctatttggatggagccatgttcaaattcgtagttagaaatagttacattttgaaacgaaggaagtatcaagtatgcattatattactatataaacatgcaaatttaaatctgacttacacaggtagaaacagagacaataaatttaactacgaataatgatttataactttttttctacttttgaatttaaacttgcatatttatagtgtgatataaacatatcgatataccttgccaacaaaattcagaattttttttctgacttcttaggcggcatggaaaaaacaaaaaggatgtccccttgagagataaatagaaaacagagtactttcccattgtgtgcattcatcattcttccttgcgccgcatgcagcaaaccgtggctgctcgtcgccctcagggtcgtcgtcgtcgacgagcttaaagcctccaatggcaggtgaagttcgtggccacagagccatggggtcctcctgggcccggccgcattggagc

SEQ ID NO: 101356 - DNA, 611 bp, Oryza sativa
tgtgtatttcttaaattataattcatatactactactcctgcttcgtgctggcctgtcactgctgctgtggtcatcagttttttctgacgataaagaatctctttcgagtatgtaatctccgttcctttcgtagcggctgtgttgtcgccatgattggtggcaggcaacagctacgtcctaattaatctccaaaaaaaattttccagctgacgaactaatgcatccattgttgcatttaaaattttaatcaattaatttaggcgccagtaagacaaaccgcagtcggttataccaatccaatcatcgaaatctcagcatttattcgacatcttattgttattgtacttaaatattatacattctaatcatcgtagttagatagtgataactgaaatactgaattagacatgtggttgggcaacatggcatttccaattccaagcttcaattcaaattcaccgatgcttaaagtacatttcttctcttctttatcaacggaatgaggcccttttatatataaaaaaaagaagtacatttcctaaatttggaattttggttgtattgcaaaattttgattgatttttctgaacttccttttatattaaaaaaa

SEQ ID NO: 101357 - DNA, 565 bp, Oryza sativa
ccatggatggatgcatgaaccaaaccaagaaaacactaggcttaattaataatcaatcaattaatcatcatctcttgatccaagtcaagtgtagccgcagaacgaactgcaaatttgcaaaatcgatatggaagaaatgattttaattagtccgtactaattggacacttaatttgcttaatgcgggccgtgttcgtgaaggagtccgagtccgagtccgagtccgacgcgaactgggaagagctcccgatataagcacgcgcggcgccgcctcgacgatgcatctctctctcgatcaatcgtttcgcattcgccgatcgattcgccgccgggagcagaagcaagaaagcaagggcatcgtcggcgtcggagtcggagatggggaagaggaagtctcgggtgtcgaagatgctggcgacggcgaagaaggcggcgccgaagctggagacggcgttcagctgcccgttctgcgaccacggcggcgcggtggagtgcagcatcgacatcaagcacatgatcgccgaggcctcctgcttcgtctgccaggcgcgctacttcaccaccg

SEQ ID NO: 101358 - DNA, 921 bp, Oryza sativa
tccaaagcatcactgcatataactaattgccattattatccatagtagatgggtacattattgtattaaccatgtcatatctatttactaatccaagttagatttcatacttcctaccaaaatgaatgccattatttcaaacacagagcaggctggaccgtatgctatatgtaggacttacagaagaacatgaagaatctgcgaggttgtttgctcatatggtaggagcacaggtgctttcacaatctggagcactgaacttagatatcaaggacaatcagcccactggaaatggtaagagacctcacaagcttgcagccttacccctttatgtaacatactttcaggaagcatacttatgtagtatttatctacctttttaagactgagggacaaagcccagctagttttatctatagaatcagaaagacaagagaataaaactgaaggatcagattgtctgggttccagcctatcctgcaagacaaaaacagtgcaatacagttacaaagaagttaaatgtcagtacataacaaaacaacatagaagctagaactcaacaaagctcaaacaaatggaaataagttacttgttaactactcagtgcataagtagcagatgcaagccacgtcgtgtggactctggaaaacaatgttttgttaaagctgcaactcaatagaataatgaataaataaaacaacagcactcatggaattgtggtacgcgttatgtctattcttggcgtatggtaatccgtttgtgggatatcattgtgcaaaagcaaattacttagtctatcttacttgttctcacagactctcactcatccacgctggacccagaggacgaagaaacaaatgaacatctggtaatagggtgattaagctttaatctttactttgcgtgttaattggttttgca

SEQ ID NO: 101359 - DNA, 601 bp, Oryza sativa
ttgagccctctgcgtctcataaaatgatgatacttttagccgcacactgctgggtggtatggtatgtatacattgtcatgccatggccatgcctaaaagccatgaaatggcccctttggccacgtcactcttggtatggagtgtatacatacccaaagggattgcttcatggaaaataagtttcagaagggtttcttttgaatatttttaaatgggacctggtttctcctagctagcactcttgtttttctctcttaagctaattgtacttgcttgcttcataaacgtcagtatggaaatattttggtatttgtgctcatttttcacaagcatttattcagattttgtctttcatctcgtatattattttctgtaatgtaacaatgtccgtgatgtaatatttctcaaggtttatctaatcttataatttttttggttttctctttcagggctggatagaaatggtctgcagttcctggagttgctctccttggaaggttgtactatttggtcttggggtcacaataaccatcgcacttatcatacttgctttaacaacgagaagaagaacgtttaaacttaaggtctgatactctgatga

SEQ ID NO: 101360 - DNA, 697 bp, Oryza sativa
tcttcacgggaaagctttggtatttttcatatttggtttgaacttgctataaatctaaactagtgccaaatttaagcgttaacaatttcattgggttatgagttattaactgcatagattggaccgacacggagcacggcgaaccaggatggtggctgcataagttcataagcgcggatagagatcatagcggcgccatggacttcatagagctcaacgagtaccacactcatttctgaacctttttttagattgttgagtacatcggaaattcaatagattaaactctcctaacccttggtctatgtgtgttgcatatatactatagcttcttgcatccagaagatagcagccaggagaaagtgaaattatggctgttgaaggataaattaaggcaagcagtgtccaaacacttgcatatacttataatgttgctaattacggtccactaatatgataaattgatgtatttgatttatctttttcatctgcatggatgcatggaatacagtggaatggatcacgatagagacgggaaattaagtttggatgagtttatcagtcagtttcacatgatcgaccacaactccattgtagagcatagtgctgatgatgatactagttgtgctgaagctgagaagaagtttcgagagctcgattctaacaatgacgggtaatacttgaaacagaagaaaat

SEQ ID NO: 101361 - DNA, 675 bp, Oryza sativa
gcatagccatgataccctgcttgaaccaaaaagaaaaaaagaaattggaacttactaaactacatatggagacccaatcataaggtgcgatgacagtgagttcagaagaacttaacggtacctcaatcccacgaggattattgttctcctcgttcatctccatcaaatgtctgccattctcaacagttggagcatcaaccccagacttctcaaacaaagagagcagttcagctaaagcaccaccctcactaaaacaaagacgcgaggtgcgctcaacccggacattagaggtaggcccggcatatgccaccatcagctggacaacatgtagaacagaacaaatcaaacagaggggtctcaagcacatcaaaacaggaaggaactttcacacagattgtaagaactttaaacaattctggggggaactcattaaactgtaaggcaaataacccttccaaagttcactataggaataatttgctagaacttaatttggcagagtcaacaagcaatcattctttttttgctgagaaattttaaaatgccgaactattgctgccaaactacccagatgactgtgagtctttccaccaacaatcctaaataagtttccatttagaacaactacaatagctgagaaaacagaccaggtaagttacaacctggaattacttg

SEQ ID NO: 101362 - DNA, 631 bp, Oryza sativa
atttgtacatcaagtccaattctacttttaaaatatagcttgcacaaaaaatggctattttgcattattacataaaacattacttccaaattggcgatcctgtattctgaaagatgtattggaactttttttttgtcatgtgcacgtgctgcaggttggctgcagacagaaggcagcagcccgagtagcgatttctggctgcagtatattacttcaataccaagttatcatttaattatgaagtgcactaagctgttgctttctatgtacatgtaagcttatctatgagataaaaaaacaaacaaacaaaaaaagcccgtggttaggatggcttgcggcattcagctaagtcgagaaaaatgcccctgaacgtggcacgtcactgggcatgcttaacctcacgcggggagcactcttctaccagcattaacgaggggggattttttttgtgcaaaacctgggcttgagccttggtcggtgtcccctctaccagagactctaccactgtgctacacacacgtttgttcagcttatctatgagataaattattagaatcctctacataagttattagaattatgcaaagttcctccattgcttccttctattgatctattatatgtccatctt

SEQ ID NO: 101363 - DNA, 605 bp, Oryza sativa
tgatagtgaggtatgaactcatattctaagtcttgggcaacttgtaagttactgcgtcaatcgttttgactgtgactagggaaacaggtaaatataccatggtctctactggttagtattaggccgtgtttagatacttttcaaaaaaaaaattaacatatacgaacctatatgaagtattaaacgtagattaataacaaaacaaattacagatttcgccagtaaactgcgaggcaaatctattaagcctaattaatccatcattagcaaatatttactgtagcactacattgtcaaatcatggcacaattaggctcaaaagattcgtcttgcaatttacatgtaaactatgcaattggttttttcatccacatttaatgttccatgcatgtgtccaaacatttgatatgacagaaaagttggaagtttgaaggtaacatagccttagagcaagtataatagtaggctataagctgactaaatgctgaagtgtaggagagaagagaggagagagaggagaagcgggctgtaaacttaaagccggcttggacgcaagaaccaagccatattcgtggacactagaatctactccctccttccaaaaa

SEQ ID NO: 101364 - DNA, 670 bp, Oryza sativa
actgtatatactttgataatatgtttgttttctatttaaaatattactatatttatctttaaacttgatcaagtttaaagataaatatagtaatattttaaacttcacccctaaactatacaaaaccatccaatttggatcctatagcagtatatacatctgattttgttgacgtaacaatttgacccgatccactcgtgctgactagacactgatgtagcaaaaaatgaaagtgggccccacatgttatccttagtctccaccttatctcttcctcagttccactgctctctctccctcggattgggattgggtgacataaggtaggcatgtcacaatgtgacatagcgtgaatctcggccctccaaaacaaatccaactgctgagatccatccacgtcatcatgagttaaaattttactcgcagatttatttaggagtaaaaattttactaggagtaaattttcaggtattgggagcaaaattttaactcgtgagtatgtggacgaatcttagccattggatttactttctagggctgagattcaccctatgtcacctttgtgaggctggggcctgttgcagctgggggtggcttcggcctccaccaggaagctacccgacgcggttcttgcccgcccacccgctaagcagcgtcggccgcggaggaa

SEQ ID NO: 101365 - DNA, 596 bp, Oryza sativa
taagatggccggtaatccttctttagaatctatccagattcatgctgaccatggacaattttcagtacaaaacaatagcactgaaaaagacttgttgtattactgaaagatccttcgtgcgtaagaattgatctgcaatcagggctgcccctccttaaaataaactgtacaccccactgccagttgtatccaccacaggttttgatgattacattgcacggcattacaatcaactcatccagataaccaaaaaatgtagccgcaaagttttgaatggaagttgccaacctgacaaatcatcacctgcacattggatcccattcattgttgataatccacaacctgtagtaccctgtaaaataatagatcggagaaacagcgaccctgtgagaaatattggaacctgacaagccaagcagatcatttatatgttgtacttcctccgtttcacaatgtaagccattctagcattttccacatttatattgatgttaatgaatctagatagatatatatgtctagattcattaacaccaatatgaatgtgggaaatgctagaatgacttacattgtgaaacagagggagtagttaattc

SEQ ID NO: 101366 - DNA, 1654 bp, Oryza sativa
  unsure (1)..(1654): unsure at all n locations
acacaaacgcaatgacctggcacggcatggtgccatggtctgatggtcattgaaaaaatgaggttatattccaacttaataatggattatagatatcncaaaatgagagagaagcaaagccattattcagaagtctacttcaaatgggtagctttgctactcaaaaaacttggttgcgtctttgaggctttcagcttggatgatggatatgttttccttcgtttggctagccaacttctttagcttattagagttcagagttctgaccaaactgaatttgactggccttctctgctcacttatgagcttgcaaaacccatggaaaatagtatttcattaggtaagggtcaattatacattcactcacccttgcgagacaagctatagattatgctactagacgttttctaatgctagattacagacgtcagatgaaagtgaggtcacctgtagttgttggatcaatttcaggttgacatagtaatctaatgtgctgcaatcttcccagctgcctcactggctcaagctgattgatttgttcttggtcatgacgaaatctcctaactcgttgactggatatcgaatccctccaaattacaataataacatttcttgaaaattcagaaggcagaaagaacaagaaaccaaaattccacaaaggcgacaacacgcatgggcggctatccagtactgatcatcgtcttttttttctcctctgatgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagagattcctgcagtgctgccgtggtcgacccgattaaacatcgcggttggcgccgcgaagggtttggcgttcctccacacgcagagaagccggtcatctaccgtgacttcaaggcctccaacatcctgctcgattcggtgagtgccctgtagcttttcctaggtagattgacacctctcatatgcatgcatctcagttagctaggagtttttgatgcacacatcacatatgatatactatatatatagtatcatcctaatgaccttttcatcatcatcagtgaaaaggtagagtaatgactaggaaattgtacttggcacagtttggattttgaagcattttatgacatgattatgtcagagaaacttagtatcatactgtacttatgctgttatagtgttatgcatcacttcatacttaactagtactagttaatggttattatcatattgtacttctctaccaaagaaaaggaaaggaaagcttagtgatgtgggctatggttcataggttgggccgtaagtgagttctgctcaagattgggctaaaaggaggcccaaattttagtttcaccactgaaaagcgtcactgaaaataattttatcgggtcatataatcaaatctttattatctaaaaaatataatcaaatctttacatttttttccatgaccgtgtcaatgttcttttttttgaaagaaaaagcaaatgttaagtttgggcctttaatgggttactactcaagatgggc

SEQ ID NO: 101367 - DNA, 646 bp, Oryza sativa
  unsure (1)..(646): unsure at all n locations
ggcgacttcgagctcggtacccaaaatgtaactatttctaactacgaatttgaacatggctccatccaaatagctatatgttgggattttatggagtattcatctattataattctataggaggacgacatgcgcaaatggaggacgtctcctggagggggaaaaaccatccacataattctttggtcccaactcacaatgggagatgatagtaagaatgtgtagtacaccgagctagttacatgcatgcatccgggagacatgatggtataaagaaacccggcagccaaatgtgtttaatttcacactgaaactcagcagccaaatgtgtttaattccacaccgatataagattgggccagtagcatgtgtcggcaaacattttaattgcatttacaaactcgcagcttgagctgtataataatcccaggagggaatgtgcctaacaactaatgacagtatttatcaaccccccccccccccaaaggggccccttttttcaaaaacaaaagttgcaaaatgatcctgtgagtcatctgaaagccgtcaggttttatttctgacttctgagtcggaaccgattcttgacttctgtatgcctaatgctgcactatctnatgcaactttgtaaattacagccactttc

SEQ ID NO: 101368 - DNA, 1657 bp, Oryza sativa
gtattcgggaccaatatatattcttaagatcattgatttagactctatacatgggaaatggtagcgaccattgaataaaaatgtgttttggttccagtaactggatgggatagatttgttgtctacgtttggacgatatcttactgatttccagtaagatctaagcgtcggtcaatttttcatttcattccagcctccgacgataggtactgtgccgttaaagatacatgtttctattcaagttaaatcacacttatgcaattattcatggctatcatttgagattgtactaatggtttgtattatattaagggatccatatgcttacaaaattgttctggattattttttttctatatggttcatccatacaacttaaatggataatgcaccgcagacagcccacaccactgccatcgccatccaccgcatacagctcgcaccactgccatcgccaccgcctccgcttgctctcctgtttttttgggccaccgcctccgcttgctctcctgtttttttttgggaaaaagacagagagggagaatagggctgacaagtgggccctacgtttttttagtatttctcctatcacttacatgtgggtctcatcttgtaacgttcctatgataggactacactttacatgaaatatattttatgtacgatatgaattgaattaaagttcaaatgcatagatcatataaaaatatttttttgctaacatgaaaatttaaaaattattaaaaacagatagaattgcaccgtaacgtttagtacggacatattactagtaacttataatacaaaatgtattttaatgttgaactagcacttatcagtgtcccacgtacgtatgaccatttccatagttccaagttccaacatcatcttacacggaagaaaacgaaagaaaagggcagacgacttcttcatccatattgctagtagatacttatattaagacttgtatccataatcccgtcagttctctcagctcaggtccacctcaaaccgtttgtcgttgattcgctcacaactttaagccgcttttttcttttagaaagaaccaccacaaaatcgccttggaactctaatgttccaaacaaaccgtccaaaattcaccaatatcatgcttgaacacacaaacaaaactcacttgcaaaaactcctctttgccttgaccaatcacgtgtacaaaaccaaagataaaaaagatggccaaccttagaccacacgcatcccatccccatcccttttcttgttatcatcaaccagaaaggttacaaaccaacaagtaacccagacacaagagcatcttggcagatcagttgagattttagccacaaacgagcgaacaactaaccacttaacccgaaccaaccccaacaactgtcatcatcgaccaaatcccccaattagcgtccatcccgattgcttctccaaactctatttcttaattctatcgagtatcaaccaccccgttttatattataagtcgtttgatttttttccctagccaactttttttaagttagactaaacttatagaaaaaatatattaacatttttaatataaaaacagacagattattaaaatatatttaatattaaatttaacgaaactaattttatgctataaaaattgttatttttttca

SEQ ID NO: 101369 - DNA, 655 bp, Oryza sativa
acatattaatctttcttgttaaaattttttataattatttagataacatataaataataagcggatttttcctcgagagtttggaatccacttctgaatactgcagtactgcaccatacaaagcttttttttttcctatgtactccactgtgcatgcagtagctacctgattaatgacctgtgtcgttcatggttgattcctcgctggctatgaggatatcagcatggtggcgtcatacatggtggtgggacgcactaaacgcagcccacactccagtagtagtaaagcgctcatgctatcttaatccttcctagcttagctagctagctgcaatttgcaaagatgctttatttgtaatcgatcacctgtgtacatactgtaccgtcatttcgatgcgttgaaaaggaaccacatgggtgtatataatcgtacgtaattagcaatatttgccattccttttttttgcttttctagtatattttccgagtttcctggcttcccaaaacaaggttactgatcaacaccgtatatgctaatattccccacttagatcagagtactactatttaagggcaaagagcgtacatgaaaacgaaacagtacttcctctatttaagattcatgggggcatttagaaaaatgctatgcatacca

SEQ ID NO: 101370 - DNA, 604 bp, Oryza sativa
gcttcgggtctcggcgtcgcgcgcggcgggtgaggtgcgagacagctagtggtagtcctagtcctacgcggttgtgctttgtgcacgcacgtgggtgaaactgtgtgttgactgttgaggctgtactactactcctgttaggtatggtgtgcctgtctgtccctgctaattaagcggaacgtttgccgctaattatctccgttgtcgttaatttttaaacatgtgttccaattatgaaaattgctatacgtaggacccaactgtttaactcacgtacaactgaatttgattaacggttgcaaataattacaacgcaaatgaacatgttttcctttgattgatctatagttgcatgtctctagttgtatatgagttatacaactaggtcgtatgtatagcagtattatttgattattcgtcttttaaaaagattttattcgtcttttagaaaagattacgtaagcatcatgtacctttttgttggttgttttatcactaaaaatattttaaatatggtttatatcttacgcattcacacaaaatttttaaacaagacaaatggtcaaacatgcgccaaaaatcgataacgtcatttatcaaacaa

SEQ ID NO: 101371 - DNA, 564 bp, Oryza sativa
ttaggagtataaaagaaattctcttactgaaaaccagagggagtactacatataacatcatttttttacgggttgataagttgcggaaaaaccaacaaattagcaacaaatatgagtaaaacttgtatacatgtgtcttcttagcgatttaaaaatcaatgctgaaaataaattccaataaaattaaaaatctcaagataatctgtaaaatgtagttttaaaatttaaattttgattgcgactgataagaaaaaaaaacaaatgatgggaggctatatcaactgtcaaactggctaatttagaaagacgacatcgaattcctacagattggaggcagcaaaagagagcccgtctctgccgggtgcgtgcatgatgctcgatcatatcccatctctcctcacttcatcatcaacaagaacaagaggaactatataggcaagatctagactgaaactactatagcaactaactgtactgtagctagattacgcttagctatagctgctgctgcatctatctgtaaattccaactacgacgtcgactgctccaagctagcttggccg

SEQ ID NO: 101372 - DNA, 644 bp, Oryza sativa
  unsure (1)..(644): unsure at all n locations
gtttgcccgttggtcttatttaaaatttaggtaattattatttctttttctatcatttgatttattgttaaatatacttttatgtatacatatagttttacacatatcccaaaagtttttaataagacgaacggtcaaacatgtttaaaanagtcaatggtgtcaaacatttagaaaaggagggagtatgtaataagagatagttggtgaattatagtgtagatataattttttctgagtttgtttgaccgagtttatagaattttgattaataaaaaaattcaaacggcttataatattaaaacgagggagtactagataagtgctttcttcatttttttttatttttttctggaacacaacaaacaatataaatatgatttttgttggttatttttaattcctggtggtagaacttgcccacccaaatttaagtcattgacttaatatatgtgtgcacatttatattattcttctaatgatagacggcgacccgtcaacaccgaggagcacgtggtaacttcgtgagtctcaatatataccggtctatgctcatagaaataaagtgtgtgtttataagagcatctataggtgtttttcatgagtctcatgatatactagtctaatgctcatagaggtaaagt

SEQ ID NO: 101373 - DNA, 687 bp, Oryza sativa
caaccaaaatccaaactttagatccaactaaacacagccgatggattggacggcgaaacacatgtacacgcagtacatgtactgcgtgagagcgacgtcgttctagccatggtatagctacttttctttcttcgttgtggttttaacttattagctacacgtaaaatgagaaatatattattagcataaaattagttaagtattaattattaaaaatttaaaataaattttatttgaaatttgaaaatcatatcctgtatataaagttttttatacgaaacacaaccacttatccgtttgaaaaacatattaacgaagcttatttaggccgggcgctagctacaatggtgagctttaatttgtcagcctcttgctgcatatatgttctttttagagaaggatattttctatccggcctctatattcaatcggatatatctatgcagtctttttaaattaaaaacttagcctataaaacagagaatttactcatcaaataatccaatctgaaattcgtttctatagatatttgaactcacgacttaaagtgttactcgagttactgtaactaatatgctacatgaggaactaggcactgcgatcgcgatcacacgtttatgcgatcgatcgaccgggcacgaactgacagctccagcatgttgaatgcatatatttacctttactttt

SEQ ID NO: 101374 - DNA, 625 bp, Oryza sativa
caattctaaatgcattagaaatatatacaaaatagtatgtggtatttttagggggatgttatacatacgatttttttttacgattgttgtacggtaaaatgattttttctagcggttgttaacgatgaaatggattctttttttagtattgagttcatattcaaagctcaagttcatgatgatgttttggtttgctatatcataaccttttttttttgataaatttgttttttttaaaaacttattttgaaagtagtttaataaaaaagtttaattaaaaataagttattggcttagtgttagagaagttggtacagagttcctatatgattgtgttataagtgttggtgctgaactcctgttaatgtggtggttgagttaatcccttttgatgtggtagggttcttagtgccaaggtggttggcatgagacggctaacctcgccaaacgcatttgcgttgagcctgcagcctatagatcgcggccgagccgcccaggcccggcactcccttctttttatcctcgcggctagggttcatccacgtcgccctctctgctcccctccgaatatctcctcaaatatccctcaaatcgaaggctattttgtacgcattgcgttggagat

SEQ ID NO: 101375 - DNA, 582 bp, Oryza sativa
ttaagtcttaacgcattcttaattctaaatcccaagttttagagtttacaaaaaacaacatacaaaaataatcatataaccaatatatatctctaccccatccaattctcaatacattacacatatatacaaaatagtatatggtattttacaacactactatacatacaattcttttttacaattattatacaacaaaacccttctttccaccatttattaacaataaaataaattcctcttccactattaaccccatatccaaaactcaaattcataataatatcttaacctactatatcataaccctttttttttaataaatttatccttttcaaaaacttatttcaaaaataatcccaacaaaaaacttcaaccaaaaataacccatcaactcaacaccacacaacttaacaccaacttcctacataaccataccacacttgttaacactaaacccctactaacattaccaccaacccaatccccttcaacctaacaaaattctcaccaccaaaacaattaacactaaaacaactaacctctcaaacacatttacattaaccctacaacctatagatc

SEQ ID NO: 101376 - DNA, 546 bp, Oryza sativa
agtgaatgtgtgaaatatgtgaataatggaaggcgtatgtgaatgcatgtgttaaatatgtaaatgggacatgtgtatgtgaatgattgtatatggaaggggatgatggcatattgtcgaatatattggtttcagtaattttgaagcgggaatagatagacaaggactagggttagtcaaaaagatacaatgaatttttttgggggaaatagtgattagtggggggttttaacttaagataatgggaatgatgtcatcggtgacgggtttaagttaaagtttgattgggttgagttatttatcatgggctttagtttaggttgaattgggattgtatttattggtatatgacgggtagtaattgtggtgtgattaagattaggttatcggtgatgggttttgtttgactagttatgtgggtgaaacctataggtgacgggcttcagtttaggtcggacccacataagttcatccttgacggccttatgaatgatagagatgaattcccccccagtgacctttacaccgtgatgggtcccatatctg

SEQ ID NO: 101377 - DNA, 617 bp, Oryza sativa
attcctgcagcccgcctaggcctgtctaccgtcaactttatgggctctttccatagcccatatgttcttatctctagtcaattgtatccgggagaggcagggggcgacacgcgccagctggcagcctggcaccctctcctaagcatgatttttttcgttttctttttttcgcggtttttttttttcatttttcattttgcgctttttctaatttttttaatcttcagcacacatgttttcaaatgtttgagttaaaagtttttaaattttaatttgaaagtttttaaatctcaacgtaaaaattttcaaatatggacttaaaaattttcaaatctcgagttgaaatttcttaaatctccagttggaagtttctaatctgagtcgaaagttttcaaatctgagttaaatttgaattcaagtttgaatttgaatttgaatttgaatttaaatttaaatttgaattcaaattttttatatatagtatttctatatataaatttttccaactatttgattttttaaaacttttttgtggtttactgtaataggaagagaagaaggggaggaggaagggaagaagtgggagaactgcgtataggagggaggcggggggatgc

SEQ ID NO: 101378 - DNA, 600 bp, Oryza sativa
tgttagaccagtgaatgcataatgcatagttccatccccatccaccaaaacttaaggcacttagctcatataataatttttaggttgatataataaattgctagcatggactacagctcccctagtttataaaatatgaaccatggtaataaagaccataagcctatgaactaaggttagattagttaactaaaatactcattttatacatcactagctagatgaggcaagttctggacctaaacctctaaagctatgaacctatagaacactatacacctataacacgttataacttgtaaaatacataaagaattcatattaactctaaaaattatgaaaccaaatgtgttggtcttagaaaacacatatcttcaccccagcaaacataaacttaacaagaatcaccttacaacagcatttcacaatagtacctaagtaaatcctacactataccgacgaaacttctaaaattcataattctcaaatgaaatgagataaaatataaattctttcacctaaattcattttagaccagtacctattcactgtgcacaaatcatccattttagagcattttggatttttcgcatatttcgg

SEQ ID NO: 101379 - DNA, 645 bp, Oryza sativa
taatcatgttgtgctcgcggtcatgagcggcgtgtggatatctattgagtatagacttgtgtttattctcctaaatgctgaaatttacctttaaatcaatttaaagagatttgagaatgatctccttgctccttgctgccatggaaggcaatgaggtgcatatttatacatgattaatgcctattttgatgcccaatatgacaagtactagcttgttgaaatttatttgaaagtaaacctgatttggaaatgttttatgcaaataaaacttgctttatgctaaaaagaaccatattatgtcttccttgattatatgccttgcaagtagggtgttaggcttgtcttggtgcttgccctaataatgtactgactcttgctattgaattaatcttttgcttgcaggttttagacttagtctttgagtgatgcgggtaatcgactgcttcttctagtacttgaacttaatggggtaaacccctagtcggtgtgcttgtggattgggtagacaagcttccgctgttctatatatttatttggcccgtcggccaatgtaactaaaagagatgtagtttataatcgctttcatcttatttggggttgctatgtataatcatgcctgagatgaaagtgtgaatctagtgcaca

SEQ ID NO: 101380 - DNA, 645 bp, Oryza sativa
cagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttagggttgggaagcattggaaatattattgtgttcgtttcggaccatttgattcgaatccttagatcattttgatcataacccagaccagtcgaacttaggggtgagaagcatctggaatattattgtgtctgtttcggaccatttgattcgaatcctaaaataatttttccagaacacatagtatgggggagaaaatgttttttcatcctttcgtatggtgaaaatccaagattggcaaacaacgtttcttctgttatatacgc

SEQ ID NO: 101381 - DNA, 556 bp, Oryza sativa
aattgatgtgatatactttaatgaaaaaaaagaaaaaaattgaactaaatgaagatgacctataaccgtatatatgatattataaaaattgatagagagatacattgaaatattatgtgaatggtgggatgatttaacatgcttacattttaaatctctaaaatttaataaattattaaattatatataatatagcatgcttgcatgatgcttaaatgtaataattgttagatgataatgatggaacaccattgcttgttaagctttaggaattagtgggctataactttatagcaagagagaattaattatgataaacaaatttctttagcaatccgcagttgtctgtgtcaaatcctatgttactaaggcttaacatgcaaacatgccaaatcatcatgtactaacaagatgtcccatcatcatgtattaacaagatgcaccatcatcatccactaacaaccattaaatttaaacatcatgtaaacatgctatattatctataattttataatttattaaattttagagcttttaaaatgcaagcatgttaaat

SEQ ID NO: 101382 - DNA, 633 bp, Oryza sativa
acatgtccatcccatacatcaagcagtttgtttgtttgttggccttttttttctttgcttcagtctatcataggtagaatttttctttcaacttttcacctcaactgttattcgtacgttgtagataggtattgaactcaaactgaatatcagctattcatggtgttaatttgaaattgagtttcaaggacacaaactatatgaagcaatttgctcctaattacagttggaaacaaggaaaaacagaggaaacagaggagtgtctttttttttttatgtgtgcactttgttatgcagagatcgggagtgttctcagattttcgagttcaataaaacttccatcttctattatatactaaaagtccattaaactttctacaaacgctctcaagccgccacgtggcgctcctacaaacgctcctagatcggcacgtggcgctttaacatccaaccatcggttttcatttaatctggtggacccattatttttaaccactagatctttattttaagaaaaaaacaaatcaatctatctaaaaaaatcccacgttactcggccgtgtcccctggacctgtacgtccttatgtccgatgtacgtacatatcccctctatgtccttttcttttttcctt

SEQ ID NO: 101383 - DNA, 552 bp, Oryza sativa
aaaaaattgatattaagaggacattcctcatatatacacggtgaattcaacagactttctagggccaaatacaccacggatcatcaagataactctagggccaaaatatgctaccaaattgaggctatcattccacagaacgaaacaaaaattggaaaaaaatagcacaatttcttgagtaatgtaaccactgaaaagtactagcttgctgcaacaatggggggagtgcagtaaggttttgttctccgatgcttcctgccgatttcccttcaaaatcagacccaaatagcatttatgaatcaagatatattcgtgaatgagcacaaatgaaagaaattgaaattagaatgcaattgtttgactaaaagaacattacgagctaagttcaattaacagttacctggatctgtcatatatacaaccatgtgtttgttctgcatcaaaattaccagacaacatgcatgctgcggcgcatacattggaggtgtaggggatgcgaccatttgctgttcgccagctgccggagcttgcacttgggacacaagctaagaa

SEQ ID NO: 101384 - DNA, 555 bp, Oryza sativa
cagttgaggtgaaaagtggaaaaaaaaattctacttaggatagactgaagcaaagaaaaaaaaaggcaaacattcaaacaacctgctggatgtatgggatggacatgttttaatgcaaccatattcaaaatcgaaccacaatgttgtgtacatccatgcctattaaatgtgatcaaatgtgtggctaccacggttcttgcacttgaggtgtttgtttcatcagtacatcctactgtgaagtatacatgtatcaaagttgtctaaccttatagttttggattggaatgtttcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtagaaggagctgatgtcctaattgatgtatacagaacacatgtgaatctacgtatctgaagaggatgctatcagcgtcgaacatttgtgtcattcttcatagatca

SEQ ID NO: 101385 - DNA, 587 bp, Oryza sativa
tacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgcccgagcgtgcccatggagccatggctgctctttctcctccgttgtgtagctgatctgggggtcccgcgacaaaaa

SEQ ID NO: 101386 - DNA, 722 bp, Oryza sativa
gctcaacaaagaaacatcaaggtaaaatatgtacccttggccacttttaatcaaatttacatattatattgttgaatttttttttttgtgtgcatggacaagagtaacccctgtctagtccaagctccagccaacattagtactacaccatcttgtccccatctcatcctctaacctagcccctccagcagtgcctcctttcttcacaatgcattggcatccataggaattgagagcgactctactgcccacacctttgcacagggcaggctttcgctgcatcaagtgggatgaagacacattcagggtggcttgttcaagtccataaaaaaactgagcacagctagaagctgatgaagcagttcactgtctttattggaagggtcaagtccgatttacccccctcaacactattgcaaaagtacaatttacccccttcaactataaaaccacaagatacacccctcatctattcaatccagacacttaaccccctcataccctgttttaggtggtttagggctgagttgtcttgacattacttgttctcatacaaaccttgcttctgacacattttgtgttctcataaagaacaaatccctgtttgtcattacaatgtcaacctggtgctattaagacttatattacttgttccttgtccttgcttctgtttctttttttttttttttggcacagacctcattgcacaaacaatatatatg

SEQ ID NO: 101387 - DNA, 517 bp, Oryza sativa
cttcgcaggcgacgcttatatggtctgcctgcaaagatcaatcttcacaggtggactgccccctccaccccgggtactttttttgccggcggggttttggctccgaattacatgcccgcctgcgaaaatcgatcccctacgacgccgaaaatgagttttctagtagggtcagctagaatatgattcaagcatctctaatttggttcaaggagcccttgattttgagacaacatgtttcacaaaaccaagacttaattatgcaaaacacacgttaatattgtactatggaaaatgctacacgtacgactttcgcttacgatcttgatacgagcaaacgtaaatgacggagaaggcactgggtacctaacgggagcacacactaatagaaaaaagatttttcatggcgttgccctatgatttttactggcggaaaaatacgaaaactgtcagcaaaaatgtaacgaggggtggagggctacggattgccagcgaaaacaaatcttcgctggcagccgag

SEQ ID NO: 101388 - DNA, 677 bp, Oryza sativa
actactatagggcgaattcgagctcggtaccccagataaaggtattcagaaacagtatccgggtaagcagaattcattgttcatgtaataataaccaatatttatatttttaatacaaattgctttcacatacattacctttgctttcaaaaagtttccacctgacaaagcataaaatttcctatttctcctctatggacattgctctcttaaccgttttcacatccataatgtgaaaacctacaaaacctactcaaacctacaaaacctgtgtacccaagttttatggttcatcctaaaattgaaaagagtatgaatgctcttcagagtatatgctgctaaaccattgttttcctagaaaattcagtgactataataaacatggggttgtggggttagagcttatgtctgacccaaataagataaggtttctggtttgtagccattctcttggtggatattcccatgacaaaaatgtttgtccttagggaaccacacacgtgtatctcccattggggaatcgatgtaattttgtggtcaggattatattatcataatggtgacaccatctagcttcttaaaacgaaaacctggaagtcttttggtattaatttcatttttttattataaaatatttaattgaatatctgtatgtagtatatacataaggtttaaaa

SEQ ID NO: 101389 - DNA, 649 bp, Oryza sativa
ccaaaaaaataggaaatatggaaggggagggttagagggggagagagggagtacgtacatacatgtgcacattttttttcgttttaaaacgtattaagtgaacttgtgattggagtgggggaacgtacagattttttttttggaagataagatttagtggtgaaaattaataatctaatgatttaaaatgttgggtccaccggtttataggaaagtgccacgtggcggtataggagcatttgtaggaataccatatggcggtttaggagcatttataggaaatttattagacttttagtatataatgataatgatgctcaaatttctaagaatttttttctaatttttaaatgtgataagttcgatgaatctttattgcgtagaatgatttaagatgacactaatattttaatgtttcgtggttgtttggttgttgccagtatgttcaaatgatgtatttaaatttttatagagcaaaatagtaatatagatgttgatttacttaattaattacaaataaaattactgtttaaataaattaaaaaccggattctgttttgatgcgatatgatcaaataatgtattttagtttttgtacatagtaaaatatgggtgatatggattttaaaatattagttattttctattg

SEQ ID NO: 101390 - DNA, 562 bp, Oryza sativa
tctgattcctataaaggtgagaaaatctgaaaaaacatctaaaaaatttcgtccaattccctaagaaagtggcgaaaaaaagggttcgtaaaaaataaaaagctagttcatacaaaataaaaaatacgcgcgagaaaaaaatagaaagggcaaaacaaattccgatttctaatcagtatatatctcttctctatctctaatctaatctaactatttaaaaagagaaaatacacgagaaaaataaaaacagttcaaaaaaatgcgtgagaaaaaagtcagaaaaagcgcaaaaaaatgctaaaaaggttttccatcttccataaaaaaacgtgcgagaaatattatttccatcgtcggttatttttttaaaaaaaacatacgaggaaaaaactggtagaaaaaatgcgccatttctaaaaaatgatttgaaaaaacacgcaagaaaaaaacaccgtctattaaaaaaacaaatcgctccgaaaaacctgtcagaaaaaaaaaacgctaaattgatggacgcttgagtcggataggatccatcgattttttgccatctactaca

SEQ ID NO: 101391 - DNA, 529 bp, Oryza sativa
cttatttttaacctattgtctatattgctagatgaatacctattatgattagtgacttcatagatcatatgtgtaattgggatgctatgatcatctttcttatgaatatttatttatctcctaataagatcgttttaaaagtatcaagatcaatttgtataggtacatagccttcataggcatgttaagagaaattaattaagttagtagaaagtcgttagaagcctgacaggatataagtaatagatgggtgaatggtgagagtgcttaacattgtatgacttgttagatcgcagatcaatactcccttcatttcaaaatgtttaacggccttaactttttagcacgtatttaaccattcgtcttattaaaaaaattatgaaatatgtaaaactatatgtgtacatgaaaatatatttaataatgaatcaaatgatatgaaaagaataaataattacttaaatttttttgaataagacgaatggtcaaatacgtactaaaaaagtcaacggtgtcaaacattttgaaa

SEQ ID NO: 101392 - DNA, 533 bp, Oryza sativa
tgtgatatgtcttaacgagagaagtgagaaatagcattaactagctaagactactaagtgaggatgaactaggtacatagcatattataaaaataatgaagatatatattgaaatattttgtgaattatgtgggatgatgatttaacatgcttgcattttaaaagctctaaaatttaataaattataaaattatagataatatagcatgtttacatgatgtttaaatttaatggttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctaaagcttaacaagcaatggtgttccatcattatcatctaacaattattacatttaagcatcatgcaagcatgctatattatatataatttaataatttattaaa

SEQ ID NO: 101393 - DNA, 2648 bp, Oryza sativa
ctcgaacagcggcacaagcaagcgagactagaaggaaggagaggtgttaacgccaaaattttttaagcccgaagtcatcatcggcttagagtcgatctctggcaaaggggtaagtcatacgttccgttggccctggtaattgtgtcggctacattggtgttgttcaaggctacatcgcttcgacctctttgatcactctggttcggttgatatattttcctacctatttatcatatatcttggttaatctaagtcgattattcaatttacttctattggtcagatcttttctagggtgtggtgggtatcggctaaattgttttgtcgatctagattagctaaggtattcaccaccctgaaaatcagtcaaatgcttattgtctagatattatgtttcttttcatacttagtgctgcatcaattgggtttgacgtactaagtcgtgcttagagctatagtctctagcctgctttttgattgccaataaggatttcatcggggtttcagccgatgagttatatggacgttgtatcgacttataaggattacatacgaattggatttagccgattgcaacaaaggtttaattgattaactaatcatttggattttacgacattggacctccagccgatgtattctttaaccttcggattagcgcttattctatcatatcattgatagccgattggtttccactgaattatattagttatgttacattatcatcagtcaactgtctttatatcattatctacattggacatataatcgattattcaaaaccctgtccacattggttggaattactccatcggcttgtcagccgatcggctctttgatcttcaatttatatatcttgtcagttgtaggatcaaactgactggcacgcccgcatctcataaatattctggaccagcgctggagctaagtagatctcccaggccattgtgttcatcgacttagttcgggccaacacagatctagcaccatcgaccaagcacggattttttttgtcaacaagagggaaagtgatatcaccaaagttcttgcaaaataagttgtttcccaaagttcgaatccttgaggggattctacgctccgttgaggagctcacaaagagccgggtcttagctaactctttcctcaagaggttgcacaaagcactactccttccacccactagtggttttcttttctttcggaggctagatctggcattcacaaacttctcctggctaaccacaagtacattggtggctcaagattggcacttagccgcttaggagtacacaattcccaagattaaaagatggaacaaggatcccttggagatgaaactagtactcaacgaatcttcacgaagttaacaccaagcactcacacaaactcaaaaccacaactctcacacacacaaggtccgagctcaaagatcggtggagaggggaaattagaaagcaaggcttaaagtggtctcaaagcaaagcaagccaagggcgaaaatatttgcattagcaccagcaaccttgacttggagtaggtgggggggggggtatttattgccacgcccacaaatccaccgagggagtcaaattgcaactgttttgttttaatagtttgtggggaaggggaggggggtcgagatattcggtattgtggttcaaggattcgaataagattcggtcactagttaagagagtcaaagtgagcttattgcaatctacattatgcttctagtaagttggcttttctccccctgggctatacttgttgcccttccctcgaatttcttgtatatatatatatatatatgcataacatacctatatataattttaaaattctatgggtattcagctgatatccatgaatcacattggatccggccgccacccggggcttcatcgtgaggaatgtttttctagacaaatccaagggtggtaatacggagttatatccatcctaactaactgccaaatacttctctcaagggtggaaattaaaactatttgtctcatgccatattatgtcacgccacttcaaataaatcaagccattagatggtagttagataccacatatttctcttttactaggctcccaagtcccacattacatgggttgtccatagatagctaattaatgacatcacaaatgattcaccttcgaaaccattttctaatgggaatcctaaaagatacctaattaattatttggacgtccctaagtaaccatcatcgcttgatctcacctttgtcgatcaggcaccaagatttcttccacgtactaaacatgtctcaactctcgatttttgatggacaaacaacttcttcattgatgaccatatgtaacgtcgtggcctaattagaatttgacatctgtgatccatgagagctgtgtgcacatatctgttaccacattgctaatttagtaagagtgaaaccaacttataaggcatcttccctctaaccatatcgctcctgagttaactattttacacgaagtgaggatgaaagtttaagtggagtggtgtatgtaagtgggcccacttgtcgattgggctggctacgtggttcttgagggaaggctcacacaacatcatgttttccacatggaataagttcacttgacgtccctcaattatacac

SEQ ID NO: 101394 - DNA, 581 bp, Oryza sativa
tgaggatgctacgcttgaggaagtggaggaagcagaggcagctgcgtggtgtgcagccaatgaccatcccaacagacccgcccttgaatcataagacgtatgaagataagatgatgctgtttgacatacatcaagaggtatatctcttctctgcgaagtctgatacaaagccattcggtgaatttaagcctcttcttagcgcaagtttaataatatagtcaaccactaacgtcaaatcacttgtaatcaatttaagttttaatagcatagccgactactagctttaaatcatctatattcaatctaatagccaatcttggaatctgcgttaccattgactatatggatctatagcccacttcttctctctctaggcactagccggacggttacccccggtctagagtctagccagtctatacgatacgccatacttatactaccggcatattttttttacatatatgtaaatacacttagcaagtcaaaagttctagagaatatttgagagcaacaaaagatggtatttaatgtttaccttattttgcaagaatgaatcttcaattagcttcaaattcaaa

SEQ ID NO: 101395 - DNA, 642 bp, Oryza sativa
cttgctgctgacagtaaactctgcaataatctggctgacccccttattctcgaccaaacatagaattaacagcctgaaatggggggaaataatgacacaccaagctcaaaacatagttatcgggtgagaaaaaaggaagataccagataggaacagacccatgaattttcagatgaagtgtgcatgctagattgtttgatttcctaatgactcgagcataaaatagacttaagaatacaaagcagacgattggacaaatacatgatattagtacagacccatgtagtcgaagtgttgaaacttgaaattttgtcctacaaggtttgggtgtaatatttgaagttttgaactcacagggaattgtcaaaaagaaggatgtgctatagacttatagtaaaagcaaacaaagttggaccaataaaagattcaggtgtaaacttaatagaattgatagattgttcatgaataacctttcaatatttgaacacataatgttatgatcttccttagagcctcctttgtgagacaaagcaggaacaagagcttgaatgacttcagttggaggtcctttgacaaaaaacgaatcatatatttccttccttgcagaggcacggatctgacgtaaccacttcaaggcaacat

SEQ ID NO: 101396 - DNA, 675 bp, Oryza sativa
ttaaatcattgtaagtctctccttgaaaattgaagttgaagcgtcttaaagacaagattacttgtagcttgtagcaattctgttcgatagatcagttggcatgccacttatttagtattcgttgccaagcatataatatccattaatacaataaaagaagatttttgtgcaaatcattataatattgcactggagcaataaattcgttcactatattctagtgttttcatgctcatttttcctgtagcaccatgacatcctgccatgatgatccatgaaatgctccttatgctgcatacctcaaaatggcagccaaaattaggataaggagattgtgccataacttcctgttcctgggattgactagtttggatgggattttgcctagatccagggaaaggaatcttgcgtattactaattaaatttgtaccaattctcttaaggagatctgaactacatgaaagttcattttcttcagctctgcattcctttcccaccataaccaaggtttatccagattttttttaacagggaagctaatcgttagattatgttttaatagtttgctcagtgtacttcttaatttccttattctggaatactacctccgtcccagaatataagaatttttagggttgaacacggttattaagaaagtaggtagaattaaatgg

SEQ ID NO: 101397 - DNA, 600 bp, Oryza sativa
tcctcaatcatgtcggagaagatagacatcatacacctttgaaaagatgcaggagcgttgcacaatccgaaggacattctctggtcctccgtatgaatgggatttgatgatacccggaatacccatcaaggaaacagaaaaacgaatgatttgccagccgttacaacctctcgcatcgcattattgagccgtcattgaggttccctagagggagtactctcagggtcaatagggatacgatgggtgcaaagtgcgggattgatccctctgagatcttgaagggaatagccaagaatagaacgatgcttttccaacactgttagaggacgttgaatctcgtcttcggagagcttgtcactgattatgacaggagcttctctatcattatgtaggaaagtatagcgtaggccttgaggtagaggtttaagctcaagcggaggtcgaggtggcggttccatgattggcagatcgagagtctcaccgggttccgcttcttccttgatgaagtcagggacttgatcttccaggagggcttcaggagactcgtgagggggaactgctgtaacctcctccgctcactcaatttctgtgagagggtcg

SEQ ID NO: 101398 - DNA, 599 bp, Oryza sativa
ttccctaaatgtttgacaccgttgacttttttaaacatgtttggccattcgttttattcaaaaacttttgtgatatgtgtaaaactatatgtatacataaaaatatatttaacaataaatcaaatgatagaaaaagaattaacaattacttaaattttttaaataaaacgaacggtcaaatattttttaaaaagtcaacggcgtcaacattttaggatggaggtagtatatcttctccactatcttaatatatacaagagcatcacgtatgtactgcagaatgctcgatcatatgcatgcccttcagaaaatatacgtgcaaggattgggtggtcaaagcgcacatttatctgttgacacctaattagctatattgctagctatacgtacctgtcaagcggcatgtgtactcacgtaatcatctggatcagaaagacactttcttttccttgcggtgcaagctctgggtttgactattgaccagtcgtataaaatctactcccattttggttggatgcgagtacaacgaatttatatataaaatatgtccagatttattgtactaggataaatcacatctaaccaaaataccttatata

SEQ ID NO: 101399 - DNA, 718 bp, Oryza sativa
atgaaccagaggaagatctgaccacacatattcccttggattcgatacccttggaatactccgtaggggaagtgctacatcggtatatccgtgcgtttgcggatttcatctatgatcgttaagaaataccaaagcatttctggcaccgttgccggggaacggttgctgatcatttccgaacctagttaatcctcgtatctctgttccattttttttgttctacctttacccctgctacccagagaagtgctcctgtaaaaccctcctcgaccatggagcaacctcttttcgagctatctgctcctaggggcgaattctatgagccacctccttcatcggagcccatttatacaattggctatgaaattcgccccgaactaatcagcatgtttagggaaaatcctttttctggcttcgatctagaaaatccctatcatcatctgtgaaactttgagcaagtctgctcatgccttaagattcgtggcatgagaagaaactgtgcagtggaaattgtttccgttctctcttcaagagagagcgaagcaatggtacacctctaccgttggatgtgtaaacggtagcttggaaaagttgcaagacagattctgtcttgctttcttcccagttactagtattactgccctttgagtagaaattctcagttttcagcagatcaaaaacaaatcaatcggtgcagcgtggtccacattcactaatt

SEQ ID NO: 101400 - DNA, 658 bp, Oryza sativa
aaaaattataatgctgtcatagcttttttggactccattgaaaatcttgagagatctcactgttcttgaatggaactttagaattcttatcagaaacaagctactgttatacctaaagtataaacaaatttattggcaaaagaagtgtattatcagatgggccaagtttggggggtgagaatacaaaatttttccatgctatggctactgagtcttatagaagaaatgcaataccctctttagtagattcttctggtttagtctgtacaagacatgaggaaaaggctcacatagcgtggagtgctttctcttcaagaataggttgttctcagtttgagtttatgccttttcagcggcaagaacttttccatgcaaatcaatctcttgctactttggatcaaccctttggtatttctgagttggacaaaattatacagaatctgcctatagacagagcccctgggcctgatgggtttaatgggatgtttgtgaagaaatgttggccaatcttttgtcaggattattatagacttgcagctgagttctactctggtacactggacctggatcctttaaaccattcttttatcatcttggttccaaagaaatctgtgcccgaaggtataaatgactataggccaataccactcttgggaat

SEQ ID NO: 101401 - DNA, 776 bp, Oryza sativa
taagataatcagcatgcgcaccaatttaatggtcactggcgtatatctaaacaacttgcttcaacctaccctgcataactgcactgatacggttttgtatgcactgataattctttgattatcattcctgtacttgcttcacatgtttcttttctgaatccaatatcaacattaacctttgcgtagccttctgtcgggtcttgccatttattatttgcatagcaacattatattcttcaaatttcactatttttgtccacatacagaggccccatactgttaacatcatcagtccattgtcggacaggcaatatgttaccttcaaattgactgaatctgaaattgtggcccttccatactatagtagaattcttgcttcactgcaagattcagattatgaaatcctggtctggttatgcttcaccgcaataattcttttgcctactttgggaccaccattttcagttacttcaattaaggcgtgttcggttagttcctccacaagaggattgaagaggaatcggagacgatttatttcacaccttttgaggggatttatttctcgatggggaattgcatgttgtcatctctaattaagctcacagtagcagtggcacaatgcaaaagattagtaccaccatcgccagcttgtttgcggtttaaaaggatgaaaagcccaattacagtacaaagtattgcagtcttaacaacttgatttgtatctgaaccctttttaaaccttgaacattacaattaaggctgaaaaagaactgggc

SEQ ID NO: 101402 - DNA, 500 bp, Oryza sativa
gaaacggatgaagtacaattttgttttacagctcatgtatgatatagtttttgctgcctacttggtgataattatataagcatgaatcattctctcgttggttaattttgatgtcaaattgtatgtgctcgccttatgtactcagaccttgctgatagtcacatcgtttatattccttgtgaaacaatgtactccatctctctaaattatttgcttgaggccaactcttttttgtcgtgctgctagttatgactttgcgaggttattgtaattgagcaatttgaattgggtcatcaatagtgttgaaatcaatatgctagctagatatgtgtctcataatacttgtcgttttgatttttttttaacatttgaccattcggtttattcaaaaattataaaattattatttattttgtttgtgacttattttattatcaaatgtattttaagtatgacttatcttttttatatttggacaaatttttaaataagacgaatgg

SEQ ID NO: 101403 - DNA, 610 bp, Oryza sativa
tgctgtttttctttttatgcacctttctgcttttgttctctcttttattattatttttatcaaaaacgacctcaagtactttattataagattatagggactccaatgtaaatataaaaattacagggactcaaatacaaaagtacaaacccaaaaattaaaataatataaaaatggaatgctttcgacatgtaggttctgtttttgtaaacagatcttcaatccggcacatcattttgtttcaccaagatgtgtgatatattatggtacagattgaaaccgagaggagtatggtatctcggactcaaaaggagtggcgccttttatttttcgggggaattgtttatcggatttttttcgccctttttttatcggacaattacggttttttcgcccgttttcttctcgctcgcctggttatttggccagttttgttgacagacgatggaagcatctcttattttcagtagttgagatttgttttggagcctgtgttgttacctctccattccacataaaacattattcattttttgttacctcttccgtccacatataagatccttttactggaaataaaatgtcatatcctataaatagtttgttacct

SEQ ID NO: 101404 - DNA, 563 bp, Oryza sativa
ttattttcccattttatattttctacacagttttaaattgatagcctcaagtcaaaactaaattggtctgatagatcactccatgtagaagtcctctagggagaggagatctgttttgcagcgtatcccctgattatgcttgatcactccataaaaatgaaattacctgtagccttcaaatgtgatgaagccatgtaattttctggtgccatagaattaataactgatatacatggttcagaaacgagcttatatttgaagcatgatgcagagagtatcaagacaaaacatgtaaaatgtgaaaggaaaattagcatccggttgaaatatgaatcaggctgaacatttccaatgaatagcacaaatagaatcgataatacaaacctgaagaagaaatgcctggctgggtgatggcggcgatgtggtcaggcaggcagcgctggcttcggctcggctgtaccggtcggtagtgacgcggggcgacgatgcaggagtcggcgccggtcaacagcggccgcggaggacatcggcgaggcgggagtcggtgccggtcggcagtggcc

SEQ ID NO: 101405 - DNA, 722 bp, Oryza sativa
tttcagttatatgtttgctccctcagttttgctagatagcttataggcaattgcatgtaagattatcagtccgagctatttatttttgttcaagggagccctcatatgttgttttaggatctcataggctcaacctctgaagtatcctattttttccaccaagtcctgctagtgctgcactgaatctatactggttgataggaagcatgggtgtgtgctcatgttaggctcaacctcatcgtttgccactagtttgcctcattttctaagctagggtctaaatggtgattttcatggtccccaaaaggttttagcataacaatacgctgatttaacatatgctggagtagtggaggttagcgttggacctccaaaattgcaataggctgtgatttgaaatgctgttctagatatgcatgcttatgcattaaatgggaccgtaggagagcattgtgtgtggccttgaagcctcaattatttgtagcctatggggccacatgcgtatgcacacatgtgtgttgtaactgaacaccaactgaatttcactgtgaacttaaaactattataggcacatagaagcccaccaccacatacgtacctcacatctgcattacttcgttcaaatcttcctcatcattaagtaagatgtggagatactacaaaaaaaatgtggattgggtgatgactccaatatagggcaatttgtatgttgggatgccatt

SEQ ID NO: 101406 - DNA, 601 bp, Oryza sativa
cctctttccatttttccaagaatcggagcaaatcttaaggggtttctatcctcgtcgcctctttccattttcccaagaatcggagcatatccgctttgtatagagcttggaattgagccctatcatcgcctctttccgtttccccaagaatcggagcaaatccgcttcgtattgagcttggaatcgagccctatcatagacaagcgaacctagctagaaacatagggtttcgtccgtttcgcttggaaaaaaaatcgtgtagcggatgttgacaatgacggagaaaaaatcatccggaaaccatacgtattttttaattaggtatagataggcttgtttaaaggaaaaactattcagcctagctcggtccaaaaaaggactgcaccaggcccatcctgaccattttcatttcattgatcgatgaattttctttttttaccaaaacattcatgaaataaaggagcaatgctgcaatatggttcacatgtatgctgatacatgttaccaaacaaacaaaatgtagcttactttatttggctttagagatattctacgtatttctagtaaacactgaaatatcactatgtttatctacttcatt

SEQ ID NO: 101407 - DNA, 662 bp, Oryza sativa
acgtattatttacagtgaaattgggtaatatagatcttgaattatttaaaagatgttttaaagaacattgattggatatttatcatatatagatcttaattttactaaatatatttatatttgtgaagtaatatattttacttttatattgttgaacataaaaaccatatataacttaagaattataatcatttagctttctaattattttttgtttttatattaagttgctaattagttaaaaattagaagaatgaagaattgaatgagaaaggagaggaggaggagagagtacgtatgtagttaattagttactattgccttattgtatcataattgatccaccgatttgaataaaaaattagacttgatattgaaggaaattcttagggtttccttcaattttggggaggactcatgaaaatgatacgtgcatgtgataaattgaaaaagaccaacatgtaataattctttaccaccaaaatatagctaactaatatgagtcttaaaccgttgatttgattaaaaaacagtagttcaagtgtataataaactgaatgtgtagttcaagtgtatcactgtgatcactcctataatttaggtagcatgcatggtgcacagcgagctcctgcaggctccatatctctaacttattgtaacaa

SEQ ID NO: 101408 - DNA, 512 bp, Oryza sativa
  unsure (1)..(512): unsure at all n locations
caaaaaatacccacggcaccgtcgctccttgcgcagatggatgggcactggatgagataagaaatcggcagcggtgggggggcgtgaatgaagccgctggtgaaggagcgctggttcccccgccgcgggcggcaaatgcggggcgagcaagcgagcgcacaggcgggggcgtggatgcggggcgggcagatttggggcgagcctgcgcgcggctcaggcgggcttcgcacgggcggggctgcgctcgccgaggggaggaaagaaaagagattaggtgagaaagcggcgccgcacggagggaggaaacgagaaagagcgaagaggagaagagggggcgcgactaccttttncttcctttggnntnttttnnttnccnccaaaaaaatttctacccttctaacatggacggatggatttatctctgtacctcccagtaccagtacctaccggtacaagttgctggatgggagcaacgctcaagcagtcgaatacatgaatcatccaacttggac

SEQ ID NO: 101409 - DNA, 613 bp, Oryza sativa
tttttatgaaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcgacaggacctgtcgaacagcccccgttcgacaggcagggctgtcgaacagcccccgttcgacaggctgggctgtcgaactgccgcagttcgacaggatgtccgtcgaactgccacagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaa

SEQ ID NO: 101410 - DNA, 582 bp, Oryza sativa
aggcggccgggctggacgagaaccacaacggcgacggccaccgccgccgtggacgaggtccgcagccgaggcggtcgcggtgggcaagggccactgccaaggcgagcagaggcgatggagacgacggccatggcggacgagggtggcgacaacggtagacgagggcgatggagacgccggccatggtgcacgaggtggcggcccggtggagcgcgacgacggcagatgagggcgacggagacgctggccatggtcgatgaggcggcggcccggtggagcgcgacgacggcagatgagcgtgacggcaacaacggggaacacaagcggagcgaacgcgctggtggtgataccggcggacgcgggccgagtggatggcgatgcagacgcgctggtgggccccgctgcctcgggcgagcgtgcagtcaagcgactaattaggccatccccaaccaataaactattagtttccatacttgtcatgtcatatagacactatatgtagacactatgtattcaatggatggtgtatctatctatcttctatctatctatcttctatctatctattatctattatatact

SEQ ID NO: 101411 - DNA, 728 bp, Oryza sativa
tcagttctgtccctttcccatctttcaattcaatgggtgattgccgggagcatcaatttcgtgtctgagaagaaatacccaggaacccatccggggctactgactttgtcgttgagatttacaataattacagataattaaacgagtcccacagtatgttgagatcactaacactattaaatggattgcctttagtttacgttggttgggaaccttctccttcagcacacggcaaacagagaaactcattcgcacatgattaattaagtataagctaaaactagcaccggtggagaaatgctttttagtcacggttcgcaaccccctatagtcccggtttttaaactggaactaccaatccgggacgtcccggttcaaatacccgggactaaaaatagatatttagtcctggttagtaacaccaaccagaactaaaaagaggggatctttagtaccggttggtgttaccaaccggggctaaagagagggtggcggaagtgaaatgatcccctttttcttttttctttttttttcttttttattttctcccaaatcaagtgggatacatatcccaaatcaaacccccaatccacaaatcgaagtaacatctcaaatctacatcacaaatcaaagtttacttatacacacaaataaatacatcataaatcaaatacatcacaatatcctaagaaattactcaaatacatcacagatccaaacaatgaatc

SEQ ID NO: 101412 - DNA, 623 bp, Oryza sativa
aaaccgtatacccctaaagtgcatgaggactcaagttcatggagcgggtactgccaaagtgaggttgttgaaaggctttgccgtggcaagtctcattcgttgggacgtaggctcatgtgttaggcaagtcgcggagtacgggtaaagtgtacatccactgaagtatgagtaaaccaatctattcgaatagccgtgctcgcggttattgagcaccgggacatgtattacacttggctagactctaatttcttaatatgatagggaagggatatgcatgatgattttgtaattgtggatcaacttctcaagaggcgagaaggggtagaccccagaaaaccattacgaccagtggcgggaagctatccttgggacacaatggatggtagacagaaccgtcgctgtttaatgaacaatggagttaaaacttgatcagtttatgctaggtcttaggcttatgaaaagaattgcaaaattggctttatgcaaataaaccattagcctttcattgaatatcctctatcatatgcatcgttgttatggtggcttgctgagtacggttggtactcactcttgctatttacaaattccatcagaagccggtgatgaagtctcggatgacccat

SEQ ID NO: 101413 - DNA, 786 bp, Oryza sativa
ttcctgcagcccaggtttaataaattcgtctcacagttttcaggcagaatctgtaatttgttttgttattagacaacatttaatacttcagatgtatatccgtatatccgatgtgacatcctaaaacaaaatttttttgccaacaaaaccgggcctaagtcaaacattttgaatgaggttcttctcccattttacagtacttgtcgtttataattttgtagtaagtcagacatttgtttgaccattaatttttaaaaatttgtatagtttaataatacaagtcatatatttttaagatttaccatgacaaataattttataataatataattcacatgttatttaactatacgagtttccaaagatcaataatcaaagttacacatgtttagcttaggaaaaaataaagcgatgaacatttgaaatggtaaaaactcatatagtccaacgaaccccccccccccccccttcttttattatttctgtgtagatttcatttccttggttttgcacggcaggaaattaaggtgtgacaaaaaaaaaacatggtatcctggcccaaattgattaagcacattttgagaggtatcacaattccattaatcatcctatttcgtggctagttgacgatattttataatccattctttattctccgtggccagctgttgtttgcaagcttatcctttccttttaagaaaagtatactactaattagcgtggctgcttggcacaatactgatcaaatgcaactgcaagacctactccgtttggggctgcaggaat

SEQ ID NO: 101414 - DNA, 723 bp, Oryza sativa
cttataaattattttctagtagctaataagccgtttgaataagcatataataaatataagagtaagagatacaatgatattgtaagagataagggagataattccaagcctggatcacgatgaaaagtgcagggcaacaacacatacatttggatgaaaaaaactgggaaaaaatgttttgtgatattgaaataattctattaaaatttggatatagacttgcccaagtaaaagaagtggagcagattctagaaatcaaatctgtatcaatagaattataatgtgttcaaatctaacagaaattaaagcatgggaagtttgttaggaaggttacaagttacagttggttacacctctaaaaagttactcccttcaatttttaatacatagcgtctctaatttttaatagatattgccttattaaaatgtaattataatgtattttattatgatttatttattattaaaagtactttaaacctgatttatatatttgcacaattatttgaataaatcgaaatgttaaacgtttggctaagagacgacaacgacattattattttttttagggaaaacctcagaagagaacagggagagcctattttcatttaagaagaagaggttcactagcaccaatcggcaccgccacccctagcgcccttatattatagctaagtcgctgacgtgaaggggttagcgcaaaaaacttgggctgcaggaatt

SEQ ID NO: 101415 - DNA, 2242 bp, Oryza sativa
accaaatattgacttttctctgaaaattaattcacctgtgacagatctagtgtgacagatctagcatgggggctccggtacccttgcccgctggatcttgaggtaagggggaagaagagggatttgaggaagaaggcaatgaccctcctccattctcaagctgcatcaacccctgtaatttacaataaatatgattcattttatctgtatatagcaaattaatttataaaaagggtaaaaaaaaaggaaatatttttttcttaaaaatagatccttcacaccaaaagaggctggcgccaagggcctacttataagaaaaggtacttgcgtttggaacatgtttagaaatttttttcttacaaataagtccttggtgtcaattttttttgcgctaaccctatcacgtcagcgacttagctataatataagggcgctatgggtggcagtgccagttggcgctagtgaatctcttcttcttaaatgaaacaaggctctttctgtacttttcttaggtttttcctaaaaaaaataacgtcgttgtcgtctcttatccaaacgtttaacatttcaatttatttaaataattgtgcaaatatatgaatcaggtttaaagtacttttaataataaataaatcgtaataaaataaattataattatatttttaataagacaatatctattaaaaattagagacgctatgtattaaaaattgaagggagtaactttttagaggtgtaaccaactgtaaccttcctaacaaactttccatgctttaatttatgttggatttgaacacattataattctattgatacagatttggtttctagaatctgctccacatcttttacttgggcaagtctatatccaaattttcataggattctttcaataccacaaaacatttttttcccatttttttcatccaaatgtatgtgttgttgccctgcacttttcatcatgatgcaggcttggaattatctccattatctcttaccgtctcattgtttctcatactcttacgtttattatgcttattccaacggcttattagtgattagaaaataatttataagtaaaattttatatatgttcttagtgactcaaaagaaaatcttgtaaaacaaactacgatgaaaaaacccacaaaatcacctccaaaattaagttttaaaaattgaaatttagcttctaaacatgagcaaaacaattatgcttttattatccctaccgatcgagctgttttagggtagatctagtttattatttttttacaatgggccatatattttaaccaaggtttcataatggactagggttaaatcaatgttttcacttaacaccatacatctttacataagttgggtgagcaaaacaagggaatatgtgagagagcttcatatgatttacacagggataattataaaaggcaaaacattttatgttttcttccttcttttcagtgtgtggtagttaactgttctatttcctattttattttattcatttaccccaatgtatagatcattttgtgtcacttttaaacatgttcacgtcattattttagtgtgatttgctgaaaaaaattgttttcagatttgctattttttttctaaagatatttatcttaatactgtggcactaaaattgatgattttaactatcttttctctgacaagttccttcgatgtgctcaaccatagtccaaagtgccaactagtgtaaacatatatggtgtttagtgaaaaggttggtgtggaccttgcccattgtgaaactttggtcaaaatatatggtgcaatgtgaaatttactctattttttattataacagtgtaacacgtgaccttgaccccccccccccaccaaaaaaatagagagaattgggaaaaagaataggaccccttatggatgggttcacaggccacgtggtggaccatctccacctcccccacctgccccctatctctctagtgagaaattttcatatctcctacgcatagaaactagtttcaccgaaattttcatggccttttacatttgcaaattattttttctcaatttcaatttctttttcgcgcagaacgattgagccaggggtaaatacgtttgagaaaagaaattgtgaaaaaacaatttgcaaatgcaagaaaccataaaaaggtattgcagcgaatactcgcggtttaagagtaatattgtattgaatcccattttaataatggtattatagcaaaatccg

SEQ ID NO: 101416 - DNA, 569 bp, Oryza sativa
ttgatatttttatcatacacgggaagtatatattttacttatttatcccgtgaggggagggcgcataggggccgcgtgagacagtgagacatggataatatttttatcccttagcccccccccccccccccccaaaaaaaaaagtggaagtggaactgagcgagaaactaaaaaaagggaaactcagcgagctgtttggcgtgacgaatatttgtgttagggataaaattgcaactgaaattttgaagggtttacatgtaattagagaacttgttagggacaccattgcaacccgattattactcctatataacaacaacgcagccgcgggccgccgccttctcctcacgtaaacgccgcgtcctcctcctctcacgagtaacatggacagccgcgacgacgacgccaggtggcggcagctcggccctctcctccacgccagggacctcgccccggccgacctcgacgccgccctcgcgctcgccagggcgtacgccgccatggagcggttcgatctcgcggcgcgggagtgcgagcgcgcgctcgccctcgccctcgccgacgacacg

SEQ ID NO: 101417 - DNA, 1528 bp, Oryza sativa
gtgtccgaaaaccccttccgatattcggttaaacgtctgatgtgacacctaaaaatttttatttcgtgaactaaacagaccctatgtagtttctactcataaattgctactcctacgctcatgaatcactgaagcgtcatgtttcgaatgtttcgacgtgacgcactgtgatgcttcagtgacttttcgaagcgtcatgattcgacgtgacgcagttggtttggaaaagtaacggtgatggcatgtctcgaattttaaaaaatttcaatggcacacagtagttttcacaaatagtagtggtattttttcaaaccagaaatttgtaatggcacgagtccaattaacccaatataatataagggtcacatcctccaaaatctcttatattatacgatggagggagcagtagtctactaatactgtctattccctccttttcaggttataatgtaatttgactttggtcaaagtcaaattgttttaaaattgactaagtttatagacaaatatagtaatatttataatactaaattatcttcatcaaattaataattgaatatattttcataataaatttgtcttgggttgaaaattgttgtcgaaccgacaactgcgtcacgtcgaaaagtgtggttctctcaatagtagttggaagtaaaaacaattgtattgcttagtaaatattttttgaaaccccctgttacatggccacaagaggctacttataaccctattataggttcccctttagggtttatgttttacaaggaaatttacatggctacccttatgatagggacattattgggagcacacagtgtcttttacatgtatggcccccaatgggctttaaatggctcggcccgtttatttgtcgaaatcccccccctcgaaggcatagcggcccgctgggcctcctggcggtgaggttcggtacttggcgaaacccgtgcctccgtgctaaggctttcaccttaccgccttcgcccgtacggccctctgacgaggtcttcgtttggcggagccggcgtatttcgagccacggctttcgccgtgtagccttcgcccatatggttgctttctcgaccttcgccgcttgcctccggcctgagcctgtcacctaagttcttggtttcggtaggtccgaccgaaagccctcgtggtgtacctccaacaaaaatattactatttttttctacttggtcaaacttaaaacagtttgattgaccaaagtcaaaacgtcttataacctgaaacagagggagtatatcggacttacctccgctaatcttttgtttttgtttatggggtacgtaagtatatatttttcttagactccgtaaatccgatatagctacttacattctcactccgtccctaaatatttgacgccgttgactgtgtaaaacatgtttgaccattcgtcttattaaaatttttttgtgaaatatgtaaaactatatgtatatgcaaaagtatatttcacaatgaataaaatgataggaaaagaattaataattacttaaat

SEQ ID NO: 101418 - DNA, 586 bp, Oryza sativa
cgtaagagaaaaaaccatgggagtgattcagccagtcctctaccagaccagcagtggcacaatccgcatgctgctgcgcccgtccgatgaagtaggtcgcatctgcgttgcggagtccaaggattctggtgtcaactggagctatgcgcaaccaaccgagctcccaaaccccaattctggttagtatcaccgatcattctgccacagtcagttctgaattgcagtacatcttcatctgcagcttgtatgatgctatctatgtggtgggtggaaagcaggtatcgatggcgttaagctcaaggatgggagggtggtgctggtatacaacagcacctcaagaggggtgctcaaggttgctgtttctcaggatgacggcgacaaatgggaggatgtgctgacactggaggagacccatggtgtggagttctcataccctgctgtaattcagacttctgatgggctggttcatgtgacatacacatacaaaaggactcaaatcaaggtagttttacccatgttgtttggtcttcttatggtaattaccagtttcatcatcttccatgttaagaatgaatttcttttggtc

SEQ ID NO: 101419 - DNA, 707 bp, Oryza sativa
cccttgacctcaagtttgtccaaaatatcaagaattatagaaatgggggaagtgtctagattactcggcaaaacgatcgagatttttgggtaaatcaaacgcacctatatataagtttactaattagcaagagctggtattataagtcactaagcactttccaaacatgtcatataggctcatatgataagaaagagataagagaagaaagaggacgaggcaccctacatactactcacgtgtaatttactttaatatttacatactactgtatttgagtccttgtaatttttatatttacatttaagtccctataatcttgcaataagatacttgaggttgtttttgttaaaaaaataataaaagggagataacaaaggcagaaaagtgcataaaaagaaaaagaaaatccgcaaaaaaaaagaaagaaaaacaacaacaacaacaacaacaacaaaagtctgtttctcctaagtgacaaaaaaaaaacccgaagatccgaacggaaaaaaatcctattcttataaaaggcaaaaataaaatggtgaaaaaaaccgctagatttgatccctttaaaaaggggggaaaagaaaaaaatgcgattcctttaaaagtgaaaaaaataaaaaaaaacatttaaaaaagttcgtccgattcctaagaaagtggtgaaaaaaaggttcgtaaaaaataagaagctggttcgt

SEQ ID NO: 101420 - DNA, 590 bp, Oryza sativa
ataggattctggggaggatcagcagaagcagctgctgctgctgtttcttcttcaatcgtccatctgttggtgaattcgaccaggttatccaagagatcgacggacagtgccttgcgatccttgatgcgctggagcgtgctcttgatcttgctcaagaacctctcgctctcatcatcatcatcgtcatcggatggcgctaatttaaccgcgcaagatccgatcagctctgcctcttgttcttcagatattctctccggcacgagcagcggcgatcgttggagatccgggaagaactcgtctgcgacgtgcgactggaagcactccgcggtgaggaaaaccatcatgcattgcggatcggggcacatccagcagatccaatctccggtgtccttggccaagtccaccgcgcaggcgagggcgctcatctgagcgtccgatagtggctctcctgtgtagtgcgctttcagatcctcgacgctcaccgtcaggaagccgcggcggcgctcgtcgtcgtcggcggcggcggcggcggccatggcgaccgccttctactaggcctggaggaggaggaaccggatcccctccttggc

SEQ ID NO: 101421 - DNA, 967 bp, Oryza sativa
agagggcactcattgattgcatggggctgcttgttgatgcaatttcccatgctggtgaacctctttctgcatacattcaggctcattcagaggtacgcgtttttggtatgttgcagctgtggtgcctctaatgcatttataaattaaatatacatagataatatttggaatttgaataactgaaggactgtaaagtttagttaaacatacagaattgcgatgcaggtcttgattggtacttttgaagcgtctggataacctctgattacaataaccaagatgaatcaatctaaatgaattcgaatatgtatgttatgtcgtttataaaaccaagtagaaaatttaatgtgcttgtatgttgcaactgtttttgcacactattctattgcattccaattcatataatcgcaaattttctccttctgattatttgtgatctagcttatacaacatattgtcgcaggcgccacatgtggaggtcttggaacatgtttcaactatcctcaaggagtatggattttgccctactgaagaagtcatggacaccataaacctgtactactttttgttttgcttcacacaacaattttctatgtgaatacatgttaattttgctgattattttgctttgttcttccactttttccttgaagccaaccttatgactgcaaaatgtcagaaacaaaatcatgtagcaaaggtgtgttgggctcaagtgattctttttacatttaacaaaaatgagccctaatcctcctttttttttttcatggagaacagggtttacagatgcaaacacggcagttgcggaaatggctaatctgcatgctgcacacaaaaaggtaaagataatcaaatattactgtatcggagcatctctacctttgccttcttgtgagatgtagtacgtaaggtgtcattcacacaaatagtagtgtggtattgcagtgtgcaccagccaggtaag

SEQ ID NO: 101422 - DNA, 777 bp, Oryza sativa
ccatcacaagatgtcctccttcaagaagggcgacgaggtgcgcgtccgcacgcccgtgggaggctaggcaccacggcgctgcgcctcgtcatgtggctcggcgcggtcgtcgtctccgacgctgatgccgacgacgcccacctcgaggtcatctacacggcaacttcccgcgcgacgaccccttccggaccgtgcgcgtcgctgtcaaggacgtcaagctgcccgcgccgcgcctggccccgaccccggcaaacatggcggccccacggccgaccacggccggcaagaagctgccgcggctgaagatgtttatgctggagaaggagcagctgcgtgccaactccgaggccttcttggcattgtgatcagcgctgttcagtagtagcagtaggtggaatcagaacatgtcttcctctgttcttggtttgcatggaaggcgatgtgatcttttaaattctcgtagataggatggtctattcgcatgagaagaagaacatgcaatctgtcaactgtaatttgtcattgattatgaatgaaagatcgaggtttctcttctttattttttttaccaatatatgcatgatgaatgttttccttaatcctttggttttgttgatattcaagtgttcagatcagaatcacaatccagctgccctctgattacatatgtatgattacaatccacctgctgacaactttgaacttgtagctaggattcagcttccaattctttgcacgcctttggctttcctttccttcgtttagatcaagagcctg

SEQ ID NO: 101423 - DNA, 759 bp, Oryza sativa
ttcctgcagcccttgatgagttgctctcaaaggcacggatctgttcaagatcacgcccggacctagcatctgctcgtgcataggttggatacaccttcacagggcaccgggttcgtaaaattgatctccaatatgggaaaaaatttctccttgtatatgtgggatcccatcctctgcctacttcctttctcccagcctgttacatagtatttcaataaaagtacagcattggaaaaacaaacagacataatatattcatattggtcagccacaatctctcacttgagaggttctatgttaattaacacaaagtattggtgttttgttggatatgaatggttttactacagtgcagtactgcttaagcaacatgataagctgttgaagcagcagaaggcatgctacaaacatagcaagcgaaatatttgcttttgttgttgcctctaacaacttaataatattacactgcatcttccttcatcagaatcttcctcagagagaagatgcaagccccctttgtcaagtctcagtgttgatattacttgggaattgaaacaattcagctatgttattgagctaattatgcccaacggggttttagccaggcgctagtttaatttcattatttgtattatttcctttattattttttattgcatttaccccttatctttggtaaagaacctgatgagaaacacagtagtctcgatcacattagcgtggcagagatgaatcataattggaatgtgtggcattgca

SEQ ID NO: 101424 - DNA, 536 bp, Oryza sativa
tcacgggccgggcttgagccaacagataaattgatttagggttttactgttaaagaatacattgggtctttttggaacttagggcctgtttgtcacagctccagctccaactccacccctcctggagctggagctcagccaatcaatttcagctctaccaaaactggaagtggagttaggtgaagctctctcacaaaatatattagagttgtggagctgggtttaggcagctccacaactccactccagactcaactcctggagttatatttaggagttggagctgtactaaacaggccattaagattatgagaaacagcttgtgaaaatctagaaaaaaactcagcttatatcctatagttcattttctccattatacaactatggattctcagaatttagataaaaatctggactgtttggggctgctagaaactcccccaaacaggcccattatctggttttgatttagggagaaaatcgggttatagttgagacggtaatatatgagttttctagaattaactagaacaact

SEQ ID NO: 101425 - DNA, 568 bp, Oryza sativa
ggattaaatttagattttctataatccccatctagtcaaatcaaacaattgataatttgttggtaagaattttataagtatgttgttaaagtgaaggtgcacataagacttgtttacgtgaatcgtaaaacactccctcgcgtcgctctcatgcgggcggcccgggggaaaaaccctagccacccaccccgacacctccctcccccctcccttctaaccgctggaagcaagcggtcggccgggaaggtggcggcggagcttctcctcagcgtgggaggtggagcggcgcgtttctgacaggaggcggcagccggagtgggcatcgggcagaaatgctccccctacggccaaattaggagagggcaagctcgcggtggcgtggtggcgcgattcgggaggcacggtccggtggaggcttgcggcagcgcgacagctgtggccaatggtcctcgctgcgaggacgtgcagctccgacacctggtggcgcttgcgtatcgctgtgttccttgaccgacattgcggcgaaagccaataggcgcgcgcgtggaggcacgatcgacggcggtgg

SEQ ID NO: 101426 - DNA, 563 bp, Oryza sativa
tggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaat

SEQ ID NO: 101427 - DNA, 741 bp, Oryza sativa
tatcattttgtagtttttaagaagtcacaccaaccattgctactccactgcttgcctggctcgccaccatttatatttattgatcttgtgaccttaaaaatcaaacattttctctctcttgtttcggcttatagattctggagattccgtcactcgacactgccctactactttacaatccgcttgccgactctcctctttattatcattccgaataattgaacctgattctcgttagggtttaccgatgttatagtttttataagctgcgtcaaccaccgccgtccatggtccatatcttcattttcattggaatctaaaaaatcgcacctaatcatcattggagttcgcttttacagtttttcgaagtcacctttacttatgctccactattcctttacagtccacctgtcacccctactctctattatcattagaagttttaaaatcaaacattattatcgatgtagttctgttttcatagggttggatttgatgcccgccgattgagcttcgttctggcgaggatgagttgtgaccatgctgttagctttactttcttcacctaacgcggttacttcgttggctctgtttgacttctcagatagtcatggttgcatatataaaaattacatccccatgcatgacccctagttaaattttcgataaatctcaataactctatatatcgtccccaaaaattaatggtgaattatttcttttggagactaaagccttcta

SEQ ID NO: 101428 - DNA, 592 bp, Oryza sativa
aactttttacccattggcatggtatgacctttttactcctcacccacttggctgcagctatttcagaatcgtcctcgtcatcatccgacccatacatgtacggacaaacatgattaaccttcttagagtttttcctaacttccgcagacctatgctcatgcaaggttactttctgtatcagatgtgacaagctatcaaagtcttcatacgagaatttctccctaatcggagcaatcatatcctaaaaagccagatcggctaactgggcatcagttaaactcaaactaaagcatttgttcctcatctccctgaatctctgaatatactcgtgcacaggttcatcatgccgctgcttaatcgctgtcaagtcggataatttcatctcatgaaccccactgtagaaatagctgtggaattgattctccaaatcggcccagctattgatcgaccaatacggcaaagaggaaaaccaagtaaaagccgatccagacaaagataaccgaaataacctaaccttcagagcgtccacagccgatgcttcaccacactgagctaagaatcggctcatgtactcataagttgacacaccatc

SEQ ID NO: 101429 - DNA, 602 bp, Oryza sativa
tgcttgtcacagtggaatgcaacaaaatgcagacgtacaacactgtacaattagctaaacggcaaaagctatcaaagagtgaatcaaactacactatggccagttcaaagtacagctgcttctgcttgacatggatgaacaaggagaggagattttaacgacgccatagatgatccatagcttggaagactagctagcataagataccaagatgaactaggccgcactccaatctccaattcctgattcttccatctggagcttcaagaacacgagacacggacatagaacgagaaaggtatatatactttgagatcaatttaagaaaggcatgaatatacgcagagaaaaatgccaaaaagagaggaggattcaaggaaaaggaagttgcgcttctaggactgcatgtttgttctttcaaggaccatgggaagtactactactattgctacatataagacatggtgattttgtttacgataaggcatatggatgtggattttcatccctcgaggggacatcccctgttgtttgtatgtcatctaaatagttatcattttttttaaaaacaattgacaacatagattaatatgaaatatatc

SEQ ID NO: 101430 - DNA, 614 bp, Oryza sativa
tcggagaaaaagaaaagtcagagtccatatagaaatacaatttagaaatagctgaaattcggaattaaaaaataaggaatattagaagaggagactagagtcaatatagaaatacaatttagaaatagttaaaattcggaattaaaaaataaggaatattagaagaggagactagagtccatatagaaatacaattagaagaaatagttaaaattcggaattaaaaaaataaggaatattagaagagaagactagagtccatatagaaatacaacttagaaatagttgaaattcggaattaaaaaataaggaatattagaagaggagactagagtccatatagaaatacaattaggaaataactaaaatttggaattaaaaaaattaggaatattagaagtagagtatagattacttatagaaatacaattaggaaataatagaaattcggaatgaaaaataaggaatattataagtagagtatagaaatacaattaagaaaaaaaaatagaaattcggaattaaaaaataatgaatattagaagtagagtatagagtctatataggaatttaaaactaactaaaattcggaataaacataataaaatgaaaag

SEQ ID NO: 101431 - DNA, 616 bp, Oryza sativa
atgcctattggatggatagtttactcgaaaagtgagtaccatcacatactaacacttgataattgtgtgtaccttcattttcattgtggttattgccttggcataatggaggagaatttttgccataggacatccaactgacttgctgacttgcacatggcaacaacctttttgctgtaatttaattaatttgttccatgcaataattgttgaaaatattgttttttaatctagaattctttcctatcctactacacgtaatgtgcaatgagggttggcttgttgtttatgtttagtttcatttgttcttccatattttgtatgtggtgcttcatccttgtgcaattgtgtatgtaccggcattctaatgttggtgcttgatttcaggtatccaactgacagcgataagcagatgcttgctaaacagacaggattaactaggaaccaggtaaacaaccatttcaagtttttcttttcccaaatttatatcgatgtaactagctagtccgctacagttgtccactagcaatatctttgggtccataatgttactagcgttgtaaaacattttgatatctcaattcttgagcaggtatcgaactggtttatcaatgca

SEQ ID NO: 101432 - DNA, 579 bp, Oryza sativa
gaactggcgataatgattgattaaaacgcagctggtgactacccaaagaatttctggagttagaattatttgcgcaattggtgtggataacgatgtgcatgcgatttttgggtaagaccagagacgatcccaaagaatttggggatctccaggtgtcccgcagtcggaatcttttgatgacggagagctcggcccctttttaaagcgttgatataaagcatcatataacgttttactcaagcggatgccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagtgagtagtgacagcagttgagcacagctcacaccaggagctttgcaaaccatgattagtccatggcccatttgcctttgtaacacatctgggggc

SEQ ID NO: 101433 - DNA, 645 bp, Oryza sativa
cacgtatataaaatacaatatgaatattacacattagttgtttcgtaaagttattgcaaaatttaaaattatgttgtcattgtaatatattttaataatataatgagaaaacatatatgttattatatgagagaaaatataatgatgctaaccgcgcaatttgcgcgagccaccatgctagttatattatcaaaggaatagaaaaaggagcctccacgttcgctttcatggcctagaaattctcacattaatcggagaaaaataaaaagcagaatccatatagaaatacaatttaaaaatagctgaaattcggaattaaaaaaaataaggaatattagaagaggagactagagtccatatagaaatacaatttagaaatacctgaaattcggaattaaaaaaaggaatattagaagaggagaatagagttcatatagaaatacaattaggaaataactgaaattcggaattaaaaataaggaatattagaagtagagtatagaatccatatagaaatataattaggaaataactgaaattcggaattaaaaataaggaatattagaaatagagtatagagtcccatatagaaatccaattaggaaataactgaaattcagaattaaaaataaggaatattagaat

SEQ ID NO: 101434 - DNA, 646 bp, Oryza sativa
atatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccaaaaaggaaagcccgcggccgcggcgggagcacggaaagcaacaccagcgtcttgtgcc

SEQ ID NO: 101435 - DNA, 1776 bp, Oryza sativa
tcctgcagcccaactaataccaaatagtaccagctgatacctatgtggtatcatgcccggaggccgtagtacgtaggtatcagacctcctacctaccaagtatcataccgttttaatggaatctcgtacaatagcatcctcctaatcagtagcagtaccagaaaatcccatgtgggacactacacataacgatacaagacaaccaccccttggggaaaacttttatattttagacctttttaataaataatctatctatctatctatctatctatctatttctattatatactaaaagtccatgaaacttcctacaaacgctctcaagccgccacgtgggactcctacaaacgctcctaggccgccacgtggcactatctaatctcatcgtcgattttcacttaaattggtggacccgtttatttagaccattagattagatctattattaaaaaaggtgatagtttttccttaaaaaaacatatgcaaccggtggctgggaaaaggaaagaaaaataaatgtccctacgttaaacggtattgctaaatttgtgtacagtcggatgttttaaccgtgagatcgtccggtaagattcgtttcaagcacttgcaggctgcatcccatcttacagcttatgcgaaagaaccaaatgcacctaatcaagctctaaactcattagcacttcacctccgtcgtaaaattaataattatttatatatttatacgaatttacaccgtagttacaccccatttatatatataattagtatataaatttaagatttacatatctaattttgagacttacattataaatacactaaaattacatatataatttagggaattacaatgtaaatacataccgactattttattttactatttttttggtgaaaaatatggcgctataaatatagctactaccttttaaaaaaacatataaagctacctactgttagctggaagaaaaaaatagacatctatctacgataaaataaagcaaaaaaaaaagcgtacttagtatccgtgaaaaaaactacggtctaaaaataggattttgtataatataaaaaagataaaatacaatactacataatatacggaagtatatatatgcatgtaaatctagatctataataaaccaatagattagatcttgtaattaaattataagaaaaatcaatttaatttgatgtatccattatttttaaccattaaatctattttttagaaaaaatcttaagtcaccgtgtgtcacgtcctataaaaacggaaaaaccttagaaattcttagaaaaaaatgaaacacctcgtcattggctttcacttaaattatttaaaaaagttaaaaaaatataatctccaccgcctcaccctcacatgtacacaacactgtcatcccctccctattattttatctattaaataaaagagaaataataagtaatgtttgatattttttttgaaacaaagtacaaacgcgggcgctcacaacgcgcacaattacttctgtgaacgcacacatgcaaatacccctttgagtactttcaagagactagcctgatatattttgagattgacgaagtcaccacgtacgtctcgctatcgacgggtacgttgcctaccactaaaagaatttgtgaagtctgaactcgggcaagttccatcacaaggaacctaaccggttgagctacgttcacttcgtaataatattggatattaaaacaaccataatttttaagctacattcttggagtactcctatatctttt

SEQ ID NO: 101436 - DNA, 776 bp, Oryza sativa
ggtggtaccactgctccgtccattaggtaccaggcatccgagtccgagtaccctaaaaagggcataatggtcttatcgtgtcaaaaagcttaacgcgtgagcaggtcttgcaccgacctcttcagcctttcttcttccttcccagtgcggccgcactcactagaagagctgtcgccgacagcaaggacaattggacaaggtaaagcaatgtgggagcaagaagaccagatctactcccctcaaaactagaggcactagatcaggtcgctccaacctcggggggaccagctttgccccccagtgatggaaggagctcgacctgccaatgaaatccttgccgaccactgccttccctgcactaggccaagctctttcttctcatcgtggttgtatggtcaccgcatcaccaagccactcttcctatggccagaggctggtggtgttgctcgtctggagacttgagtttgagggccttggcctcttctaccctgacggcgatagcctcagcctcagccacagcgagtaacgagcatagctagaggggcggtccagcaacggcaaatccccttcttcaccggtgacaagaagaccctcggcggctgtgcatatccatggcttcaccagcagcagctccaaagtccagcgttgtccctgtcctcaagatcagaggtcactaaacttcttgcaaagttctccagtttataaaacttcactgaatttctatgcatatgcagttatcttgtttatgtttagcgaagtttagagaatttaatggc

SEQ ID NO: 101437 - DNA, 706 bp, Oryza sativa
acttcacagaccatgggtgagtgccagaattcactattcttgtccctatgtatatcatgcacatctgaataatcacatggcaatatataccgcaaaggtctgaacttggaggatgaatggtgaccggccttattaatgacgatataactaccacgaaaaaaatcgtagcatcaatgctaaaattgtggcaatagatacatgttgttacaatcttaaaatcgttgctagccgtggtaataggttattgcaataatttttatttagttgtaacaaattttgatattgccataaaatggatgtggcaaaagaatatattgcaacacttcacatcgttgcaatagataactattaccaccactccatgtatggcattagttctacataccaaactaaatatttcaatattaatttatcattctaaatattttcttttgatatcttgtcatggctaggatttgaacccaatatctctccctcacgcgcgctatctattaccaactcacctacgcatcacttttgtttaaaaatacatatcattccatttgagcctgtctatctgagatttgaatcatgaatttgagtatttaaaatatttcaaatgaaaaagtcaagttgtagagctctaaatttcatacaaaatttatcctaatccgtgtccatatgaaaagaataagtcaaattatgagatgataatttttttatttca

SEQ ID NO: 101438 - DNA, 1363 bp, Oryza sativa
gagacatggatatgctatagaaattatattcaattagatttcggatggtatcttaccataaattttgaaaagtgtgttccccgcaaaaaaaaattgaaaagtgtggtgcgttcccctagtactgaataacaaagcaccggtagtcactcccataatgcaactatacttacatatggaaacaacatattagtatctaccacataaccgaaaggtaattccagttgttggtaattcataattgtcgatagcaaaaatcacttcatgatctgtatgtttatatgatccagattattgatgaaatactcgatttcagattattgacaaactagttaggcgcacgctcaaaactcgatcagcaacacaaacaagtaattcacctcaaatccagcgttcatacaactaaaagccaggagatagatcatctgatatcatctactgctgattcatgatcatctatggcgttcgatacggtcactgtagaagctttcatgtactgcttctattttttccactactcttgtcattgccgatagtgatgccctattgtggacaaagcgagtgagcaggaatcttcacaccagctgagcaaatgatgcagctgaaatcttcgcagcagctaagcaagaaatgcaagatagtagcacctcacttccccaagcctcccaaacccaaaaagggttttatgaatggttgctccgttttcagttcgatatataggttttcgaggacaaacccatggattttaatttactgcagaaatcagcatcccttgcctaaggctgtgaactctctataaaaccaaagacatttgtaacacataaaagatccatgcagatgagccttggtcgctggcatggtgatttgatctctgttctgtggcaatggcatcaacatcaaaagaatgctgcccaaagattgaacatcgaactcaacagtactagtagccacaattcttgtccttgtggttcattcagattaaatgtatatgtgatgaagcatgttttaatcattcttcggtcttttgacttattaatgatacaatgaatacccttgaactgtacattcaaatgtgccccagggagaagtactgaaccactagacttgtatcatatgtagcagtaggacactggcattgtctcttggaaatttcaaggagatcataacattcaaagatttggggctgatggaagtgaaggagctagttgagaaggcctcaatcattttgaaacagtcactcacggaggagattgaggcaattattgagaagataaaggtagcattaatttggaagtcatttctttgcaagtgacaataaagcctcttaccaaagtatttagtatcaaatttggtggttagtgggcta

SEQ ID NO: 101439 - DNA, 510 bp, Oryza sativa
gtatttttgtggtcaaaataatgtcatagaaaccatgtcaatatctcaatccaaaatttaagttttgtattgtaggactaataatagatggtctcattaagacaactgtaatataatttgtttcagacaatttagttgcaactgccatatactatgtttttccattctagaccacgtttcccatattttggccgttaatatatattgcaatatagtttgcttatagcttttgaaccttctgttcaacaggtcaggcacatgtttgatgagattgattatgttttagagggaaggaatgctgaaagatttgcgagactttattctcatggtgagttcttaatttttattcaatttttgatttttgctacctgctagtgtgggttcctctaaatctatctgacaagcttgctctcctgtttcccatttatctcgaccatcatatccaaaccttttacattcacatttcctagtgctctttcagctcagattgatctctggctctctgctatt

SEQ ID NO: 101440 - DNA, 1946 bp, Oryza sativa
ccattagttttcgattcatgaatcatacaatagcatgaaccattaggatcatatgataacaaaggtaaaaagtcccataggtgagaaataaaaggaggagcggacgtgagaaggtaaggataaggaagtgaggaggtgagggagaaggtgccttggaaaagtttgaagatgttgagagggaaaagaggtggacggttagacatacttgtaggcaggcctttaagaggcccacatgcgaaaatgcattatcacatgcagtcgcttaagaggcgctcctgcgaaaataaatctattttcacaggcgggtctcttaagcggctacccgcgatgccttgaatcgatcccgtgaagagcgatttttatatgtgggagcagttatggtccatgtgcaacctataggaagtctcgtccaaaaaattgatttggtagtggtgccatacggtaggggtgctatgtacctagcctttgggaggaactggcggcctaccctagaagttatagtaattgtaagtatattttgccaatgcacggtgtgacatttaaaaatatctattatcctctcttctctctcccctacccccacacacaaagaaagaaacaaaaaggaaaattgaatatccgtctagcaatcttcttaatttcacttagcttttttatggtctttcaaaacatatagaaaaactaatttttgatacggatgaacaaagattttgggatctccatttttttcttgaaatagtagtaccggtgtgcggtgtgctcttccttaactagttaattactacccaacactgctcactatgtactggaattccaaatggacctgatgagggcaaatcccaagtcaaaaactatcaaaagtagtttatattcttgccatgttatataaacactatatgaagaaactatatactcaatgaatggtttcttcatagtaaattcccatccaataacctctcttctgtctcattttgttcagctatcctcttttttattttttttgcaaggaagctatcctcttgtttttattcttggtttatgtgtagaactagcttcttacatgagaaatagttacctcatcttttctctcacttcattaactctctatccacctcaatcttttgcttaattatgtgataatatgcttaaaatgctatgaaaaaccagatgagatggatggttgggagtgacctgcggcttgtcatgcttcacaaggtcagtcgttattcgtcacacacatgtttgtgccatgtgtgtgtgaccatgcgtgatacagtatatacatagtgacaaagcatcgtgaatactggtagttacccatggtcattggggttaacagaaaaaatctgcaaaacttctatgtgaacgccaactctataaatgagatataaatagttttattagtttaaggtttgaatatagggcaattttgaaatatagcattattttccaaacttctctaaaagataggagtcgtaaaatgagtctctttcctttgggcctatttgatgaaatttcagctttagctccatctctcttgaagctgaagtgtaactaaacggttttagcataaaaaagaatagcgtaacaagctaggatgatagatcttacaaaataaactagaaaggtagagcagggttcaggctattttacaaattaattacaaatcaactttggacttagctcttgaaattaaatttagaacttgaagctctccaaaaggaccctttataacttagggcatcaacaacgtacattacgtacattgtcgacatgggtagtaggaatagacacactccacattgcttacttctgcaagatgccaataagttgaggcccatagaagcaacaatcacttgccttatttactttttctgtcagagaactaccacttgctttatttactttttgtgtgagagactgtacatacataatttatctccttg

SEQ ID NO: 101441 - DNA, 690 bp, Oryza sativa
cgctccactggttcatgtctcttgcaggttcctatcctaaaagaattccatgtatgcaaccaaaaaccaatcattcattaacccctttaggtttgggaggcttgaggaattgaactgctactgtattgcatcttttggcttagcggctgctaagtttggtgcatttttggctgacttgcttcatccacaatagggtgtcgctttttagctttggccaaggatcaaattcacgtgagcagcacactcacggagcaacaaacacacacaatagctctctggggatgaacacacagaagtgcacaagcacacacacaagttttttcttggcaacaaatgccttttcttttcttcactcacttacaaactgatgattacacggcttatgtagcctcgcgtacatgcacatatagctacttcctccgtttcacaatataagtcattctagcattttccacatttatatttagattcattaatatcaatatgaatatgagaaatgctagaatgacttacattatgaaacggagggagtagctaacagcccgaccgggtcgcccgcacgaccatgagccactcactcacacgatctatgcgtctcacgcgcaagaatcgctcctccgagctgactaaaccacgccacaaacatgctccactaatcttgcatgcagctaactaattcgccactaatcc

SEQ ID NO: 101442 - DNA, 504 bp, Oryza sativa
  unsure (1)..(504): unsure at all n locations
aacagtgtgaaactgcagtctttctgggatagaggtagtagtagctaatgttgagctttgttaacctagatgggaagactatcttgcgcaaggcgccaaacaaaagctctaattattttggatacacccgcatttcagatcgtagaccaacaaatgctttaccaatttaatcatacgatgtttatcctaattttaatttttctcagagcaacacacatcatttttttctatccaatattaatgatcaaaattagcaaaagtggataccaattttatcagataaggttatccaccatcttcattgaatactccttatctggccactccattcacccttatccatcaatcaaacatacttaaaatttggataaccatcttctattgctganggatatccctctaaatcacacacatgaatccccatcatttggcttatccattttattttgtaaacaaaaataatttatgaataaaacttttatatacgtgttcttaacgatataa

SEQ ID NO: 101443 - DNA, 509 bp, Oryza sativa
  unsure (1)..(509): unsure at all n locations
atggggacttgtacaagaagctgttggttgttctgagtaacattggatattgtaaagctgaactttcagatgaactgtataccaaatacaggcacatttggtccccagtcaggtacccgatcatctagcttatgttccactaacattgtcttactgtcctttataatttttggtgcgagtcgttatccctgaatagattgattgaaagcttgttatttcatctanagcaatgctttgatacatttgcttcactcagttagtgttcctctctcagggataatgatgagcgtagtgctgacatgcgagatctgatgacttctttctcagcacttgaggagaaagtcctggaacagtatacatttgcaaaggtatggtagaaaatccagaattgttgattaatcattattggccaaaagattagttataaccatgttagctttaatcctttcgtgtcttggtgtgcaaagttacaagtttgaaacacctgaattagcccactatttgttctt

SEQ ID NO: 101444 - DNA, 533 bp, Oryza sativa
tagtagaagcaaatcttggaataagccaagacggaaaggctagtgaattaggccaaagctagtgcttttttgttaagtacaagctagtagctgctatacatgcaaaagctaaaatcctagcccacacccccacaaatccactcaattcagcacactgtagcacacccccaacgatttcaaagcagataaataaacttgtaattgaagaatttcaacagactaacacactctcacatcacatgcataatctgaaattctgaatacagttaagatactgcaattaattaacgaagaagatagacatgcatcatatgatgcatgtagctagagatatatgcagtgtatcgaggacatgcatggcatggcaattgggtcgccggcgccggcgccggcgacgaagacggcggattgattacctggaggagagggtggtggcggtgggagggggcgcagtgggggcagatgctggcgcagcagccgaggcagaagatgttcttctcgttcttcttgcggctctcgtgggcgggacaccc

SEQ ID NO: 101445 - DNA, 547 bp, Oryza sativa
ttcaagtaattatttattcttttcatatcatttgattcattgttaaatatattttcatatacacatatagttttacatttgaataagacgaatggtcaaacatgtgctaaaaagtcaacggtgtcaaacattttgaaacggagggagtatttgtgttccccttcagtgctctgatttctaccggaatcttcagcttttgcggcgaaagggagatcaggagatctattcgacgagatgttatccccccaccacaaaacgtagaagagcagagacaaaaaggagtaggaagtcgagaccttaccacggggagagagagagagagagagagatcccccgccgccgcgcgtgtgaccatctccgtcgagaatggcggcgccgccggcggccgctcgccgccccgaggttccgtcgtcatctcgcccacgacgccaacgaacggtgcggcccaaatgaaacgcggaaaataggccatcggcgccgacccgacccggcctggcccggcccatctttccttccaggcgaattttcttgcgctcgcggcccatgc

SEQ ID NO: 101446 - DNA, 631 bp, Oryza sativa
  unsure (1)..(631): unsure at all n locations
gcaaacattcaaatattacaccatgatcctgtagttagaaaggttcttgaagcttcattttcagaacntaagagccatattgtcagcaatgttgggatttgtataggagtacatgtcttcaattcacatttgccaaaacaggacataccatctctacaatctccgagtttcacattgaccaattcagtcaaactgtaattaagttgtcaaaatactactttctatccaaaaacaagttagatcatcccaacagccttactctgagcaatcaaggtgaactagaagcagtaaaagaattgtcctccgacaactatcacaaccaaaatttaggagagagatcagtccttctcagaaaatgatgatgaatacaccttttgttctgagaaggagtattcatcatcatcaaggccatgacgcaaggtacttcacgccagtctgaaaatagtcagttcagggaaatgactcgtgagctactatagcagtcaggtgcggatccaagaacaaaaaattagggggctcaattacacaatttcttcaacctacagcaatctagagatctttagtttatcattcatggtgaaaaaattgaaggggtgctccagggggtattcatgagtcttgtgggtgtagg

SEQ ID NO: 101447 - DNA, 657 bp, Oryza sativa
atatccctcaccattaaaaaatgcttatccaaattttaagtatgtttgattgatggataagggtgaatggagtgccagataaggagtattcaatgaagatggtggataaccttatctgataaaattggtatccacttttgctaattttgatcattaatattggatagaaaaaaatgatgtgtgttgctctgagaaaaattaaaattaggataaacatcgtatgattaaattggtaaagcatttgttggtctacgatctgaaatgcgggtgtatccaaaataattagagcttttgtttggcgccttgcgcaagatagtcttcccatctaggttaacaaagctcaacattagctactactacctctatcccagaaagactgcagtttcacactgtttgtgtccagtgtataaccgtctgtcttatttgaaaaagttttatgattattatttttgttgttattagatgataaaacatgaatagtattttatgtgtgactagcatttttaattttttttcataaatttttcaaataagatgcacggtcaaacgttggacacagaaatccacagctgcacttaaatggaatgggggtagtaatatatagcatttgtgttgttttgtatgtttagctgcacttaaatgggatggggtagtaat

SEQ ID NO: 101448 - DNA, 600 bp, Oryza sativa
ataagatttttccaaaaagaagtaaggatagactaactgtgctgatacgtcgagaacacactccgctggagacttgtatatgtcatgaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagtgatgtaccgtggtttgaatagaatgagtctacaatctataaagcttgcattcagtccatagaaccaccacacctgcgaccaattaggcaaaagtcataaagaaaaaagattgatcaatctctccattagagcaagtttaatagtatagccaactacaggctccaattcatctatagccaatctaatagctcattcatacaatagttacatactacactattaatatctggttccacctatcatacacacacttcgtcttggaatccgtgctacagctggctacaaatatatagcctgctgcccttctctctcctcatttatctgcttaagatatgtttgcaggtggctta

SEQ ID NO: 101449 - DNA, 1182 bp, Oryza sativa
ctgcggtagccgcctccgccccctcgcttctgtagcgccgtctcgactgatatgcatatttacaaatttatccctcaactcaaaactgcaaagtgtccatgagagtagcatcattcagatttcagagacactgaattaagcacaccaagtccggcatgtgtgtaaatggttttgaatcatgttcaaaaggtatatactactactatcaaatatgtcaaaaacaactacaaaattgtaccgaaaaatcaattatgtttctaggaacctagctactctctgtcattgtgcgcgtctctgttcatgatcagattcagaatcaatcatcactgcggccatccgcattgatttctcaacgacacaagtagctagggggaaaccactgttctagaataagtgcatgcacaataacacgtagctggtcctcttcgtaggcatcccataaaatcgaaacatgtcctagcaaataaatgtaacgatattagaaatatatagaagcagaaaaacatcgatataaataaagagtaattttacgatccttaagagttatttaaatatatcactttatagtgtaaaagttagtaccttttgataccttatactagagctactgaatttttagtgtaaaaaatagtaccttttgatacctcatatatactagagctaccgaattttacaataaaatgaggtaccttctcctataaaatttctcataaatataaagaactgcgaaatttctcataaatatagtggaagaatcttccagcctctgtgccgtgtatacataaacatacaaggcgtgcaaaggaaaaattacaaattttgcaaacatgaaaataatataacaccatgcatgaatatgtagaatttacagattcaaaatcagttccaaggagatgccatgatctgcaatgcaaggggcatcaatttatatagattctaccattctagcacacccatgcatgctcatatattattctccatatatacttcatacaagcttaattaattaagcatataacactttggtgatagtaattaaactcttccataaatatcactccatgaaaaagccacatatatatgcatatggtaaatagaacactgttaaaacctgcaaattacaccccaagttgaaacagcagccgagtaacagtgacagacagcgtgaactacgaggcaaga

SEQ ID NO: 101450 - DNA, 587 bp, Oryza sativa
ccgggtgcaggaggtagccgacgagcggcggtgtgcggggacggcgagggccgccgcgcgccgccagctcttgtggcaagggccgcgcggaccacatccctcggacacagacacttcaggatggatcggagcaggaaatcgtccgtcagcacggccgccatcgccgccgccgccggtggctcttcgtcgccttccattgccgagatttagggtttttcttctctctctctctgttttttttttttgaaactaatggagtgagtggtggattggatttctaacgcgacttttttttttaaactaatggagtgagtggtagattggatttctaacgcggcttttttttttaaactaatggagtgagtggtggattggatttctaacgcggcggaccacgccttccaggcttccagttccagccaaggtggggacatggtggtgtatcggatgagtgggttgcacttgcactgtgatttttactacattttatttgttcttttgtttaacaatgttttttttaaatgagtctttacgaaaattgatttcgccaatgctccttttttttctctatgccacgatcatcgact

SEQ ID NO: 101451 - DNA, 531 bp, Oryza sativa
tggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaa

SEQ ID NO: 101452 - DNA, 1074 bp, Oryza sativa
gtcccaaattataaagactatacttttttacacggtcttcaataacatacttttaccaatattttatttcattctataatcccaacaaatatgaaattagcaacttcaaaatatgaatctaccgatttaaattttcttaaaaaggggatgccctataatttgggacggagggagtactctgtccattccaaaatatacaacattgttgattttttatataattttttaccattcgtcttatttaaagaatttaatataaatacgtaaaattataagataacattatagtttcttttgataataagacatgtcaaaacaaaacaaaacaatgaaatttttatatatattttttataaaatgaactgtcaaatattatgttaaaagtggacggcgtcgtacattttgggacatagcgagtatcagtactactgtttgtgtgtgtacaattgtcaataatttaattgaaattaatctatatagttctctgttctgtcttctgtggcctaattacataatttacaaattaatcagtgcacaaaggacatcaacatgctacatgttcttgagccattttgtgaagacgtcgggagccccgggatccataacaatgaagcgacagatggaatgattaggctcatgctggagtctgcttctgctgctaatgatgacattattgaattcaagtgtagagttgagtgcataaaaacaatacaacattactgcatcccattgaattccaatttatctgttttcccattttccttggatagcacttgacctaagaaagtctaattttgcttatttactgcagaaagcttcttatgtggttttacaaatatgggcaaatgataaaactgtaagggagagtcttggtgtgcacaaggtatttctactatggtactacgtatacatatatttggatttccatccaccagtagcaaagtgcatatattttgtggttacagtaaatttgggtggctttccgcatgaaattaggccgattatcatattacaaattctgcattgtccttacaaaaggctagtcattctttgaatccttttatatcagaataa

SEQ ID NO: 101453 - DNA, 1714 bp, Oryza sativa
taattgatgattggcgaccatggtatgctgctggacaagttgccgggtaagaagtaaatatttccgttgacagtcaatttcaagagtgattataatttcagtggatatattgcactttctagtgtgagctactgcattttgtagcatgagatatgtttggagtaaattttggtgtattcagtgccttcataaaaatcatgtgatggaatcccaaattaacgtcaaaaattatgataaccccattaccaagcaaatatcatgcaaaacacgaatatttctagtattaatttggtgtctactggtacctccgaaacagaacacaatgccacaaattagacgattttggttagccgttaaggaaataccattgtttctacagttaacctaccatgaggtgcaaatatattagcactagaaataattatactccatcgcattataaatttgaacaagcttgatgaagtttgactcccaaaataacttacaatatgaaacaaagggagtatctttcaatagcttcttaacaatcgtaaaaattaataaatgtgaagattatcatacttataactaataagttctgacatatcatgaaggccagttgggaaagtggctgatgagtggaatatgtatttacagttattttttaatacaatagaatttattctgttctttattacaatgaagctacaaccaactattatagaattcaaaccggacgaattactgcgaattagaaaattatggtttgactaaaaacaagaaaactactaacaatatcacctcaaaagacgaaatttctctcccaacggctcacaagttgtagatagtccttgtcttcctcagaccacaaaagcatctttgaattagcgtccaatatttcactcccaacatcgctggcaatatatatatgcttttcctatatttggcgcatgttgatattgctatctcttattttatgcaacataaatattccaattcactacatccgagctgcttgggacatctgccgatatgcattgcggccattgcctatatcttcgcctaatatggttactttgttttatagattcacgagaagctatgcgaataataacctgatatatgcaactgtgaaggtgtgtttttcatacatgcaagttattagtatttttacatttttgtaatattgtacttattgagcttttgcaaaaaaaattgacaagttgctttttcaagattatctccatgtccaaaatatttacacttgtgactgctggtaataataagagatttataaccttcacttatgtgtacaccaatacttcagggtgctgggcacactgctccagagtataaacctaaggagtgtctcgagatgtttgctagatggatttcaggcaatactctctgatgtatattcctcaatcagatcaagtcaactatgaaaacatgagtaaatgataacatcagagatatgaagaaaaacatttgctgcatgtaatattttggaaaaccttaagaactctcactagtacatagatatctatgacggagaccagtggtccataaaaggggcattcatctgtgttgggccgaaaataatcccgttgaagattgggcttcacggccatgcccgtcaccgttgtcccctcatcggtgatgggattcagttgtggcccgacacaggtcatctatgatgggcttcacgcatgcaatccagcatacatgaagatat

SEQ ID NO: 101454 - DNA, 666 bp, Oryza sativa
  unsure (1)..(666): unsure at all n locations
gcacatcggctgctgtgtggggcccatcagatcatgcggggcgcccttgtcattcgttgtttaatcgttgaggacttccgggttcccgttcacatcaggaaaatggtacccgggtcagttcagagtggttggaccagctttgaccgggataagaggctatgaagcccttcatcattatgatgggacgggatggagcatgccgcacaccgcttgacacactgacaaggcgagggtacacaatcgttgtcccatcggtcattcgaccggtcagatgcgcagcatgccgcattaaatacggcatggggtggntgcatagnccgctttaaatgtggttaggtgggcgttaggtgtgcccacctaaccctttacacgtgggctgatacgtagagggggtcgggaaagctcgactccacgctcggacggggcagccgccgcttcaccctaggctcgacccccctcggggggagccacgtgggtttgtgggcggcctcctccctctagctgggagggggcagctgtcacaccccgaagttctcctccaagccaaatttaatttgtaaacaaccccaagaaaatgcaggtgcaaatcaagagaaaaccctaagaaagtaatgcaaataataatcggattgggcatgtggaatttttcttgagttctacatgtca

SEQ ID NO: 101455 - DNA, 1727 bp, Oryza sativa
ccactctgtattaagatatcaaaacaggcaaaatatattaaacaacaagtataatatactctaatgcaataagatcctaacataaagggcagatttagcataacaatcaaacatataaggtaaaatagctaaatcagataagatcggctgaaactccgatgctatctccttcaataattataaaacaagctagatattataattatagatcggatgcagcattaagcataaagataaatataagatctagacaaggtgatcaaaacctctaagagatggtagatatgctatataatctagattaatgatcttcgaatccaattctttgtcgaatccacttcgattcaaatgccgaacctggttcataacttaccaaatttggtcgttaacaattagatgaaccatactgtcaaactcgtgacataataatatgaccttgataggtgccaacaatccttgaaatacaagatttgctaacttctcatcacttaggctcaaactaagataaaatgagtttaaataactgttatctatgatcattgaactacaaaaacgacttttctgtacgaagacccctataggttacacatggatcttaattggtcacatctgcaaaaattcgatctctattttcgcatacggctctttaagagacactaataccaaaatctatttttgcaagtgggcctcttaatgggccacatgccaaaatgaatctattttcgccggcctcttaagtgatccctgtgcgaaaatacccctctccttcacatattttttttctcccctcctttctcttttccctctaggccacttcattttttttcacctcccatcctctctctcttccactgctctcacctcttctctctttgtttctcctctctctctccctctcctctcctctcctctgctccaagcagccaggagtaggtggcggctcgggaccactaacgacgattggcagatcatatcctatgataaatctattatataattaaagcaatagaaaaatgtgtctccacgttcgctctcatggcctagaaattctcacattaatcggagaaaaagaaaaggcagagtccatatagaaatacaatttagaaatagctgaaattcgaaattaaaaaataagaaatattagaagagtagactagagttcatatagaaatacaatttagaaatagtttgaaattcggaattaaaaaataagcaatattagaagaggagactagagtccatatagaaaatacaattaggaaataactgaaattcggaattaaaaaataaggaatattagaagaggagactagagtccatatagaaatacaattaggaaataactgaaattcgtaattaaaaataaggaatattagaagtagagtatagagtccatatagaaatacaattaggaaataactgaaatttggaattgaaaaaaaggaatattataagtagagtatagagtccatatagaaatacaattaagaaaaaaaatagaaattcggaattaaaaaataaggaatattaaaagtagagtatagagtctatataggaatttaaaactaactaaaatttagaataaacataataaaattaaaagtagagtttagagtacgtataaaaatacaatttacaaataactaaaatttgaaattaagaaaaacatgggaagaagagtttaaggtcaatataggaatacaatttagaagtaactgaaattcgaa

SEQ ID NO: 101456 - DNA, 2743 bp, Oryza sativa
aatattgtttttcataattaacatgatgcataccaacaaaaataatttatgaaaaaaatattgtaactgctagtatgcatttatctggcatgtgtagcgtcctccaaccggatgggagtagaaaggcaataatgaaaagagtgttaaaaattcttaagaatataataactgtatgatgcatcattactgatttacttactatatacacataatatcaaacttaatattgtatttggaaactcttttatatggtacgacacaataagcaagaaaacttgaaaatggccatatagtcagctacaatgggcaaataaagaatttactcattttaattcagagcttcttagattacaggattaacttaattcacaggttggtctgtatagcttgagagaaattgttgcacatatatataggtttggaaactagaattgcaaaatctaaattttgtctacaagcgccaaatctagaatagcaaattctgcaaacaaacccaattaaggtgaacaaaggataaattttcattggaagaaagtctaacaataaattttaatggacatggcagtaaagcacgagctacatgcaaaaacaacttgtctcaagcagtcgatatagcgctgctataaagcctctatttccacagatggttgcatgtagctggccgcgtgtgaatgcctttttcgtaggtgtacacctgtgatagaccttttgcacatgccttcttatattgttatgttgtgccttgtgcgggtattgtgtttgctatcgaaggaaagtaacatgactttctcactggaaaattcagcatttgaatagaattatacattggggataatttgacacgaaggactactatgtctgatgtatacacgaacttttgttcccctagagaacataaatcacacttttattttattataaaacttttttttctttttatgatgtttatatttatgaaaaagtcaagtttactccctcggactatttcgtgaaagtagtaaacaccctaaactatctgcagctcatttcacactcctaacgagtgaaattagttcagtttacttcgtaacgatatttctcttttttccctcttctctctacataccgaaatagatgcagtacagcttatgtcttaacattttttttatacttttctatcactgtttacatatgttggaaccacctaatactgaactaaacacagagattttaaagatcacgcaaacattcatgaaaagattttgaaaataattttaacttttgataatggtttcatatgcagcttataacttttcagattaaaatacatcttgtataaagaggaaccaaaacataaattaatcttattaagaagtaaagtgaaacattttcaattgtattaaagtgaggcaaaaaatagtttagatgattaagtgatccattgaagtagattaggggagtaaattggacaattttcattatttgttacatctatataaaatttgcagcatttcaaacagtaccagaatatttttgttgcagaattcgctacctcctattagctgctagttactaaatggtaaatgtggtacctcctgatacatccaatagggtgaaatctatctatctatacctatactaatcgggcactttttagaagctctcacgttaatcagaaagatctaaccgttgatttgatggattgtaagatcataaccgtagattaattaatataacaaccgtggattattaatcgtagtttaggccaccacctaatctatcttgatgtcgaaccaatatctaacatgatctcaggtgatgtagttagcaccttggcctagcttgcatatagctgacggctgcaccagttagttatacaattaatcaattgattgccacgccgtaccatcaatctagcgtttgtatttttagggctgtggcaacagcaatattgacgctacctaccacgccgtagtcatccgagaacatacggaacttcagcgagcaatccaatgacgacatcgattcccatcggcaaaggcaacagcatgcgtgtgaacggatcgagtctgatggccggcgacagcgattgcagaagccacgttttcttttttaggtaaagatcagtcgaatcccatctagcttgagcaatccagctaaaccgtgtgattgtgtgtatatgcatgtatctaggcaacggaccgagagtcatcggagatataagtagcagttaacaagctatcaagcaaatttgatcaaatcatactcatgcatatgatgcatgccgcgaagaacagggattaaactcacgtatttgacaatgccaatttgattcaaaactgagatttaacgagagattatatcttcagtacacatgatttgatggatgcagggagtttgtacaccaatttgcagagataagaaggaaaggctggtatcagattaattccatggagcaaatcaacgactgaagaaagaaagggaaatagcagcttagtgtatatcgatctcccaagaaagcagatgggcaaaagcaatggccggccacaactcgatatgggaatgactgaagaaagggaaatagcatgctttcaggtttgcactgaacttgattgttattatttgttaaatttttgtgcaaaataaatacatttagaaatatgtagtcaaattatataaaaattaattagatgccgataaatgtctttcctaagtacacaatatagttaaatcatgcgtattgcgtgctataatatatgatgca

SEQ ID NO: 101457 - DNA, 676 bp, Oryza sativa
aatccaagaggtctaatgtcctgatgcagccttgaacgacgccgacgtagacgatacaattgcctggaccggcggaacattggacttatcccttcgccggagatcgaacaccgatgcagctccacgtcatgtgccaagtcccgccggacgataaaacaaagtacaaacgtaaagtggcaatgcgccgaattgtattgatcatgaagatagattacatagaccccgggtgtacatatttatacccatgagttgatacaagtccttgtcggacaagaaaaaaacttttctaaagataaaaggaaactaacaaactattcctaattaatagataacttgccatgccgcattctctttgaactggtctcttttggataagcttactttagtagatcaatttccttaaccgaatatagcatgaatccaacaactgacgacttggcaactctcatcggctaatctcaggacttcaaagccgatgctgactctaagccgatgactactccgagcttaccaaatttcaccattaacacatccccccctagttctggagtacgagaattcatgcttcaaaatttcttgtcttgataactccaaaaccaatcttcctttgcttcttgtaatcggctgtcatgagccgatactgatgtgctccaccatgttgaaactgatgcgcttg

SEQ ID NO: 101458 - DNA, 695 bp, Oryza sativa
gaaggtagatgaaagtagctagtttctattttcttgggttgcacttaaaaattataaatagattgctcacagaaaataggagaagatgggctcgataggacattgtttgaatttagaagacctaaactgagaggataaattctggaaaaattatatttattcatgattttcccctatacacttccatgcagttaaatgcacattttagttatgtatggttttagctgattaagaattatatttagtctattatttgacaagtttgacttgtttatttaaggtatcaaatttagttattaaattgtaccaaaattacagtgagttgtatatattaagtagagcttacataaattttcccatcattttatcttgcacgaattattttagataattagcgatgcttatctcttttatgtgtttcccttttcctaaatgcatgtaaatgcttataaaagttttatttggactcttcttaacctgaggtgatgttgatatggtagaattacagtttaccttacataggtcgtaagctccttacctataagcataagtttactttaatattaaattaagaggatgcttatagagatgattaagatagaatataccctatatgagttaatttatttgttcactttcatgttcatgacatgtcttcagatggatgaccaaattagttttgtgaggcttgacat

SEQ ID NO: 101459 - DNA, 745 bp, Oryza sativa
agagatagttttcccgctaggcgccacgacggaacgggcctacaatgtggtagggaaaaatcaagaaacatgcacactttagctccttctgggccccatacataagaaacgatagctttattacctcaaattcgtacaacatgcatgcaaactcaattttcatgcttaaatgcaataatattacaagtaaacgaagggtctatgattacgtgatgatcaatttgaaaattttaatttgtgttaaacgatgatccatataaaacgaatggagtattttatactagttggtccattatgcggcaaagccgcgtctattttctagtgttgacctatcttcaggggagtcctagagaagcgtcagaattgtcggtgctctctcctcgcttgtactccgcggatgcttcttttaataaagtaagtgttcgggattttcttttttatttaatttactacttaagtgagatatatattcctatcgttgcgtgtttgtcgcttagtatttatgttgagtgctttagtactaggactttgtaggaaaaaggaagttcctatacgaggctagagtaatcaataacttaggtgtgttgtctaggttagcgattacctttgtttgttgtgtgctctctgaaaagtgaggtaggtagtaggtgatgatagcgctgttcatcctttgtatccctccatatttggacacatcatagagctacatgccggactcagcttggtagactggggggagtcggtg

SEQ ID NO: 101460 - DNA, 998 bp, Oryza sativa
atccgaattctttttgctatttgaaatattggaactttgaaatttgataagaccatttataacactaactaaatacccatgcgttgcaatggaatttaagaaggatgtttttattctaacaagaaaggtagcccacgcgaatgagtgggcatgtatcgtaagttgtatttgagaaacttattgaagcggaatttaactgagtaacatttgcatgccatgcttcaaaagaactatttgtttcataaattttctttttggcattgcttagataatttttcaaacctattagagttgttccaattatctaaggtaattattatgcaatggttattgcaatacaataattgtcaggcttagataatttttcaaacctattagagttgttccaattatctaaagtaattattatgcagtggttattgcaatacaataaatgtcagtaaagtagagctcatacaataaattcatgtttctatattgttctatgctgatacaattagtatggtgttcaactgatcatgtttatatattcaacatgttgtctatatgaaatttaggcaagatggggtacacattatgacgtaaaaaaatgatatcatttaaagattttttctttaatttattagtgtcttcatagatcatatatatactttagatgctatgatcattttaagattatttatttatctccaaaaagatcatttattgataaatgcatgaagatcaaattgtataggtaaatagcccccatatacatgttgagagaaattaattaacttgacaggaagtcgttatatgtctatcaggatatataagtataggtctaccagctttattaaaaaataggatttttttaaaaaaatataataacaacctgttgacgaaaaaatcgaacacaccggcctgggagatctgcttggctccaatgcaggtccaaaggttgttgagatgcgggcgagccagtcagtttgatcctgcaactgacaagatatgcaaat

SEQ ID NO: 101461 - DNA, 638 bp, Oryza sativa
caaataagacaggcaattaaagttgggcacggaaacttatggttacgcttattttgggacggaggtagtattatctgccagagaaaggatcgataatgatgtatgtgggtttttttttcacatcaatcaagtaatttatggatgataatgatgtatgtggatttatttttttaattttcacatcaatcagtaatttatggatgactactgactctttcatcgcaattgtttggtagtccattgtcccatatcagtttgtaagctagtaacgccaagcactctgtgctagtgcttaatgctagcatcttccaatcgacagaccaatctcagaaaggtccaaatgaatgcaacctggttcattatttctgcaaatgtaatgttttgaacacaaagtaacaacctaactaaattccacctcactgctgtttaatttttaacacacatatatatccatcatttttataatatttaacatatacttatctatgtgcgggatatattaatatttcatctacaatctcatacatagtctactaactatatgtctcttttaacatagtttgacaaaccaattttatttaattcaatttggtgttaataactaatatattttttatttttagcttgattattaaaaa

SEQ ID NO: 101462 - DNA, 752 bp, Oryza sativa
ctaataaattccagcaagctagtccttaagtcctaaccatatgggcatcaaagtaggcattaatcatgtataaataggcacctcattggcttccatggcagccaggagatcattctcaaatctcatcataatttgaggtaaattttagcatttagaagaataaacacaagcctatactcaatacatatccacacgccgctcatgaccgtgagcacggctaattgattagtttttactctgcagagtttgtacactttacccacatgatgcaaaataataatcatacaagagcatggcacgcgatacataagtacccaatttattacccacaacaaagcttttccaaaatttatgatttagccttacaccagcacgatacgtgttactccatcctaagccatacacgttatatgacctagaaccgttaagtttaagtggtgggcccacgccttaaacttaacgccatggtggcgaacacaacgggaccccacccacgtggcacaataccattgtattagatagagttagtcacctaaactaccacgtcgaggtaaataggaagttcctctgagttatccgaactcatacacaccggcctaccagaatgtaaggctgaaccataaataatttactaagcttgggctatcccatactagcacatgtggttgtactgtatacgaaatgaactgactcaacgaaatgaactgacattgagtgaaagtccttaggtcggtttgggcgcactctccccc

SEQ ID NO: 101463 - DNA, 789 bp, Oryza sativa
caagcaactagtactcgttgtacaacaaatttcaaacagcgcgtgaactctgaaaaaaatacattaagcggtagcgttaattcacgtgttgcgcgcggaatattagttcgagcgccgcacaacgcactctccttccgattttcctcttttttaccaccccacctttactccgcatcccaccttttctcagttcgcgcgttttttcatttttttaccaccccgcctttcgtgttttttttctctttaacatctcttatccatgcttcatcataggacccaataaaatattaaccatccagattttttttccttctctctaggttttttgttttcacgttttagtaaaatatttaccatttagtttttcattttcagtttttctagtgtatccccacgtttcaaaaataacgaatttattgtgttgagttttccatttattcctagagtaacaaatttactcgaatgaataccctcttctaaagtaacaaatttacttgcacgaatacccccatataatacgtgcaccattcctaaatgattataaaagaattactaccagcttataacgctagttattcatttaccagtgttataaatattatttaaactagcatggtggcccgcgcagattacgcggctagcatcattatattttctctcatataatagcatatatgttttctcattatattatttaaatatattaaaatgacagcataattttaaattttgcaataactttacaaaactactcatgtgtaatatccatattgtattttatatacgtgt

SEQ ID NO: 101464 - DNA, 2058 bp, Oryza sativa
  unsure (1)..(2058): unsure at all n locations
ttaggctccgggggtgggggggcggcaccatatactaagttttatgcggagtcatgtctcatatacagaaggtattccggataaggaagaagaggcagagttctatatgaaaactacaaggactactcatatcatatccatacttgtctctctcgttctacttagacaaagagatatctgtgaatataaatacaagaccccctaggagaaaaggggacacagtcagtcataatagacaccaatacccattgccaaacattaacatcaaaagataagcctaaacatacccaatctaatattacaaaggccgacaagagggatctagcgttatctctaatctcgccaagttcatattcagaaggaagactaccccatcatcgactacgcgtgggttccataccgccaagtggacgatgactagataggttatcctaaattgtacttgtgtgatcctgatgaataagaggaacaccggcttcggccaacaggagtagagccattaccttacaaataaggggcccgaacttatataaaaatccctattcccatcttttttacctcaatctcacgcataccccggtaccaacaatcctcatactctgcaaataccgtagtcgtcatctacttagtcaacagaaatacataaatttcttagaaattttcaaattgatttggtgctcacccaaggaatattgcatatctgcaacaaaaagggtgaactttagcgtgtttcaaactttcaatcacaatattttagctgtttataactcaccaaagcaatcactatattttagttgattatagtgaacaataatcccgtatactatttaggaactaaccaagagataattctcacaagataaatctgaattactcaggaagaatattatactgaaatcagagtataaacagaataaaagaactgagagaagattaccgacaactccggaattcttccgacttcttctactctactctcttcctattctattacacaatatagtataatagagcctcttataattcagctcaagcttggaagtgtgtgtagtgagggagtgaggtccatttatagggcagttatgacggttgtgagaaggggaaatgtccgaactaccccgcaaccgtcatcagggagtgatctggagcgtccatgccaaaacctgngatcaacggcgatcaccagtgttcggacgaactgtcacgcccggaatttctatccaaaattccaaacgcttacatgtgcgtgaaccctcgtccaggaatcagccgaggcacacaataacaaattgataatagagtaccattattactctaattaaataagcgaataaaatgtcattacagaggtagatagttcctctcaatcaatagagatctaagcagcggaaaaataagataaacggcgcagacgactccactccacaggcagcttgaccagggctacacctaatcctccacaccatcagcatcattgtagaactctttctctgatgaatgattgcaagggggagttttttgacctacctcagccaagccaccccaacaaaatatgccaggtgcacaaggataacaaaaggatggccatagtaggggtttcattttgcataaaccagcatttaataaaacatttcagaatttaataaaacagttaagtaatagacaatattaatccaacgctatacaacataccctgttgtataggccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggatattcgaatagttttactctgatcaggagtgtaccactgtacccacaagacacagccccacatcatgtcaccatgtgctcaatacctccacggtacctcggaaaggagctgttacattacccctcgtacaacacaacccactacagtgcacctttcctggatcataatcaccccct

SEQ ID NO: 101465 - DNA, 611 bp, Oryza sativa
aagatttggcagataaaagttcctatgaagatcaggatcttcctttggcttttgttgaaagatagtgttctaaccaaagacaatttaaagaaaaggggttggaaaaaaggaaatgaaacatgtcagttctgtgataaaaaatagtcaattcaacacttatttttttattgccccatgacaaggcttacttggaatgtggtggcatgtacttttggtttgcaacctgtgaaaaacattcaatatgctttgggttgggggtttggatccagaaatgggataaagtaacaaaatacttaatgttggtggggatagcagctgtgcggtggtctgtttggaagacaagaaataaagcttgtttgagcggttgttgccataggaccccactgaaattttatatcaagcgtgctcatggatgcatgattgggttattctgcagagacaggtgggaaatcaagaaaagctgcgatggggaatccaattgctaaagcaggtcacaaatgaagtgttcaattcaagacatggatggcgcgcccttcagaaagattacaagcagctgagcggattagaagagaggagagaaatatccaagttttgaacaaggacacatttgt

SEQ ID NO: 101466 - DNA, 786 bp, Oryza sativa
atataaatatataaattagtttatctatacatgtaggggactccatgtaagtttttgccctcggccttaaaccccaggaccggtcctgttcaccggcgccatattctccgcgcgcgatccgagttcatggcggcctcggcgtgtgcaaacagaggatcctttggagctagctgggccctgctggtagctttagcgtgcgatttctggagagaaatagatggattggttggactagttggtgtggtgtgtggacagtgtggtgtactgttcttgtgggacaaaagaagcagaaagaagagcaaaaatgttatcgcttgatactttgatgactcgtctagggtgaggtgagtgtcggtaattacagtgccttctacaaacaatattatccttttggatttggaggattctgaaggtcaaggtgctggtgcttgagacgtcagctccatccgaactgggataaaggcccttcaaactttcaacttttccattacatcgaacttctacacacgtaaacttctaacttttccatcacatcattccaatttcttcaaacttccaatttagagcgtggaactaaacacattctcaagggtatatccgcttgtttttgcatgtcacttaaaaaatcatcaaaagatttaaaaaagatttatatgatagatcaatatgtgatagtgtcactttatagattggcatattcaaattccacttatacaagtagaagcgaaaataataaatctgactatgaaaagaccgagtaattcacaatcaattttttaagtgtat

SEQ ID NO: 101467 - DNA, 932 bp, Oryza sativa
  unsure (1)..(932): unsure at all n locations
ccgtagtgtgggggatttggtgatataagcgttgtttcttttgtgatttatatattggctgcggaactgtgggtctgtggctgctatgccttgcgtcattgcttacgcgagggccatttgtttgttctttccacgcaggcacgtgcacctctggttctatggaagtgtgaattcaccattcttgagagctacaggggagctacttttttccaaagaaaaaaaatggtatatctcggcatctttttaaggcctataaattttctctcatcagtggtagttgcaaagtttgaatgttatatttacgtgtttctccttacatttttatacattttaactgaagttgacagaagcctagctaacggtaataacataaaggaagaaaaatagttgtgtgatgcaactcacgtaatctatggcaattcttaggatcaatcgttggtcattggcaaaagatagaatatctgtgagaatgttattgtttcattacatatttgaccgttttgactgatttaattagtaccaaaatatgaaacanaattatgaaaaaatatttcatagaaagctatttcatagaatgtgagaaactctgtagaaatttatttgagcataagtgatttgtcatttttaattatatgcatgcaaatacaatgcataaaaaaaaaccaagaataagccacagataatctgtcaaggttatggataccatataccctatagtagttgactaaatcttggcagaacccaccacataccatgtcttatacggatactgacctctgatatgganggagttccggatagaagaaagacacccataactctgcatggaaacgacaatgactactcggattgtatccatattggtttccctagttctacttagacaagggaacacctatgggtataaatacaagaccccataggaggagagg

SEQ ID NO: 101468 - DNA, 573 bp, Oryza sativa
attgctacatagatgtcctcacatagcaagaagctcctaacctgcttggtatgtcttctattgagctcacccatgctattcatgttttctgtgtctttttgatacaagctattttggtggaaaccaagatggaagggttagctactactgtacaactgttttgaaagacactgactttgagttgattctatgtcagcagcacccccattcaattccctgctaatcccttcaaaacattcagaggactgctgaaaattgcgcacgcaattgaattgataagacttgaagatcctcaagttattcttcagccattattatgttatgatgctttttttgccgcataagtatgatgaaatgagaatcttatagaggcgacctccttgctcccggtttcttggatgattggggaggcgatccatggagtcctctgagtgcatccatggtgacgcccccacccccagggggttgggaattctcctctggtgaccgttttcgtgatgaaatcttctccacgttctctttcccggtgcacttttctcggttttttctctcggcggccttttcgtcttgtgg

SEQ ID NO: 101469 - DNA, 574 bp, Oryza sativa
tgatcagcagaaagtgctgtggcccctatggacaggagtgaaaacggccagaaataaccggaaacgatatttttctatgactttacataaacggttgaaaacagttgagaaatttttatatttatggatattatttagtgtcaacttcaatacatagaaattagaaaaattaaattttggataccgtaatatcggtaaaaatattattattatattagttttatggagtggtacgttcggaaatttccaaaccgatttttgtcggggaaaaagtaaatagagagagcatagggctcatcgatgagctctgctgtattaggcccatgagaaagcccattcaacacacaccgcaggagcaacagcgcatggcaggcaccatcctaggcccagctaatctctcgtcatcttttctggggtggaataagttaatctcaggtcctttaactgggcaacaaatccgattttagtccttcacccggaaaaccagatccaccggtcccttcactatcaaacccgagaaaatataggcccaatggaagttgggataaccgtttaacctgactgggcccctact

SEQ ID NO: 101470 - DNA, 647 bp, Oryza sativa
ttaatccaaactgagcaccaattgggaatggttatttttaattctcaaaaaaactaattttcaaaaaattgattgagattacattccaatgcattaataaataagttataatttttggtaattttcaactttaagatttatcacatcatcaaataaccaataatccaatatctaaactatgtaatttttatataaattaatttcgtattttaaattattgaataattccaacttttagaattatcacatattccgaaagctataaattagaattcgagcacaactctatattttttaattctgaattatttaaattattaaacaacaaaaactgtaattgagagtccaactgaatacaacgatgtatttattaattctgaatttgaaaacgtaacaatggatttgagagaggactttatatgagtttaccttttttatactagcaatttcatgctatttttatctcacctggttaacattgacgctcctatgaagccactaaatgggtgacctatggagtgacatcatcgaaatcttattatctaaagctggcggttatcgccgcaagctgattggttcgttttacccctatttagttttacgccacgtctccatgaagcattcggcaaacgatcgcgtgtctcgcg

SEQ ID NO: 101471 - DNA, 522 bp, Oryza sativa
aaaagtgatttttttaatataagaaacattcttttcggttatggtaaagtattaaagtctacaatatatttcacaacatagatttttgttattatgaggtaaaatatacaatttcttatacgcgtatggtgagatatgacttaattctcgtacttatttatataaacataataaataagatgcctgcgcattcgcgtggactaacttcctaattcctataaacctgatcaaactaaaataaatttatatagaaaataatctaaacgatttataatatgaaacataggaactagacgtatagagctcaatctcccgtttcttgtatctatgctctccgatccttgagcgttaaactagcgttaaatttcgatgagaactcgtccttctctaccgtgccaagaacggataccaatagtaccagtacaacacctgataggaaatttcccagcaccatgtcaagcacgtgctaaccccgctgctagtatttcgccagggaatttccgcgttataaataaaaacgga

SEQ ID NO: 101472 - DNA, 668 bp, Oryza sativa
gggaaaaaatcacatgataaattatccagcgcgccaatgggcacgccaataggcgcgccgattttctaatgaatactactactgtccttcagttgggcacaagaaaaagtttacttctcgttttcgctatcaacggtgtgtttcatattcttctcattttcgctatcaacggtgtgtttcataaattgtgtactgtttgcaggccaggaaggacctcgtaccacgtgcagtacagtcatactcctaaggccttgtttagttcctaaaaactttttccaaaaacataatatcgaatctttgggcatatatatgaagcattaaatatatatattagattatgctaaaaacttgaaaaaaatactttgcatttttgaacaactttcaggactgaaaatcaattttaataaaagtgaggttatttgtttgggagaagcaaaaaaacaaagaggagtacagtaagatcttcactttcaatataggtaatttgcctataaagtatttgggtataccgattaataaaaaatgaatcatgaataaagactggaaacagactgaggagaaaatggaaaaaagggtaggatgttggcagggaatttgcaatatataggaggaagagtaactttgataaactcttgttgagcagaacacctctatacatggtggctttt

SEQ ID NO: 101473 - DNA, 766 bp, Oryza sativa
ccggttcttatctaccctattttcccaccaaaatgactgtagcaccatggtacatggagtaaaagtgtttgcattgtccactatggtgaaatcctttcatgccattatttttttcttttaacaaacgatatacggcattattggttaccagcatggcaatcttaccctggcaaataggttcatatttgaaaatatgtttatagagcatttatttttaaaattatagtctgtttgtcctaaaaatttatgccgtgaatttatttgtaacgccccgattttagaattttagaattaaaattccaataagtttatcagtatacaattgtttgtagatgctcttattaatttgtgatttctagaataaactgtatgtttggatgcacttgttgctgacaagtgggagaaattttattaggatcaatgacagctagcagtggacgtggtacaaacgtcccagcgggccgcgagcaggacacacatctatgaaacgcactgttgatagtaaagagtaaattacgtctacagtacacaaacttggtaagtgggtgcgatctagtgcaagaatttaaaaaatgattatatagatgtaacaacttggttagtacgtgcattttggttaaaatatctctcttccacaccatactttttcagctatgtaaagaaaaagcagacagttaggtcatcttgagttccgaataaagttttagatgtattgcatttgcttggttataatactaaaataacctattatttaaaattagaaaaa

SEQ ID NO: 101474 - DNA, 581 bp, Oryza sativa
cgcccgaatagcgtgggacgggtgggaacttgactgggatgggattggacggatcttgattctcccgctcaatggtagcctcttttcaccaccccccttgttcgcggcaccttgctgcggctatggcgtggcgaagggcgaagtcatggcttgcgcgtgaggttgggccacagtgttcggcggcccgtctccgaacggggacgcttggtgcgccgccatggatgggtcgaacgacggctgggtccatgccatggcgacctggtttggcgcttggtttgctccgaagcctgatgtcggttcctgtggtcgaatggttggtgcttgagcagtgttgatgaagtcgaactgcggtccttgactccaaggcgaaaccctcgaaccaggctggctcgacggcaaccaactgggtgcactttggccggccaggtggtggcgggtgtacttggatagtgaccggctgagcctgcggctgcacataaggggtcgggtgtattgttgcggcgaaggctgcccggcgaagtacactggcgctggcatggcttgtgccggaaggggctgaattaatgcttgtgggtggactt

SEQ ID NO: 101475 - DNA, 514 bp, Oryza sativa
aagcccaactgcccaagtagtcatcttcaagtcttcgttgaaattgtaaaaatcactcgacaattttcgtgcaaagagggaaaaaatgtcagtggcgtgcatggaggagggaaaaaaagagggaaaattttgggacaaatttatatgcaatttatataagatcaatgtgtgttttgattcttattctgtgatgaacaattggcatttgtgattattggttttgatatttgaagattatcgtcgaagtggttttgtagataatcaattttcaggtgatgatcggattcactgttattttatgtggaccggtccgaccgggcggaggttgccggtcagaccggtgctatgtgtgcggtcagaccggccaggcccgcggtctgaccggccgacgctgtgtcggtttcggtttcgggttgtttctttggatatccgtgattatttcatggttatggcttctagatggatactatacgtatgtaatactgatgtttgctaacaatcagtcaagttgggg

SEQ ID NO: 101476 - DNA, 510 bp, Oryza sativa
tgttattcatatattaatttaaagcagccaaacattggattcatcgacataagttggaagtcaaatatatgcgcccaaattcccaattccaatgaaccaaagtgatgacccacttattcccattttatctctcctcacagtggcagagctagaaaaatttttgagcctgagccagcttcacttctagtaattgttatataaatttctcctcaattcattcaatcacatataaatttaatggagtttttgtcggtgagcatgcgcacccgcttggctggctccgcccttgcctccgtatgtcatataaaaattgagaaaatccattttttaataacacaattcgaatgcatctgtctaaatgctgtgcaattcaaatgtattctgggagtatttttttcttctataagaaaataatgtattaagttttaatgcaggtgtatactatggtgcagttcaaatgaattttggtagtagcatttttttatggtgagaaataatgcattacatttt

SEQ ID NO: 101477 - DNA, 602 bp, Oryza sativa
  unsure (1)..(602): unsure at all n locations
ttcctgcagccactcccggttatttcacccgggactaaagatagcgatctttagtcccggattggtactcccggtttggaaaccgggactaaagggggttacgaaccgggactacaaagggttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctacctcaaaaattaanctaaaagagtgtaattaatttgtctgtcaaaacatttcattctcacatggttccatcaggctctttcaacatcacatcatttttttcgtttttcgatcttgtcagaccatgtaaaccagtnaggtattatttgtaacacctagtttttttttcagtctttttgtttcaaatggtgaatgtg

SEQ ID NO: 101478 - DNA, 544 bp, Oryza sativa
ccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatgtataggggtgggactttagtccc

SEQ ID NO: 101479 - DNA, 739 bp, Oryza sativa
caaataattcatcctaataatccgttgaataatctgaaaaaaaaagttcacatgtttgatagagagcatgactcgatttggtttccatgagagcaaatggggtattgcttggaagattttatccgtagttaaagaggataagtggggagctagtaggtatatataggaatgaaaacggttcggatagtttatgaccatccagatgtacttttataacgaatggtgtcggacaaataatttattggaaatgaaaacgaatttagaaatttttttcaaaaatagaaacgagtacattaagtcaagtgtctgtagggaaaaaaagggcaacccatatttccaccaactttaggcccatatctctaccttaactcatttgtcacatattttaagtttcgaaatatgttgtatttgatactattattgatattattgatactgttatttcagtgacaaaacttacattccaattctgaaaactttcaattcaagtataaaaaatttcatctcaaaatcacaaaacctccaactgatgatttgaaactttcatctcaaatcacaaatatttcaattcaaaaaccgaaaagtttcatctcaagacccccaaaacttttaataccaaacatcaactagatattcaaatccatcttcttctttgacttcaacaattgttaccttattgctcatcccaattctgaaaactttcaattcaagtataaaaaatttcgtctcaagtatcaaa

SEQ ID NO: 101480 - DNA, 4573 bp, Oryza sativa
cgagaatggtgaagctttattatgacactgggtgattatattttgccaagtttgtctgctttgcgcgattcttgacttgtattttttccttccccttttccctattgctttagcgggggtttcgccgaaagtcatgcgttcagcccccttttgaggattggcgaaaagatttgttgacttttcagctttcgacttccgtttttgactcgtagcattttgcgctaggaaaaacgcttgtgttttgcgtaagtcaaatgtaacggcgttcggtatctttattccaacgttcgtgatttcaacgttcggcgagcgatgccttggccgattcgttttcgcctttttatggcgaagctgtagctccttttcttctttttttttaaagtatgtgctttcgcctgatggagcttatgtgtgtttcaaatttctttttgctaatgttcgcatagtcactttcgtgctttcgttaggtcgaaacatgtcggcccctttgcgtaatttagcgaaaagatttgtcgacttttcagccctcatcattcgctctcgacttttggcatacgcgtccagaaacgcttaagtatttgcataagtcgagtataacgacgatcggtatgttttccgaaaacgagctgtcgcggtttcaacgttcggcgagcagtgcttcggccggttcgtatcgcccccccggcgttttcgttgatcaaacgattgccttggggtttttccacgaaatatcatacacaaaaaaggcgaagacacctatgaatttttatatgtccgagcgccagtttgccattgcccagcatcgatacagcatagtccccgtttttccttcttcaccgcttaaaaatttttgttgatctaacaactagcgatgaagaagatgctcaaggggtagtccttcgccattaaggacagcttttgctgatgaatcggatctaaagtccgaatgtttttggcgggcaatggaattaatctgtaacttgtgcttttttggcaaataaatggggtgtggtgcgtgttacggctgttcggctcgtacttttcccttttttcctttggcaaaggtatttttaggtactttgatcgttttgaccgttgccggctttcggtctttttgcacttcgacctttttaaccgttaccggccttcggtccttttaggtacttcgacctttttaaccgttgctggctttcttcatttgcctgcagcgaagattacccttggcgaattagccctgagcccttggcgccgtacctcattggtactgtggcgaagggtgtgggtgtggcgaaaggtgtccagaggctaggttggcttcgcggcccctattttcgcctctggtcctaactcattttcacccctagcccttggcgccgtacctcattggtactatggcgaagggtgtgggtgtggcgaaaggtgcccagaggctaggttggctttgtagcccccccagcttagacttaagtcattttcgcccccatcccttgacgccataccttattggtattgtggcgaagggcctgggtgtggcgaaacctattcgcccccagcccttgacgccgtaccttattggtattgtggcgaagggtgtgggtgtggcgaaaggtctcttcccccacagcccttgacgccgtagcttattggtactatggcgaagggcgtgggtgggcaaaacctgtacgctcgcagcccttgacgccgtaccttattagtactatggcgaaaggcgtgggcgtgtggcgaaacctagtcgcccgcagcccttgacgccgtaccttattggtactatggcgaagggcgtgggtgggcgaaacctattcgcccgcagcccttgacaccgtgccttattggcactatggcgaagggcgtgggcgggcgaaacctatcacccgcagcccttgacgcggtgccttattggccctatggcgaagggcgtcggcgggcgaaaccggttcgcccgcagcccttgacgctgtgccttattggtactatggcgaagggcgtggcgtgcggcgaaacctcttcgcccgcagccttgacgccgtaccttattggtactgtggcgaagggtgtgggtgtggcgaaaggtgtccagaggctaggttggcttcgcggcctatggacccccgtttttataacaggaatcaagcatgtaaacggtactatttccctggatcaattagtctggtacacacgagttcggagctgaaataccaagtgcacatacacgagagtctagtgcgaattattacatcataggcccgcaggcatagtcttagaacataggaccgaacggtccggaatacatcccaaaagcaaaagtagataagacagcggagttaaggcagcggcacgccattgccacaggcaacgaccgtaactaagacctactgagcgccatcgtcttcatcaccctcttggtaataggcatagggatcctccgaagcttcatctccggcctctgattaagttatatattgcaagggtgagtaccaacagtactcagcaagccgccacagcaacaatgcacatgataggggtattcgaaggatggctatggttcttttacgtaaagcaagttttgtaattcttttcacaagcctaagacctaacatagactaatcaaattttagtactagtgttcacattaaacaacgacggttctgtccaccatccattgtgatcccaaggatagcttcccgccattgagtcgtcatggttttctgaggatgtccatcttcccgcctcttaggaagtggctccaacagcataaaatcatcatgcaatatcccatcctacacaagttaagaattttgagtctagccaagtgtaatacatgtcccggtgctcaataaccgcgagcacggctattcgaatagatttggtttactcacactgtagtgaatatacactttacccgcactccgcaactgcccaacacatgagcctcgtcctagcacatgagacgcgtcatggcaaagctttttgataacctcgcattggcagtacctgctccatgaactttacatcctcatgcactctaggcgtacacggtttctagcagtgagaggagttctggcgcacccgggagggaaagactcacacatgcattaagttataattatgtttagattctcacatggcagtcctaccgatggcgacaccactgtagacacccgcctcacggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccggggacggcactagccttttccggacaccacccaaattctccgtccgccccagtcgaaaacagttgtttaattttatttctcctttcacaaatcatgtcatcaacatcatggcaatgtggcgctcatgtctccacatgccgcatcccaattaccttcccaagggtaattgcccaagcatataacatttgataaatatgagtatgcatgattctaaaatagcatttctaagcaattgtcataattgactagagactcatacgtaaacatggttacgaaggcataagggtaaacaataatcaaggcatggcataatcacaagtagaatgttcatcattgcatgcaattttatttgtaaacaaaataatttcgcaattaggatcaacatgttcaaagaatagtgatgacttgccttgctcgtagtcctgcgggtcttgaccctcgctcggatccgcaactccctcgggttctaaaattacgtgcgaggaaatgatttgaattcaattggaattcaattaaaatctaaattactcaaaaagtcgaacgtgaatcgatctttctatattgactacaaagtttgcgaaaccactttattcgaattgttggatcttttaacctaagtcattttgtgatttagaagtacattcctaagaattcaacataattagttagctcttaataaatctaaactcctaccgcgaattgattacttatagagattaccaaaaataatctataattatattaaattttgcaattctacgactataattaatctataattaaattctaattattttaaattttctaaacctccttattctctctctaattttctatttattttcccttttcttttcctctccttttttttctctcttctttctttctctttttcctctctttcttttctttctttttcctctcttcttttctctctctctctccctcccggcttctttcttcctccctctctctctcggctcatgctccccggcggcgacggcggcagaacgagggaaggggcggcggcttaccgacggcggcggcgcaaggcgggcgacgcacggtgcggcactcggcgcggcgtggcggcttcgaggcgacggcacggcggcttcgaggtgacggcgcggcggcacgaaagcggcggtgcgtggagaaggaagggggatggagggggatgggtgtggagtggaaagggaaggggc

SEQ ID NO: 101481 - DNA, 775 bp, Oryza sativa
ccatccaaataccgtagtcgcgatctcgaatgtcaaacagttagaatgatataaacagacaggaactggattagaagtgaagaaacagatgcccttacgttttctaaacgaacaaagaaaaaaacgagctgatttcatggtttgggcatttaacttgtgactggtatattgcaatcaagcagttcctagcaaaacctcctgttgctaatcgctatagatagcccaagattgacaccgaaggtacaaaacagtgttgaccaacaatttcatgtcatttgcctgcttaattttcactccttccaccaaaaaagaccaaagcaatgtcaagagctgagcagttgctcattgtgcttccccatcaaatgacttctgcaaaaccaactgaataagcatgagctccaagagaggatccactagggtccggggcaaagcggtggagctagtctaacccactcatgcattctagtgcattttttcggagcacttcacccctttttgttgaatctggaccatttggttggtttccaactccatgtaaaatgaatctggaagccagagctataccaaacatgcccgtacattgagatgaaaggtgcaatgaaaaatagtagcattcattcattttgactgagatctctgcaggttagctctactatggacaatagttataaaaataggaagcagatcatttcgcttatgcttttccataagacgtatgaaccaccaaaaaaattagtgggtaaatcttttatatgtgtccttagtgattcaaaag

SEQ ID NO: 101482 - DNA, 691 bp, Oryza sativa
aaacataaatataatattagcaaacaaaataatgtatttcttttactacttattattttaatcttattatttaattctttgtgtttcatattattctaatataagctacgtgttgttaataaggtgtttaaatatatatatgatattcccttaaaaatgtgtctcaagtgaccaatagctagtccaaagtaatatttttgtacttgttaaatatagttaatttgagccttcaatatacgacaaaatctaatgtacatatgcggataaaaaataactataagattcagatcagatagttatgtttgtgtctaatacatcatagagagagggaaccgaatgggtggagggacaaatatatacatgtaagtacgtacgtatgtacatatggaagggagggacttggctcacgtgggcctttcaatttttttaataacaaaaataaatctaattggtccaccatgtttaaaggaaaatcaatggttgtgatatggacttgaattatttgttttcgttttccatctaatctaaatgagaaaaaaaagaaaaagaagtatggtaggatcatatgtacgtacaaacgtacatgctgtacaggtacacggaccgaaggatattttaagagagataattgatttgctaattttgtactaagatagatctaatggttgttgatttggcaattttgtaagat

SEQ ID NO: 101483 - DNA, 1378 bp, Oryza sativa
acaattgttcgtattcattcaattcaatgtcaaacatgaatacacccagctcagttcgaactaagattgagttgggatcgtctatgaacccgataactcttagcctaatcatgacatagttatactcatcgttatcacttttaatcgttggtgggagcgagggaatgatgttgctatccttcttctccttgggaccaaacttccgtgccagcattaatacaacctccatctcatcatcagagttggagtctgaatccgaataagaacttggtgaaatgattgatttggctgcatagcatcatgatggagagcagtaacttctatccaggtggcataaccatcttcataaatgtctttgatggagaaaaccttgatgattgggcccatcatgcctgcgtagccaagccgcccgtcttccatggggaagatgaggaagtctgggagatccaccggtgttctaagtagcgctagggtgttggtgtccaactcaaattcaatgatttaggtcctcccctctaccagctagtagatggcgtagtcgagcacagtggattgcttgaggtcacgaggtgacatatgtaaagtagacacggtatatagctcaaattatatttgatggtgttcacagatcgtatctaaaatcaagaggacatatatatactgatataatcggataggcattcttcaaagtctgacaccccttgcataataaggaccggccagcttccatgaatcgcgtagcacttagagcttcttactttgtaaaagtgcataatttgtaaagtgcaaatgcacacatattagttagagtaaagtgctgcttactttgtaattcaggtagcatccatcaacaacagcagataactttatatcatccagttcaaggaatttttaaagccagccagcttatttgcttagccaaatctcggttattcgcttcatcacacctctgcaaccattgccacctagcagaacatgtagaggattaatagcctgattaggttatttcaacttgcaaacatagatatatatcacctttatgttcacttaaaactcaaaattcatcataatcattattcctgtagaaaattatgaaatccattgagaaaggtttgttttgtgtgatttacattttcgtaggaaaatttagacagcacccattttatcttttatagtggaggaacacacattgtttcttttccccgctatactacagacaggtcgagcatcacgatcttgcgcaggtcccaggtggaagcaccatgggtgtagttgcgcagcgtccatagctggagggtgtacccggacacggcggtgaggccgacgctgccgttcttggggacgacgatgctcaggttgctcgtgaacgttgtcgaag

SEQ ID NO: 101484 - DNA, 681 bp, Oryza sativa
tgcatcgaattcctgcagcccgaatgatataattcaagaattattttacattttcgttttttgatggcattaaccacattaatcccagtttagttgctgaacaaagctttaaatcctgggaaatagcacacttttaatgttatttgggggtaactcccattttctttaatcatgtattaaagtccgacaagtcccatatattaacattagaatatagagtacctccttataccgattaaccaatagcttctgaatgcaatataatactcctaatatctctttatggatcaaaaaaatgctcaaactcaaacgacttgcttactctgacttcaaaattagatcaatgatgtgcctactctgacttggcaaaataattttgctcaaggtgatcatttgtttggaacaaataaaagatcaggtaagtgtttgtgctgtttgtgttggaccaaatcctaaatagttgaagatttggatagtatgaactgaaaatgttccttccccagatttcaattagattttatctgcaaactatgtttggagctgaaatcaagaatgtgcttttgacatgcaattggatggataagtgagcaactttcacatgtgatatgagaaatggaagagttacataaataatttgatcatcgcagtctatagggatcagaccataattttaaacggaac

SEQ ID NO: 101485 - DNA, 547 bp, Oryza sativa
tgaagaatctcttcactttggtataatatgtcatttgtgataatccttgcgagttcactttttgtccatgagaataatcaaacataatatttgcttgtactagccacaaacttgtttggaatgaatggcgttgtattgtggatacacaaggtcgtctgtgcatgggacagagaatattgtcactgttcttggtttccacttactggctagagcctctcttcatgtcatttatttggattttgaaagttggtgatttctcttgtattgcagttcatattggctcaatacatgtgttttcagttttatgctgtgctctgattgtaaatcatttctaactaaacatgtaaaatgcaattcctgcaatagctgtaagctgatagacatagttagcatggtggtgttcagtgttgataagatagcttaacaagcattggaattggatgtgctcattgctcaatacaggaaatgacagtattgtttgttggaatttgcttcaggttagaggtggagtagtgagcatattctactatcagtactagttattgtt

SEQ ID NO: 101486 - DNA, 608 bp, Oryza sativa
gttttggatctgacagtttacaatccgtcttctgaaaaaccaactatgtatatcacttgttctacttcaatattttaaacatgacttgtatttttttatatttgcaccaaaattttaaataagacggaaatatattatgttcaaaagtgaacaacgccgtaaactcaaaaataaagggcgtacaagtttatgtgttacgtaccgtggtgcaacttaatttaattattaatagtgcgtcatgaacgactaattaagaaaagatcaaaattaatcatatttttttcgtcagcgcagaactactgcacgttattgatttaagcaatccccttctttctattattggccactaaacacctaaaacttaatatataatattaagtatttattagtactcctaaaatttacatacaagcatgttacatcaacccattaagcaaacaaaactcaacatgccatcataccggaattatatttaccactaccatttattttggtttaaaacttaacatacccatgctaaatcatttttatatatttctattcaaattattttattacttttcgaatatttaacatatatttcgcaacacaacgttgggcattattcc

SEQ ID NO: 101487 - DNA, 1321 bp, Oryza sativa
ctatcgtatagaaactttttgcaaaaacacaccgtttagcagtttgaaaagtgtgcgcgtggaaaacaagggagagggttggggaaaaggggtgccgaacacagcctatatttatctcaaattttctatgtatactcatttatcttgtcaaattcacttgttgctttaggcaccctcatcatttttccttctatatatgacttgtttcagattgccgtatttgaaaattttcattgatcatttatcttgtttgttggttgttttattaaacatagtattgtcataatcattgtcagataaccaatcatcgggctaattatcaagaaacttaaagcaccctaccccacttcaatgaccaagatattcaagggcttaacatttgagcgggacatgtcattttactacctttgtcaaaagctcgcatatgccctgttatatcattgaggaagagaagtagactcaatggatctaaagtaccaacacaagcatgatcccatgaggcacgggatatatagagattaatgtctagatataatggataaagaaatggtggctctacccttagttcgcattcaaagattaccaaatatggttaattagatatataacattacaaattttttaattttgaaatttaccactactattcatttatttagaactatgctattggtatttgtctgaaattgtaatggtgccattgacatacatattttacatatatgtgacggaaataccctcatcttcaacctctctcctctcagtctcagactctcagttgcctcggtatagcaggagcagcaggagctctttctcactcactctctaattaatccttttgtgggttaattagatatatgctgccggtggagcttggcgtggtgcctctcaccagcatcgggggctagtctcgtcggcgtcgccaaggcgcggcagacaacgggcaggtaggaggaggcgatggtggcgttgcagtagacggcggcagtggtcgtccaccaccacgtcgccacggccatggccccgccagtggcgcgaggacgaatggaagacggcaggacgctggcgacacgaggatgagcagacgaagccggcgatacgaggtggacgagcggacgccagctcaagattcggcggagctcggagcggacgaggctccggccagctctcggtggattcggcgccccctctctcgctttatctggatctgggcgaagccacttggggcggagctcgggccaggatgcaccactgctcggctagacggcgtcggtggatctgtgacagggaggctcgggcgtagctgcgcacgaccggtggc

SEQ ID NO: 101488 - DNA, 792 bp, Oryza sativa
cttgggtgccccggttaaaaataagaaaggaattaggagtagcaaaaaaggaaaggtgaattgtctgacgggggcacaaacggccgcatttgcagcaggcagcgaggagattggaacgcgatccttgcggggtacggcggagtaaatgggggctttgaattggatgaccgcattcacatcgtgctagtagtagtacatgatagctagcccttgctcccatcaataggtaactgtgctatctacaggagccactgctgccaaagaagcttatcatcccttcactcccatcttctgaaaatgcctgtagcatgcaagaacgaccatatattagtgtgtgtgtgtgtgcgtgggtgggggggggggggtgttaacgttttggatactgttatttgcaagatcaagacgggatacagttttctacaggacgttgttgattaaagaaaatgaagaaattacggacgaaaaaagatgagtagtaagaccgccctcgcagtgatcgcaattaatttttggttctttaaatttgattaaatttattactgtaaaatttagtcaaaatttgttatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcat

SEQ ID NO: 101489 - DNA, 588 bp, Oryza sativa
ctctgtattttgctgtcagtaacaaacttctagcaaacaatttaagtgtgtttgccgcaggatgagcctcacgagggcctgagggctggagcaacacattcaaccaggtgtattttttgtacacatattgtctaggtctggacaaaagccaaatatcgcataatcctgcattttttattcagatgttcaatattcccataatcaatccaaatatgatggattatcgcctttctagctaatgtggtaaatattagtagtaatgtttgaaatctcgtatctcataggtttggttgctgagctaacatgaataatctgtttttggcttttcgatatagctggcaattcaagtttatcgttttcagttgagcattttgacaaatgagtgagttaatttccctgttttatttccacttggacagttcaagcacaaacataattaggtgaccattatcgatttactgaattttgctaccaaatttgctgagattttttttcgggcacttgaattagattgtagcatgcgtattatcattctgttctctgaactaagaaaaagtttgatagggagtccaaatgcacaatatattt

SEQ ID NO: 101490 - DNA, 575 bp, Oryza sativa
catgtcttgcatgtgcgttatcattccgtcaatgattaactgatgatgtcgctaatgatcgatagagcttggttgacctgaacaataccgtggggcactggaaagagtattgtcatgatatcggcccctgtcgcgggcatgaacacttgttgagaaaaccgtacaaacagcactaaaacagtgtgttttcatgggatatggcaccttagttttctcttctcctcttctccacgtcaagaaaaagctatacggcgaagcttaaaatgacacatttactgcttttttttcatgctctaattaatgaactgcttgcttggagtaatcatttagagcctagctgcctagatttatcaacttcacttttatggcgtacttctcaaaattgtcggcagtcggtgcagattttttttttttatcgacacagagtgtacttcccggtaaattggtcggcaccccattttcttcaactatctacatggcatttgacagaatacatatataaggctgagttcttttttcaactttcacaactcacatatctcgttttccacgcgctcgtttttcaaactactaaa

SEQ ID NO: 101491 - DNA, 536 bp, Oryza sativa
tcctgcagccctgcatggtacgtgcagagagccagagatgagttcttctatattttttttccttcttctagaattcattataaaaaatgtagtacttggtaactgtaaaatcaaacattcttctagaattcatctgactagatgaatatttgaatgggtagtgattagtaaattaatcttgtcctatgaatacatatttttctatgtatacattgctcttggtggttgatggatctcgtatatggtagtagtagctagaatatcactcatgcttggggtggaacatgaaaatttttgcgccccaattttgtttattgataattcgtcatgttctactagctagcagaatctagcacacgcaacatatagcctcctgccttatagccgaccttttgtccttttcttttacatgccttgaatttgtagagattgtacatctggcatgtgcagttagattactgatgcagttcactgaatttccaactctacatgctagatattaatttaacaaattcatcaatgaacaacctcattag

SEQ ID NO: 101492 - DNA, 1106 bp, Oryza sativa
tgattgtacaactgtcctaccagaactcatgcgagctgcagaggtagaaagacatgcatatggtgattttgtaataataagatggatgcgagatcaatgggacaagtgttctcgaaaaagatggagagccatgacaaataaactatagctagctagccaattaggaaagcaaagcaaagcaaattcctagaacacgacattattccatcacctagctagctaggttctgaataagtccatcacatatccgaccttcatgctaattaaataaattaatttgatacatagatagatatatgttctcactagctagagcttatatagtacgtacatatatgtgctagacgtatagatagcttataccggttatatgttcctaaaataatttctcaaccatgtaagatctgttatatatactagatgaagttcaacattaattttaaaaccatgcagtaattaattaattagtaatgcaaaacccatcctatttcagaaggctaattttctttcagtgtcaaataataatttctttcactcatatgtaaaaaaaaagggtgatttttaaggtaataggtgttggcccaaaaaggaaatacttaaattcggcgacatcaagttcctttgtattttggattttttaaaaaaatgcaaagtcatttttgacaaatgttagcctagaagtaaagaaatttagcacattggaacaagcatcaaagtattttttttaaaaaaaaggaacaaactaaactcagatgagaattcataattaatataactactataattaagttaaaacacatatatagctgaagcaacaatatttaaaaaaaaacgaaattccaaatcaaatcgttttcccatttcccccatatgcatgcatctccacataaattgtctccatttgtccccccatttaattgttttgtttctatctacctttccctttcctgagtgatatgtactatatatatgtaattacctagcagttggtgtgaacatagccagcatgcatcaaaatgcgtctccgagttgctacgagacatgcaggtaagaacaagcaaagcagccatgtttttggcctctccagcagccaagagcatgcacaa

SEQ ID NO: 101493 - DNA, 955 bp, Oryza sativa
gggcccacccaccattgacacttcccacactatcgggtgggtcccgacccggcaactttttcctgctgcccactgacaagctgatctggcggattttgccggcccacttgccatgcactagtggtctagtagtggacaacgggtatttgtcattactgcgcaatggtaacgcgtacacgtcctgcccaccacaacgtgcgtgcagctgccaggtgggacctacgtttctatccccagctgggccccacgcgtcatgtgaatggtatctttcgtgccatgtgctgggccggggcgagagataatgcttcctgatggtgggacccaaacattaggtgggccacctcaacttgcgagcagttgggcttctaatggactgtacctcttccgttttggttggtcatgggcttctctgtcgccccccttacgtgggctggtcgttttgctttgttgcctccatgggctgaaatgggcttcatggcccttcactaattatttgggctttactgtacggcctatcttaggagccactgcacaaagattaggaataagttcacttggtgaccctcaaaagtgattgaaatctaatccgtgaccctaaaccacaaaaccggtgcaatttgactccctcggtggttttggagggcggtttcgctgatgtggcgctgacgtggcggtattgaccgggtctcctttacacgtggcgttgacgtggcgtttaggtggcatttagaattaaaaaatatgtgtgggacccatttgtcattgacatagattgtgggacccacgttccccttctctctcccctccctcagttcattccctcttcccgccgctccctctctctctctcctgcggcgggcggagacgacggtgaacggtggagacggcggtggaggcgcgacggcctgcgaacggcggcggcgcccgggctgagctcccccgtgggcgggcgggt

SEQ ID NO: 101494 - DNA, 547 bp, Oryza sativa
ttcctattcccctattttttcagtaccgccattcaaaggggtcctcaatcttgtagcttcttacaccatcttcatttttgttatcttcaaccatgatatttatctccttcaacatgtccatcaactcattatgggatctcatcaaacatctcattgatcccaatatgtgaggcatcatctgtcttgtcatcagtacataatcctattacttgatccttacatatgagccatcaaccttttcacttgatgctaaaacataacctaccatcacaaactcatagtaaaggttaattccaacaatcgttatcattaatcaccaaaactcgtcccaatacaaggttagatgacttgatctttcatgcctcacggagatgattagttaatttaccgattaatatgctacagtgataattctaattaacgggaatgaaaaaagagagagaaaaagagaaagagaaaaaaaggcattttgggagggctctggcaatttcaatggcgatctcccatgagtgtcgatggtcacaccggcgcctccagggggtgggga

SEQ ID NO: 101495 - DNA, 953 bp, Oryza sativa
tggatgtgcctccgttgtggagaacactgaaacccaccatggcactatgctcctctttctgtctcactacaggctccaactgttcccgcatgggtttgtcttcttgcatctgcacacgcacagaataattcattcttcgcatcgcaacttgcaaaagctggtcgcttgcctgatgctgcgccctgacgcgtgctttcgctagctaacctttacatgtgttcaggcgtggatggtttgttcagggccttgagtttcttcagaaaatctgctagtagcgtcttgttcaggcagctggtttgatcatcgagcttgaacgctagccctcattgaatgcctgaagccgattgatgggttttatggatggattagtcgaactgtcgaagctgcctggttgtcccagcaagcatgatcgccgtggtgcagatgttgctgtccctctctgcgatcatgtcaattatagcacggagccttcgttttaagttgccatgtccagacaccatgcttccatggacgcggatcagaagtgtacaacccaacgcgtttcacctgtgccccaaaaaaaatgagttaaaacgatgcattcaagctgtggcgcctgctgcccccatcctgcttgttttgcatggtcccccctgttcaggttcagggagagaggtgaggtgaggtgaggtcccccttgcttgggccgtgcgatgcggcagctagcgtgaaggcacgctcgcgagttcggcactcgctttcggtcgggggggccattcaattaagctgcatggacgcacgtaggacggcgacgttcgttagccacggacgccggaacgcttgcgtccacttccccggaaagctcgacggagagagggagaaggccccggtaggcctttgctcaccctgcaacaatatgctgtcgggccgggtcgacatcgacagcccgaggaggaggagatgcgttagctatc

SEQ ID NO: 101496 - DNA, 637 bp, Oryza sativa
gatccttgtcttctgtgttgttgaaacgaagactgttatccttgtttatggttcttttgcgttgttaaaatgaagatcatgctaatatttgcttacagggatatccacctttcattctgaactttacaggagtaacgtactattgtcaaaacagcgtattccacgggagaaattcaacgcacattatagacctgcttgttttatattggcatggtattcaatggtcttgaaattataatggcacgcagctttaaataggtgaatactaataatatattttaaaaccataaaagttataataccattaaatctaattaaaaattatatcaatagaaaatagacggaaaaaataaagtaatactatctccgtccaaaaaaaattataattctaggttgttagtgttaaggtttgagaagaaaaaccataatgcctcttattaaatagtgtataggtcagaatggaagggaagtaatgaatggaatcattagtactctattggataattatttggggataaatttaaatcctaaaaatacaattattatgggatagatgtatagtaattttttttattaaaagagacagatgaaaaatacgaatattagaattccaaaattgaaatgacattagtactct

SEQ ID NO: 101497 - DNA, 758 bp, Oryza sativa
tgactaaatggagattttcaatcatattattacattaggtacgtatggacacaaatcgctatgacagggaagcgcgtgagccctcggattatatgtattatatatttgcatgaattagtatatcatattattatactatatgtgaaatatttgatgtatgagataaattaaattaaagctcaaatgcacagttcatataataatatttttttgctaccacgaaaaattttaaaattattaaagataaataggagttgcaacatagcgtttagcacgtgcatattactaatgttaacagtcagtgaagaaaagctaaaaaagggtgaaaatggagagagagaaagagggggaaaagatgaagacgacaattatctcctaccactgcagtttctgtttcatcactccagtgtccaagtctctcaaatcttcttctccccttctccgatcctcgcttctgtcgttctcccccgtttcaccggagccagcgttgggtacattttataaagaaactactccttcattaatgtatgacattgttgatattttgacctacgtttaaccattcatcttattcaaaatttttgtgcaaatacaaaaatatttatgtgatgcttaaacaatatttgatgataaatcaagtcacaataaaataaatcataattacataaatattttaaattatacgaatggtctaacgttgataaaaagtaaacaacgacatacattaaaatttaatacggagggagtattttaaaaaa

SEQ ID NO: 101498 - DNA, 655 bp, Oryza sativa
caaactcccaatcccatttcatccagttaccaaacaagccgttgaagtttctttggattggttcaaaacatagaaatttgaatgttagaagaattttcacatgaggtctaaccttttgaaaaaaaatcctatgcctatcgctcttgtgattccagtgtattctgtgctatatctaaatggtcattttcgaagttttcttgtattttttaatcataggatttaaagtgctaagataatctaatcttgtattttttttctatattaaaaatcccgctttaaaaacccaagtgttattaccttgtggcttcagggtcacaagcacatactttgcacgttatttgaatgtctagattcatccctaaaatttgaatctttttggacagaaggagtacacatctctatggtgcatatagctaggaatatagtgcaatgcttgtgtacgtgatgagtacgtagtacgtacgtttatcctacctctgagtctgaggtgagtgaataagaaaaggacagttgtcctcatcccctcatgattaattgcagttagtaactaatggtgatgagcgtactgatgatccttgttactactattggctgatcgatcgatggacaggagtgacattccatggattaagacattggtgattggtgaagccat

SEQ ID NO: 101499 - DNA, 1370 bp, Oryza sativa
aatcccggcaatgatggggacagtggttatgatgggggcccagatgacgacaatatttggcaatttggcccaaatgtgcatgtggaagaagatcacccttgggaccaagctgtagggcaggtccatgatgatgcagaaaatttggatcaggctattgataacatgggccaggttgttaacaatgacaattggcagttagttactattgagcaaacgaatttgggtttattttctgaccttgcttctgctttcactcaatttgttcatcaatggtctgtaaatttgattccttctgctgtgattagaaatgggttagtctctctgccaaggggcccgccagttgtggtttgttcttctgctctgctgcctgttttggacgattttcaggagcatcatctgttgctggagccaactcctttggctgtcttgccccctgacaaccctctacttcctgataacccttttgatatgccttctgatgttgttgatgttaatccaagccctgttacacctaattcaaggattatcacgaagctgaaccctgtttctccctgcaaaagaaagaggaaaatggtaaccccattggtggattcttctgtcaggagaagtggtagactattagctatcagagatgggtttaggcaagagttagctgaagatccaaacatgggggttggtaagccaagagggaaggatgtcagaaagcttaagcagttggctgatgctagtggagtggtatttcctaatgaactgattccttttgtggatctccattctgatatttctattgataattctagtgatttgtccactgttatccctgctgattgttctgttgatttaattcagagaattggattggacatatgtggtgcttccctggaggaggtgtcttctgtggtgtcaatgtaaggttcttcttcagcattggtcaccaagcctatcagcccagttagtaatgattagaagtttgtgctgttttttgttgcagctaggctgctttggacttgtctgttatcagctagtgtcctgtgatgttttacttttgtcagaccttatggttcccatgttactctatgatatttgggcttttcagttgcagttattgattggattatatccagtctggatgtttaattttatccctgtgttttaaatgaacccttctttaaaaaattggaatgtgttatgctggaatgttagaggcattaattctgatgataaatgacttgctataaggaataaggttgaggaaagtggttgtgttattttttgcctacaggagacaaagaggagcagttttgatcattcttgtattaggaagcttgctcctaagcgttttgataaatttgcattttcaccttctaggg

SEQ ID NO: 101500 - DNA, 578 bp, Oryza sativa
gaatgcgtacgttgtgccccatacacactccggttagtgctacatatgtctgtgtcaatcagactatcaaagtacctagtttacttgcgttacttgactggttcaatgcatatactacttttttagactatttttattattattatttttagactagttcaatgcatatacttgcggtcatgtcacttgcaagttgcaacatgtgtcctgatccacataaatggcgtagtgcctaaaacgacagctattaatctgatccatgtgcttgtgcatattatcttgcggcagctacacctacaaactagatcgatcgaccacgaattaacaacgcgttaactgaataaagtcgaatataaatttgacatgagataaaactacactactagaaaaatgatctttgctggatcggctgttttccacaataataccggttccaataagaaccggtagtcccggttataaaattttgatctttagtcccggttagtaacacaaacccctgtcagaggcatgtaggaggctgaggtatcaatcggcactaaagtagtcccggttgatactaccaaccgcaagtaaat

SEQ ID NO: 101501 - DNA, 758 bp, Oryza sativa
ctccttaagcgccgaggccctgctacacatcatcatggcgcaggcgcgcaaggagctccccctcctgccgccgcctcaagcggcgtcctcgtcgcccaccgtgccagcagcccactccccattcctgctgtccaggcaaaactccagcgctgccccgcgccgtcgtcgtcgtcgtgggcacaagctcactcgttctcgcaggagtaacagcatgggcaatggcggcgccgcgaatgagatgatcagccctggggaggagctaatgagccccttgaacggcgggggaagctcctccgcgaacgcctctgccttattttctcagggcggggactctctcctagacgactgctagctgcaggagcagctctcgttcctgcacgacagagccgagggcgtaaaccgcgggcatgctctacaagcgatctacggaccgtattgccatagcccctgacctggccagagcagtgggatgcattactaccgtctacaccgggccaatgggatggataggcacagctcgccatcagttgcccacctgacattgttcagtggatattgctaagtgaagagaccttgactgatcgacgtccacagaacgagtacgatcagtgctatctatgcgtactacaactacgcggtgactcaacaattgtggtggcacccggtctggccggaagtgaaggcattggtgatctgagtgggcaaatacattgttgtcgtctccgccgcatggacagtggcagaagacttgatgtcta

SEQ ID NO: 101502 - DNA, 632 bp, Oryza sativa
accgattcgaagcaatctggcgcgaacacgcgatccctcctccacaaagcctcctgccggagtcgttgccggacgacgacggcgaccgctgcggctgtggtcgttcgacgccggcgagagggtaatcctttgaatggcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtcggacaatattataaaaattgacagaatttcttatatatttactaaagttggacaagaaactaaatgtatgcgcatttttaataattttaacaaaaatgatatgatttaaaatgacatcaatctaaacaacccttcagttagaaaagaatgggcttaaaatcaagaatcaatcatattttatccacatcagcttttcaagatgctttttgtagacaaataacagatttttgtacgcgtataattttccttttgagaaggttttgtatctaaaacagtttcattt

SEQ ID NO: 101503 - DNA, 587 bp, Oryza sativa
aaaaatacgcccccttatatattccataattatacgtggggtggaggtgtatgttgtaattgctgtatccatttgttatttcattcacttgttatccctagctctactatctccctcgttcattttctcttctgaatttgctgcaacttgtcatccgatttcctatattgctctggctactggttcaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtc

SEQ ID NO: 101504 - DNA, 760 bp, Oryza sativa
aagacccggcgacttataatatgataacggacggagtatgggtcaagcattagattacatagaacaattactactcccggagctcattaaaggctaccactgatgatgcatatgctagcatgcattactaaacagtacaggtacatataagctcccagctcactactggactatcgatatgccaaacagaactttactctgtaccaatcatataaatgaaatctaccctgtccgtgccaaaagacagtggatacgggaatcaagaaaggaatgcaattgaatacgaaggagctccgattgagtgacaaacggcggtaggagataaaagagactgacagaaggatacaatggcctgtgaccggaatgaccggaataagtagtaatagacgacaacgatcatcagtgctcccaataagggaaggggatgacggagggaccattatttatagatcataatggagaggctagtgagccatggcacatgcaatcaatagtctgtcataagtgaagcgagcgaagcacaactagatacgtttgctagaatgcaaccagtccaccgacaatcaaaacctacaagccacatgagtgctctcacccacagacatataaataacgtaatggcaagccacagctcccaaggcaattcccaaatgacttggccaggtcaaaacagatgcctaccctgacagaccggggtggccttcgtcaatggaaactaaggccgccccttctgaaggtgctaaaagaataggcagtgacg

SEQ ID NO: 101505 - DNA, 766 bp, Oryza sativa
  unsure (1)..(766): unsure at all n locations
ctgcaggtggcgccaagctaaggccattcctaactcaatggttaagatgatgtccatagtattaaataggctgccatctaagataaaaaatgatgtcacaagtaaataaataaagaaatagaaggaaaccatgtcttgcatgagacatagtttctacacaacatctaagacatcatgtgagataagtagcattaaatttaagtatagataggaatcaattagacatatataaatcaaatgttacgatagacgacacgagtttgatgttgacggctagctactagataaacttgatagcagaagaaaacacaacatgccatgttgccatccatatgaaccaatcatatatctcttgttttctcaatcctcattctggtttattagttttacatagtagacaaataaagagtaaattgtgccggtatatctgtgatggtattttgaaactcgtcgacagataaaactaatgatatgggggggggaattctatagtgttattcttggtttgattttccatgcatgcatcatcctgatcactactccaataatgtcaatactaccaataataatgtgttaatttcctccatatcttatatgctatctacttctcatcagtactaccactactagaacaacgatttttgcaggtagccaaaacgaaacagcaagtggacgtggtggtgtggtcatcattggagggaggattgatgccggcgtcgccatccagaagccgcttttcatggacgccgnttnntaccaccacttc

SEQ ID NO: 101506 - DNA, 649 bp, Oryza sativa
atgtcagcatgacgcatgtgtgcaaaactattttaaactattttttctcttaaattatttatccaaatcatgatccaattgcaccattaaatttgttgcaattaaatctttaaaacaagaccatatatggatatattccgatgaaaaaatagcttattattgaattatttataaatattgcacgttgttccaccaagtatactggaattatttcactaagtagatagaaaatgtttcaatcttttaaaatcgtgcgctatttcaccttttataaaaacaattttcagcaaatagtaaaagaatgtttcaattcattgcaacattagatctatatatagtaaaatattttgagtacactaggtgaaatatttttggtggaacaagaaataaaacgaattcccttgatagatggattatgtgggtgattttgttgcaaaagaatgtttcaattcattgtaacatttaatctatacttagtgcaacatcacgagtatactagatgaaaaaaattgttggtggacacgtggcggcgtacggacacgcgtggtggggccacgtggcagcggcgcgtgtaggcgcccgacgctgaggattatcggtgtttatagtagtaatagtctgattattttcgttggtcagatggatcgta

SEQ ID NO: 101507 - DNA, 539 bp, Oryza sativa
ttctagcctcaaatagtgtaccgcacattttatattccaaatgaatgttttgcttattacctgggggtgggggtgggggtgggggttaaagtttgatttcttttcccctttatgattggcacatatcagaccaactatggtgtttacttctattttagaccttgcggctggagctggcatatttcctatataggccagatccacctcataaggagtgtatcagtgtacaaatcacaatcattatgagttgttgaaacaacactactatttgtaaatcagataactaagcttaatctctatccctgaaaaaaaaaatctgcactaccatcccagatagatgcaccaaaatgtattttctcataagacaaaaaatatacttttgttactgaagcacggatatactttttctattgatgtattttcatctgttcaaatgtcctgcatatttgttgacttcacgtatatatatgataccattttgatattagtgagattggtggttctgtcatagtaaattggcaacatgaactatgccaaca

SEQ ID NO: 101508 - DNA, 571 bp, Oryza sativa
tcccccgaccccatgacgacattgacctaggcaacggcagtgacggccaccaacggtgacaaagcttgggcagagacaaccataacacggtgggctcacataggacattcatgcatgaccacgcatggcagcccccatccagtctcccatcattgatgccacaacctctccacacagagccctccgcaccagagcatccctaccatcggcactcatgcgagacctagttctcatcgcccaacacacgtataggatctccaccttggtggcctctaccgagagcatattggtgggaagttgttcaccattaccagcggtccccgcatagttgcatcgttttcgagtggctaccttcgacggatctcgagtgatgcccacatttagcaccaccaccgtagaggtcacccaagactaggtggagggatcctctaagaccctgtttagatgggagtaaaacttttaagtccctatcatatcggatgtttggacactaattataaatattaaatgtagactattaataaaaacccatccataatcttggactaattcgcgagacgaatctattgag

SEQ ID NO: 101509 - DNA, 530 bp, Oryza sativa
cccatattaatcggagaaaaagaaaaaaaaagtagagttcatataggaatacaatttaaaaatagatgaaattcagaattaaaaataaggaatattgaaagagttgactggagtctatacaagtatacaatttagaattaattaaaattcggaaataaaaaataggaaaactaaaagtagaagttagagtccatatagaaatacaatttagaattaactaaaattcaaattattttttttaaaaaaaagcaagattaggagaagagtctagagtccatacatgaatacaatttataaataactgaaatttgaaataaaaaataagaaatattaaaaaaaagagtctagagtctatataggcatacaatttataaataatttaaattaaaaaattaaaaaacaagatattgaaaaatgaatttagaatccatatagaaatacaattagaaataacaggttgagaattaaaaaagtagaaatattggaagaggagtctacggtccacacataggaatttagaactaaatgaa

SEQ ID NO: 101510 - DNA, 572 bp, Oryza sativa
agaattatcatggcaccttattctagtgcaggatttcacatccatgtgtattctaatatttgtttaactgagaatgctagctagtagtatggttctatgcttgttattaattttttaagtagttggtttttcaggcacacgttgtgctaattaccggctggcatgctattaatcatgacagcaagatctactgtataaaaaaaccttgatgtgcatgagaaaagcatgccaatggagaatggcaggagtaggtcgccgagaaactttctgatattttttaaaccatatatcaacagatcaacccatcttaacttacaaagcgaacataagtcttacagcatacaggtaaaagcaaaagactggaatctccagtttgacatcaggacaacaaaaaccaccacataaacaatcctgatataacaacctactattgttgcttttatgtcttggtcacttgatatctgctgctgtgatttcctccaactttgcctgcagtccctttgatatgcttatttttgcacaactcggatctcaatcctgtactaaccattgtatgtatttcatttcttagc

SEQ ID NO: 101511 - DNA, 614 bp, Oryza sativa
agctaacctgttggttcttgctgctgatagttgagacatgacaatgtgataactctcttggaagatagatgccagtacattaaaaatgagaacagaacacgagagattccatatgctgtttattgctgctgccagatctcataccatgatagacagcatcagggagctgaactggaatgattctgtttgtctaccaaccaaatggtgctgtgtctagcacatcccctgaataaataggcctcagcacaaagctagacacatcataccatcagtttcctttccttctcatctcttggattcagcacaaagaggcagagctagcaacagacatggctttccaccaaagatcaattagcttgccttctaggcctctctccaaagttgaagatgagttgcacagcatagaggcatgcatctcatcaccctccacgaccatcgaggtggtctctgatggtttgaggcggcttggggacatctacagctccattgtggagatcatgtgcctgcctagcaaccaaatttgctcatcccaacagaggaggttgttggatggagaaattgggaatgtcccttcactactggatctctgcactctatgagtgagtcttcaccga

SEQ ID NO: 101512 - DNA, 619 bp, Oryza sativa
ctattgaacttgttcttagcctcttgttattaattactccctccattacataatataaggtacaaccaccttttttagatgttccataatataaggcatacatgcatgcaagccattaactatgacaattctccattaaattactacttttttaaatccttcacactcacattctctaactctattggatgcatgtattacatttattaggatgatccaaactataaggtgataataactatttcttggtctttgggttaagggtggttgtgcctcagggcagtcccaatcctccacctaggatggtgtctatggcattaactacattgccatgtaggacttttagcttatgtgtcactatattaattaagagagagagttaagagatgaagaaactgggtctcatgcaagacacaacttcaacacgagaacctatgcactagacactatcaagttttacattgggagagaatggtgtcttcataatagatgaagaataaatataattggtagagaagagagatgatgtatttattaatggcccactttaaggaaccatgggttgtggagtgtagtttctattatgatgtcttattgacatgacaccatagacactact

SEQ ID NO: 101513 - DNA, 648 bp, Oryza sativa
tccacatggtgcgtatttttatacgatgcgttaggtgctcctgactagctctatcacattgtgatgttccagttcttgggatcaagaatcagcatggcagcttactctattgctggcccttgacaaaaatgcatgctctaacacttgtttaatggagcacgcttggcgagtcgtatgggttctctatgtgtgctattaattgttaattggttggtttattaggcataggttatgctaattaccagctggcatgatgtcaagatatattgtataataatattcctgtgaatgaggaaagcatggccatctcatcatctctagtaaagaatgctggcttcaaaggaatttttcaaactttctgtactattggttctataacatccaggaaaagtgagcatcttattgataatttaagttttttttctatcaataaactttagcttaagtaccccaaaattcaggtgaatgtttggcccgtctctcagtgtgagggttaataagttccctggaaaggaaaaatggtcatacatacaacttcaaaatcagtaaaaattgacaactgagcatgggccaaaatattttttttccttttgactaactgatgtactgtacattttgacatttgtcatttcctctcatatacacatt

SEQ ID NO: 101514 - DNA, 551 bp, Oryza sativa
gccccgtaccaacctcatctccttcctcgaccgcccttgtgacctcctcgccgcacaacagcaatggaggtgtagacggacgccagcggcgatgaccttgtagccatacaggagcagtgccggagcctggaaaaggccatcaacttccacagggagacgcatatgggcctcgtcccctcactcccaccaagagccccgccgccctaaagccccaccaccgccgcgtcctccctgaccaggtgtgctccacctaccgcaaacctcgcccggattctcccttgcctccgtcaccgctggggttgtgcgcgccatggttgtcgtgtgcccctacagctcgtccccttcgccgagatcaacgctgccgcgctcgcgcaccgcctgcaacggagagctcatctactagcgagggcgagcagactgctcttgctgacctagccgtcgaactcagcggcccggcagcctccgccatagtcctcgccctccgtcgtgctccatctcgctgttgccgccatccaccaccggtctctgccatcacctgcgagagaaatggt

SEQ ID NO: 101515 - DNA, 656 bp, Oryza sativa
aaataaaaatattaaaagaacacaatacgataataattaaaattcgaaaaaaataaaatttgaaattagaaaaagaaaaataatatttcaattagaaatgcaatttataaatgactaaaatttgtgataaaaataatgactattgaaagaaaagacgatctaaaacacatgacgagataaattaagtaacatgcctcggttgatatgataaataaaaactgttagtaaaacaccaaatagaatcctaatgacgattaaaaggagggacgacagtcatgccgtgaaggaaacaagcaaggcggttgccgggacttctagaaagtaaaaaaaataaaccccattgataatcatattcaatttttaaaatctcaatgacaataaaaaatagaagcagcgggtgggggtgtataggagtatagttgcggagccaccgaaggttgacggaacttctagaaaataaaaaatgaatcccaaaaacagttatgtttgatttttagaatcacaatgataataaagagtaggtggcggacgggccgtagaatagcatagtagcatcgtttgaaggtacttctaaaaattataaaaaataaaacccaacaagacaataaactctaaaaactacaaggtccaatttttaaaggttcggaactttaaaa

SEQ ID NO: 101516 - DNA, 719 bp, Oryza sativa
ccacaagtgatcagcaccagtgtatatggatcgatcaatctggctagaccgctgtctagctagtagtagtgttcactgttcagtggacaaccctgcatagtgttctctccacaccacggcgcatagctctaaaaagaacagtgcactggctgttttagctagccatcgatagacctgagatcctgtttagatgggactaaaacttgtaagtccctatcacatcggatgtttgaacactaattataaatattaaacgtagactattaataaaatccatccataatcttggactaattcgcgagacgaatctattgagcctaattaattcatgattagcctatgtagtgctacagtaaacattctctaattatggattaattaggcttaaaaaatttatctcgcaaattagctttcatttatataattaattttgtaagtagtctatatttaatactctaaattaatgtttaaatatagagactaaagttaagtctctggatccaaacaccacctgggctctgacctctgcgggtctcggaccaccaacatgtcaaccagcagcagcagtactactcctacctatagccatcgtcttgtgattcttggtgccctgatggctgaatagacgaatgaagagagtgtatactaaagtccgtcacaaaatataacaaagtaacttaaatcaaaattataaaaacaacttatccaaattcggagta

SEQ ID NO: 101517 - DNA, 506 bp, Oryza sativa
tcatgaattatgaaacatatgttccacacaagcaaaattattttcttttcttttttgcagtcaaattgatctgtgatgtgccatagggccatgaaatggccatatgggctgtgtcactctgataccatttgtagcctcactagcaagcaaaggatccatgtatagtggatcttgctgctgcagttagaataggccagctccaatacacgaggttaagcatgtgagcagcaggtattgtacataatagagcacttgtagcaagcaaaggatccgtgtgcagtggatcttgctgccacagctaaaacagtccagctaccatacatgaggttgagcgtgcaagtaccactgattgcacaaaatagaacacatgttgaaattaacaagagcataaaaaaagataaaacacatataaaaaataccactctggaagcaatcaattaaaataatgccttgagtgcatgcaattatgtagagtgaactaacctgctgtttcttcctgccaacag

SEQ ID NO: 101518 - DNA, 509 bp, Oryza sativa
caaaatgtacagtcatcagttagtcaaaaggaaaaaaaactttttggcccatgctcagttgtcaatttttactgattttgaagcttgtatgtatgaccatttttcctttccaggaacttatttaacctcacactgaggacggccaaacaatcacctgaattttggggtacttaagctaaagtttattgatagaaaaaaaacttaaattatcaataagatgctcacttttcctggatgttatagaaacaatagtacagaaagtttgaaaaattcctttgaagccagcattctttactagagatgatgagatggccatgctttcctcattcacaggaatattattatacaatatatcttgacatcatgccagctggtaattagcataacctatgcctaataaaccaaccaattaacaattaatagcacacatagagaacccatacgactcgccaagcgtgctccattaaacaagtgttagagcatgcatttttgtcaagggccagcactag

SEQ ID NO: 101519 - DNA, 1671 bp, Oryza sativa
cccccttccttccaagggtcacacccacctcaccctccttaccaaaggcccaaaacccacctcccacatcggtcaaaggcccctcccaccggtcaaacccgcctactaactccccccaccacccacctcttctcagctctcgtcccaggacggtgcagtaactcgacgaccactatgcagtaacactgtgtcttacgtgcagtaacagcgttaaaatatagttgaaacatagtcatgacggatctacttttgataagctctttttttctagcatcatggtgcaaacggttttaaaaaccttacatcacttgggagatattgttcttcaaagtttgacagttttgcaatttgtctctccacaagtagtaatactatactattgcttgttactacttgtctgttgtacgttactacaatcgcatcacgatgttactacactgcgttttactgtattttttgggtagtgttactgcataaacacgtggtaacgtataccttccgtgcagtaacacttctacttttgtgcagtaacaagtatatgattagcatctgagacttttaacctatatatttttgtttcaattcctgatttactgtaattcaccacaatattactgtcaaaagtgcagtaacgtcatatacatgcagtaacactatattcgagggaggagaccgattttcttgagaagagggaggaagaacggtttcttgaagaggggagtacgtagatgcattttgaagtttaaccctccacatgcagtaacactatagcttcatggtgggaatgattttaaaaaataatacatatcttgtgagatattgcttttcaaatattggcattttgaactttaaccctccacatgcagtaacagaatgtgtaacttgtagtaacaagggcatatacatgcattaacatggttttacaaaatgtataaaattgttcaaacaactcctacatcaatcagacctcactcaaagccacgtacagactttacctatagcccacctattcaatattcatcttgtaaaaatgacatagtaaaactataattatcgtgcagtaacatagctacttggaagtggtaatatgcgtctattatgtagtaacacttctactttcatacagtaacaagtatattgttagcatgtgaagctttaacccatatatttttgttttagttcttggtctattacaattttactatgacgttactgcattattgcagtaatgtcctatgtattatacagtaacgtcatatgttactgtacttttacaacaatgttactactagagcatagtaatatgttatgagtttcgatagtgaaagatattagaattgataatcatatttctttctcataaaatttttaaaacaaatagtatcattagatgaattggttagaagaatgtgctttgaactatgaggtcatgggttagtcttgaatttggcaatttattttttatttttccagaaaagagaaaaaaatgtttcaaggagaaaaaaaaagaaaaaaatgaaataaaaaaagagagattgggaaagagacagaagggaggggatcgggagggaaggagggggagcgcgagagggggggatcgggagcgagagagagacagaagggagggggagcgagagagggggggatcaggagcgagagagagaagggagg

SEQ ID NO: 101520 - DNA, 752 bp, Oryza sativa
ttcctgcaccccctttattatgttttataatatcctacatacttatatagttcatcctcacttagttagtgcttaaatgattaatctatggtccaaattatctttctccttttttttctctaactaactccttaagcttaacatgcaacaaagatgacagatcatcatccactaacaagatgccacatcatcatccactaattaataagataccacatcatcatccactaataatcatcacatttaaacatcatgcaaacatgatatatctttatagtttttataatttaagagcttttcaaatacaaacacgttaaattatcatccaatataattcacataatgtgtcaatgtatatctttattatgttttatgatatcctatatacttatatagttcatcctcacttagttagtgcttaaatgattaatctatggttcaaattatatttctcctttttttcctctaattaagtcatatcacatcaattgtttttagcctttagatgattaatctacggtccaaactatctccctacttttcttcttccataaagtcataccatcttactttttatgtttgaatcaccattctacatactatttaaatataaattatcataaaccacattaatttacttaatctgatgttatctagctatcttacacgttattttattattattatccccgcagcaatgcgcggggtttcacctagttttaaacatgttcaatactttgccacattttatg

SEQ ID NO: 101521 - DNA, 1597 bp, Oryza sativa
gttgtggtggtgggggatctgcggacgagggtggttagggtttggggggagccatgggatggagtggaaacgattcgaatcggctcgagcggtggcgtggcgtgggattgggttgggttggtgctctcgtgcgcggctggacgcacacacggacccggacccggaccgggacgagacgacggcaaccttttttccgctggactactactgctgactggtcagttcgttcgtcctttccgttggttgcgcgcggcctgctttgctttcttgtttgctttgctttgcttcctagttttcccgttagtgctttgctttcttggttactgctttgctttgctttgtgagaaaattgagattaaggcatagtagttctattcttcaccttcaaattttagcttcctggttttcccgttagtatgtttttcaaactataaaataatatgtattttgtaaaaattttatatatagaagttgctttaaaaaatcaaagaaatctatttttcaagtttataattattaatacttaatcttatcttatatacatatatatttcatccccactaagtgtagttaatattatttctctcttctgttattaagtcacatcatcccaattatttttaatctttggatgatagatctatggtccaaattgtcccttctttcttctttcataaaaacatgcaatcttaattagttttaggctcagaattgtatccaattgttttagttttgataatcaaattacatcttatttgtacatattatgcaacttaattttccgcagcaacgtggcggggtattcatctagttaatcatatgctaatgagctttctcgttttgcgtgcactaaaaatatctcttttgcaaaggatcgaacacaacaaagccagcattacgaacggtttttcgctaaaatattattttataaataggtttatttagttaaattgttattattaaccagtgtgtcattgctaaaatacttccttccctacttcttctcttccttgagctccaaccaatcctctcttactactccgcgctcttactactccgcgcattgtcacgaccgcaagctccgcctctgctcaggttcttctcgccgtccctgcttcccacttcggccattgcactggggctagaggaggttgtgacggtgcaggaagtggaggaggtcgaccatcgcgttaggcgtaatctcaaatttttgaacttctgcctcctctctttccttcacgaggaagacacggagaccaagaacatatttgtgtgtgcttaatatatgtaggaagttggatttaaacaaggtgagtagaatacatgactccatggacacatcgtcgatcgactaatgtttcgcccacaatagtgagtattggtgatgactcggtaagattattgtctctattataataatttgatgccataagagtatggagaacgattggcattgacatttgagcgatggattgatgacaggtaaggttatatcgctttctataaattatattttagcattattcgaacctacagtttttaggtaccgagtctaatgggtcgactaatttctttaatagtcaaccggggtgcagga

SEQ ID NO: 101522 - DNA, 1982 bp, Oryza sativa
tcctgcagcccatcatataattcaattcgacatttatttttgccaaagaagtccgatttgcctcttcttccctctccaccgattcaaaatttcagcaacttatcttctcttctccctcacactcagtcctctctctccaccaatatttctcatcttctcttcactacttctcacttctcagtcctctctctctctctttctcacctccttttctctctctctcgccaaccggcgcccgacggcgggcttgacgcccgcgacggctggtggaggcggcggcggtggccgggcagtagtttggcgggcgacggcagggtggcgggagcggcggcggcagcagggagtcgcggaggcggtggggacggtcggcggcgccggatccgccacccacaccctcgggagcgacggcgatgtggcgggatcggcggcggcagcgatgggaagggtcggcggtgtcggatctgccacccacgccctcgggagcgataatggcgggcggcgggcggcggcggcgggagcgtgcgacggcgatgtggcgggcgaggaggcgatgggacatggcggcggcggcttggccctgtggcggtgggctgatgggagcagcggcggtgggtctcgtcctgcccggatccggcagcggcgggcctccttgcgcctagatccagcggcggcgggcctcgtcccgcccagatccgatggtggcgggagcggacggcggtggctcccacgacagcggtagcggagggcgcgatgccggcatgattttttttaagactttatttttgtattttggatttttatttttgcataagaataccatatatccgatgaaaaataccggatagtattcgaccgttatctgattccaacggatatcacctatatcatattcgttttcattttcgaaaaaaagtatccaaattcgtctccgaatatgtcacgattaaaagacaccctaaaagactaagaatttgttggatgacactttcaactcagttggatagaggaattcttcaaaaagacaagaatatgggtaaacaaaatctttgagctaagactaaagtgaaaatgaaatacgagatatgaaaaaagaaaaggcaaacgttttaaatcaagtagcaataaaatgaatgatcaaaaatttatcaaaaagtcaaacggtggtatatattaaaaaccgagataatattataatagttgtctttacaaccttaccacaacttaagttggaggagagaaatacaaggacaatatgtgccgtctcatggcacgcaacaagaccaaaatatacgtgtccctctcaaaatagttagtctcgagcacttcttaaatttggcatcaagtctcactctaagatcgtgatgccattttcagtaaacatcgtccggtttgtgttttattagactagaatatcacattttcttgtaaattagaggctcatgtttttcctggttgactaaagaaatgtttaaaatatttgtctatatataaagtccatatctgaatacgacctacacatagcaaaatagaaggtgtcactaccaccgagtgaaagcgaattacactcgctagacattttgatgtaaaaatagctgccatacattttttcctttgtattcggacagactaaaactctcttgtgttttttttttaagaataactctcttgtgtttttaaatgtgcatgaattggaatataattatataatattctaacaacttcaactctagcatgcatggagtagtgcccgtgccaatttcgtagcaaagtgcacgacatttcaacgagaacactaaaaaaattgttatagtgggaacaggaacagaatatatatatatatatatatatatatatatatatataggcactgtttagttcccaaaaacttttcgcaaaaacatcacatcaaatctttgcatatatgtatggagcattaaatatagataaaaagaaaacctaattgcacagtttgtatgtaaact

SEQ ID NO: 101523 - DNA, 2430 bp, Oryza sativa
tctaaaacagagtaaagcaaacatgtgacacccctctctatttggctctagctccacccctgcatcacttcgtaataaatacgactgaacatgaatgtttctaaaaaaaaaagaaagaacatgaatgaacagttctaatttgtgtggctgacgatgctcctcgctctcgctacattgccaatttgccatcatcgatcttccacacagaaccgcagtgcagacacaagtcggaaaatgaaatgggtgaaaaagagaggaaatgaaacgggtgaaaaagaaatcaggttatctcgcactgatgcatgcggtgacgtgcttgtaatgaatcgacactaaaatgacagcttgattgatacaaagtatgcgtatgatcagctataggcgtctattgtagcttttgagtgagttaattgaattgtttgcctgtattttgagcttattggagatctgggcaatttttttattcgttcaaatttcgcgtgtaaactggttgatattgattttacatgatctttacaaactcttatcctcttccacaggttgctttgaaattgttcagatcaaaatagcagcaagaaaaaggatcaagaaaaagaagtactttatagggcccaaatgtataaggaaactcaagggctgcatatggcccattagtcgcttgtttgggcttcaaatggttagggtgggaacgacgagaaggcccatccatccacatctatcaagcgatgggcttttgctataggaataagtgcacttaaggttcctcaatttgttactgaatctgaaattcgtccatgaacccaaatatcaggtatagcacatcccttaacttacaatcatgtatcaactttgatccctctgcagtatagtggtcgatttcggttgacgtggcgagtgagacccacgtgggcctatatgttagttgttaacttttcttcctcctttccctcttcctcttctcttctcttttcttatctttaggattgtgccggcactgctgattgatgaggaagaaaaagatgatgctcctgaggcaacatgaggaggagcagtttcaaaagatgatgctcctgaggcaacatgaggaggagcagtttcttcaccaccgacatcaggaggagcatgaggatgagaaggcatttgagtccaaagagacgacggaaatcagacttcaaagagactccaacgatgagaagatagccgtcgttttacatggacatgcccctattcatacctaagtcattgcgtgacactatctagctcaaagagcaagaacggaagcgatgacgacagcttgagttggagctgcacgagaagaggtcaagagggttgatgacaggaaggctctaacgaggcagatcttgctccaagagatcatcaacgaagagctcctcacctacaacacagcttcaaacgacgaatccatcaactgtgttgtcaacattgacgacgagacagaccaagccgaggagcatgagtcatggcaacgccgggagatggcaaggatcaagaggggcagggaacaaagcagcttgatgacaagtcgatggaagatgagaacccggttgctgatcatcccaagaagcaaatgagatccatgcagaggtactaccacaagggtagcttcttccaacaagacgccgacaacgccacgcagactgctggagcagagggagagggagagggagatgagggagaagagttggtcgctaatatgtggggtccacgtggatcctactcgccacattagccaaaaccgaccactatactgtgtgggaccaaagttaacacgatattgtgagttggggaatgtgttataattagtatttcggttcacagacgaatttcagactcgacaacaaaattgagggacctaaaatgaacttattcctttcatatacaatgaagcttcattggagctaaccaatgaatatttgctaaaaatataaaaactatataaaatgctatagaaaaagttgagctagggtttaggattcagatttgagttcggggttagggagagatgcatagtaatacaccctttcagttcctcttttgtgtcctatcttactataaagttatccctcactaacttattaagcttaagcttaacatgcaaagatgccacatcatcatccactaacaatcatcacatttaaacatcatgcaaacatgttgtattatctataattttatagtttttataatttaagagcttttaaaatataaacatgttaaattatcatcccacataattcacatgatgtttcaatgtatatctttattatgttttataatatcctacatacttatatagttcatcctcacttagttagtgcttaaatgattaatctatggtccaaattatctttctccttttttttctctaactaactccttaagcttaacatgcaacaaagatgacagatc

SEQ ID NO: 101524 - DNA, 507 bp, Oryza sativa
agttcatgactagtcactgttaaactgggaatgtaacccaacaattccagagtcactgttcaaacagggaatgtaacccaacaattccagagtcactgttcaaacagggaatgtaacccaacaattccagcaagacacaacaaactcaaaataaatggcactaaggatctcatcagacatacgcatcaccaacacaagtagacaatgacctttcaataccagagtggcaaaattaagttgcaagaagccaataaaaagtactccctccgtttcacaatgcaagtcattttagtatttttcactttcatactgatgttaatgaatctagacatatatatctatttagatttattaacatcaatatgaatgtgagaaatgctagaatggcttacattgtgaaacgaaggaagtaaccatcttgcgatgttgaaataaacaacgagcataatcaactgttcagtctcagacttccacaaaccaggaaaaaacagtctcaggcatttaaat

SEQ ID NO: 101525 - DNA, 629 bp, Oryza sativa
agatgaagcggatcctgctgatgaggaggtcttccaggagcaagccggctacgatgagttttagggtttcggcctagttcccaagtcgcgcctgtgtcgtttggtccaactcctagcttccgtttcccttttgtagtgcagttgtgagctcgggatctgtccgcagcccaacatgactgtacatctactctataataaagagacctttgttgctgtgatattctgtctccctgtgataccagcactgtttcctgggactggtatcgattaacaggttaatttggagcgtcacgggctagttccggtcgggactagttcggggcgtgacactcatcatgaaccgtgtcgggttcgtcctgactagatccagatcccttgggatccaccaagagaggcttgagctcggcagcggcggcgagggggacgggtgaggcgcgggcagcacgaagtcgagcggtgaggtcggctatgaggaggcagcggtgaggtgctcctgccgctcgtggagctcatggcgggtggcgaggaagcggtcggagaggcctatggatgaagagagcggcgcgagcgcccaatcgagagaggaaaggggagagagatgaaaagatgggaaatggggagagagagga

SEQ ID NO: 101526 - DNA, 579 bp, Oryza sativa
tatgtgtctaggtgcatatatagcgttgatttgattgcagatgatggtcgctgaacgtggctggattctgacggacttaattagtcaccgtgcgtgtaccacatggagattagttagctagcgatctacatgagctttctcatgataaaaataaaggagcactagtacttaggccgcatcgagcaggtgaaaattatcattgtcagactatttccagaggacccggtcactcgagtgttgagaggatcaaaagataatggaactcgtctgcgctatgaacttaatttaatctggctatctttgacaagctaattctgctgctagaaactttcaaaatgttaacaagcttagctaactatgaaaaaatggtcggtaggcctagctcccgctaacggcgcggcctttccatacaggacttgcgactgattcgctaatcataagcaagacttgccctactagaccatactgttatcggtagaattgaacatcgatacattcgatattgaatacgggacgatgtttactttgaaaaagtctatcaccttactttgtattgtttaaaaagcacacaatttttat

SEQ ID NO: 101527 - DNA, 712 bp, Oryza sativa
  unsure (1)..(712): unsure at all n locations
tgcgcgccatatgtctggtcaaaattagagttacgtactcctacaattaaatnatgtatattactttctnagatttatgcacgccattttgctggtcattatactatttggtcaacactagtttccaaagtgctttatcaatcatttttaaacagtataataaacaagatcaantttgaatttatttggtccaattttcaaaaaaaccttaatttaaaaaaaaaaaaatttttaaaggggttttttttttttacgaaaacctaccccaaaaataattgttcatgttgattggtttgaattttttaataatacataaatcggccgttgctgcatccgagttggtttatatagaccaataatgattatgagagctatatatttttcatatataccgatgcgtgttgtataaacgaacttctgccatagttgcatgttaaatacagtatacatattaacaggagtatatacgtacgtatacgtactccatcaatcggtgtagtagagagatcgaaagcaataaattctggacctaaaccacctattaattctttcaccacaagtcatgaacagctcacaaaaaacgggggcttttctttgggttgggccccccaagtttttttaacccgccgttcctgttgctctgcctgctgttgctgataaaaaccaaacacaccacttaccggctgtgtgtttcttctcccttttttttttt

SEQ ID NO: 101528 - DNA, 506 bp, Oryza sativa
tgcagccctgtcgggctggatgttcagagaaggaagatgcacacctcctactaacaatgcaagcaatcacatctctctctctctcccattcatgttgagtgtgatgtagtgcactcttgtactttcaaaaaaatatatatttctataaattagaatttatgcgcaaaaatccaagtgtttttaaccaattagaaacttagaaagggaatttgagtaattcaaaatttaactaatgatgtgattaaaaagaaatctttctcctcaataatattaatctggatagtctaaaaatgcttttatttgagaacgggggtatgtattttcaatgtagcgatgtatctacttttatcataaggatgtcaatttttggaaaaaattttttaattttttttggggccttttaaaccctttaaccccttttttttcccggttttaacccaaaaaaactccttttgtttgtttttcagaaatgacaagtgtaaattaatcattcaattgcatcattt

SEQ ID NO: 101529 - DNA, 509 bp, Oryza sativa
gcagcccgatcttcagcatcgtcaagcttgtccatccagagagcaaaccacaatggtcccaaaagttggcacagtacaacctcatcatcggttgtataaagcagaagagagcagcagctggcagttgtttactgaaatgcatgaagcgtgtgatcggcatccagcccagcactatgactcatgtcgacatctctcatgagctgaagaagctcgtccttgataagctactacaggttggaagcagattgcatccagatgatgtgtggggacatcagcaaattcaccggccaatgggcaaagttggagctcatgaggagcaaactgcacattgaaagttcatcaagagctcgggctgcagggtggccttgtatttcccaaaaccccgggaaatttaaaggggcccaaattttttttccaaagaaccggggtttggggcccccccccgcgtttatgtctgctgtccttgcttggcatattgcgacggacatatccttctttcatgaagatga

SEQ ID NO: 101530 - DNA, 635 bp, Oryza sativa
taatatcaatcaatctcaagacatcgagcaaggcaagttaccatatacctgttgatcatttaagcctatattttacaaattatttatttatagccttctattcaatattctatttttctatcgcataaatcattcatagaaacccagataatttagtattgcttatttttgcttacaatatggttaaaatacctcatacttagattgggacaatatgtaagatttttgtggtttgtatttccgggtggctagtattgtctcaatcgatataagttttaccaggtacttatgtcgaacgaacgggtacgaccgcagtttctagaatggggacagacctagttattaggttaattggcaatatggcacctctgtatagtggttcttatttttaagtcctcgcgcaggaggcaactatagccgcgaagggcaactttaaccattaccatgtacaggtaaaatggtttgtgatactcgagtataaactatatggtatatttctaaaccctgatcgagatgacgtggtgtcaaacgatcagttccccttaaatacctagggaacgccagaactcctcttgctgctattaacattacgttcagagcatatgaggatataagttcatggaacaggtgccatt

SEQ ID NO: 101531 - DNA, 599 bp, Oryza sativa
atgtatgtattgttagattgatctccctccccttgagcccaaccgcttaagggggccttgaccgccccctgatcgggggcgtccaccccaatggctggtgggccccgtcacactgcgccatataaaagaggggtggaggccggcacggcacgaggtacgagattcaccgccgccgccaactccaccctacaaaccctaatccgatcgagagggggcgcagccagtgacgggaagcgccaccgccgcgccacacctcatcgccaggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactagatctaacctaggtgatcctagtgcaaagtccaacaatggtatcagagcaaccctagtgtttagatcgtttcggggaaagaaatccaaagaaagaaaagcacaagatccgcacggatcaaaagaaccgaaaaccc

SEQ ID NO: 101532 - DNA, 4333 bp, Oryza sativa
gacgcggcagagggtaggcggagcggcgcgcgtggcagggtagggcaaaggctggggaccaggtcgaacacgtggcgggcaatgaacagtgcacttttccaataaaccgattttagagtgtttctcatatgaatttgattccgaaattcttaattttttgcataaatgaagttttaccccatatttatattattctaactaaagattcacctaatttaatatcactcatattttgtttatataattcatttgaatttttaattaaagttaattctcattccatcgtattaaaatttaattgttgttaatatggttgcgataacattttatttatttccaaacccacctaatctttattttaatttatattttaattatttatttagcccacttgatttttagggtttattcctagttaatttcctcccatttgtgatcgatgaaatccgaaatcaaaatctaataaaatcttcgaataaaattggcatgatgcaatttatttaaaaagttttttttttttttgaagatcagaatttgtttttggagtctttgattttgttggtcgaattttcagaatgttacaccaatatactagctaataccctctatccgatgccctcctggtacttcgagaagccacccctgactgccgagttccttacgacagcccgtcatgaccatacaaccagagctaaatacggtggaataccctccccagggaattaacttagaattacatatcggcgcgaaggaatacccatactgagctgtcaccatcagcggctcacctctcatccgcaatatataacaccaaatattgatatctcgtaatctagacaccacgtctcaactacaagatactactctaatatcatcgtcataacagagtaattgcataagcaaacattatacccgcaccaaagcatctcccagataagctagccgtatattctgtataacatgaacataatgtaaagtaggtactcagatactcggaaagtatttcaatgccataaatgtatctagaagagtattctaataaaagtaaaaagcttacaaaagagaagagaaaagctactagagccatacccgaactcttccgaagacatccggactcctgatttctactctattcctattctaccagctagatactactaaactaaacttgaggtgtgtgagtgaagtgaggatgacaactccttttatagcctaccaatgacggttgtgacggttggaatggtcggaaataccctccaaccgtcattgggggctaatccacaccgtccaggcgaagccctggatcggatggcgttgaggagggtttggccgaaccccctggttcggccgaacctggggccgacccaatccagcccaatttcggctggtggcctcctccgttgttcttctctgcagacttgtgaattttggcccagtttgtcacgtcaattatgagttcttggcccattcatacataagtctggttctcgacatcgtccgattgatttatcttctatgttgatgtcgattctcctctactttagtgtcattctctgcataaggttagtatacctaatactagtggaatattattattctaacatatttctgcattgcaagcatcactagttctctattttggtagtattgacggtcgaaactgattgataacgactgtcaacatcaagcaagagctctttcatattctctcaagtagtttagtgttcttaagctagtggaataggaatagagtagaaatcaggaatccggaaaccatcgaaagagttcgggtatggctatagtagctttcctttcctcttttgtaagctttgtgcttaatttagaatactcttctttatacatttatggtattgaaaaactttctgagtatatgaatgccaactttacactatgttcatgttatactgaatataccgctagcttatctaggagatgctttggtgcgggtataatgtttgtgtatgcaattactctctcatgatggtgatattagtgtagtatttggtagtttagacgtggtgtctagataacgggatatcattatttgaggttaaatgctgggatgagaggtgggccgctaatggtgacagctcagtacgggtattcctccacacgtgtatatagtactaagttaatttcttggggaggatactcctccgtatttagccccggttgcatggtcatgacgagttgtcgtaaggaactcggcagtcaggggtggcttctcaaagtaccaggagggcatcggatagagggtattagctaatataccagatgactagaatatatatatatactatgtatactagaagtataggaatagattatctttctcttttctttccacttagcttagatattttattatgagaatgagtagcttgctgcttgtgtgacaccctacccttggattatcttaacccctgcttagactatgattatcacaagtaatatataaattattagtcaagttctctctaccatgatctccccacgggtttaaataaatacgatatccttggaatactctcgggtgaaatgctacaataggttatctgttcgcttgcggatgaactctgtaaccataatatatcaggagtatttctgtgccattgctggaaattatatttctagtaatgacgttaagaaatatcaacagtgatgaaaatggttttttaaaagttttgagtcgatttgtggtagagaatagacaaaatgtgtatatgaagttagtaataagtacttctcaaattttaatggaatacatacaatattatgtttttcaaatgagtagggttaatcattcgacatttcttaataaaaactatagctaaagagacgtaccaccatgaaaaactgcaaaacaccatatcattattatactttaataaagatttatactttagcgccagatttgtttccaccatatgttgtttactaccatacgagactcattaactaattctaagaatgtacttattttcacaaacttttttacactaactaattcgctagagtgcatttacagttgggttcagtggtgtatacatttgtccatcaattatacccggtatattagaatctctatcaactataaaaaatataagtagttttatgcgtattttattggattattcatgtttttccaatactacttggaaaagaaaatacataattctcgtgatgaattaagggttgtattgtagcaaattaactgcctaaaatcttatttatttatttattttcacatatatctatcatgtatgcttctcactcctcaaatagcaataaaaaatttcagatacttttagaatctcaatctcacacaaaataaacttaaaaatattcacttaaaaatcaaatctaaattctgttgttttattatcactagctagaatttaatttaatttttctcatcaatctattaattatgcttctcatagctcaaataagaaaagttatcaaaaattccaaatactttgagaatctcaatctctcccaaaattaaataaacctaaatagatgtacttaaaaaacaatgctaggttttcttattttaatttttacatatgtagatctaaattaacgctctacatttgtcaagtaatatttgacaccataaaatatgacataaaattaattgaaacattattatcgcgtttgctattacatgctggtgtcatttgtcatgatatatttatcactacaataagtttatgattaattttgactgtgcatgtgtagtattatttttaataagagtaaagtacacgagcggtctttaaacttgaagaggtgtgtcatctaagtttctaaactctcaaaatgcatatccaagtcgcagaacttgtcatagcgtgtcatctaggttccaaattgccacagccccttcaagatcctacgtggcgctgatgtggcacgcgacacaaacaagacgtagcataattttgactgacaaatgggacccatttaaaaatttcttgttttctttttttcttcttttcttctcttttttttcctttctactcctttctctatgacccgagcagaagaaaggaaaaaaagaacgagacgaaaacgaaaaagaaaaaaagtagaacaaaaaaaaaggacacatcacgtccatgtggcatgtcacatcagcgtcacgtagaatcttagaggggctgtgtcgatttgggacctagatgatacactttgacaagttctaagacctggaactacattttgagagtttggggacctagatggtacaactctgtaagtttaattaccgcctatacactttagtttttttataaaatcgtagatt

SEQ ID NO: 101533 - DNA, 1130 bp, Oryza sativa
atcgtaacgtaagcatgtcatgtttttttttgatagagattagcagcatgggaattttaagagctctaatccaatgtttaaaataacgggtccactaatttaagtaaaaatataaggttggatgcttttctttttttaagcgtcacgtaacaatataggagcgtttgctggacatataatagatttttagtatataatagatttctatgatttctctaatttatttgtgagccacgtagcggtgtaaaagcatttgtacaaagtttaattaacttttagtgtataatagatagatttagaagatggtttaaaagaacattgattgaatatttattatagatcttaatttaacaacatattgatatttgtgaagtaatatattttatctttatattgtagaaaatcatattttaaaaagaccgttgatttttatgaatgtatgttttttctgtcctttttatgtagacatgtgtatttggtttcttccagcgaaaattaggaaacttttatcgttttattttcacaatcatgtacgtctgtatacgtacggagagaaaaatcattagcatttgtatcgtacaaactcatgcctacgggcagtagtagcgcttgtatgttataaacatgcagaagttattattcccgtagtagcgcttgtatgttataaacatgcagaagttattatttttaaataataggcttgatctaatgatgtaaaataatgcgtcatcaatttaagtgcaaatcgacgataagattagattgtaccatgtgatgacttagaagcgtttgtaggagtaccacgtggtgacttagaagcgttcgtaggaagtttaataaacttttattataaaataataaacttgcattctacgtactcaagtagtaccttacctaactcaccataactcacctgttcagttaaacaaataatgaagtagtagatgcatattggaaggtgtaattttgttgattccctactactatatatgtttattgccataaatgtttgttctggagatgcacatgcctaaaatatttctatgatatgcattgcgtttgcacatgtattaccaccggagcggtagcatgggcaaattactagtacattataattaacgaacttcaga

SEQ ID NO: 101534 - DNA, 1221 bp, Oryza sativa
ctttgggccaaacttggcccaaaagaaaaggaggattattttttgctttttatttttaataaactctgataattgtttttgttgtttaataaatatttccagtgctctgaaaatttcaagtaaaatttgagggctccttttagaccaaggagaatttaacaaaaattctccgggccacattcgaatttttcttgtacgcattttagtgtttgccaatttcttttcgaattttaattaattctattattccttttagaaaatgatttttatttcgggatgaatttatcaggacgtgacagatctctagggacttaggcatttttgctttggcaatttgtgctcacaatggtgtggcccgatgctgttaaaatcctttttaatgcagttagatgattctttggaatcattacgatgcgaacagaagctgttaggcggcaaaagctgttcgggttgattcgagatgactagttttctaatggtcattctcttggcatgatatatgcttattttgattatggtgagggtcatagcctaggctatttagactcgttaattgccatgattcttatcatatttggtggatcatcttaagagtttttactcggattcttgtcaaatatgtttatttatggaccttttggagcgtttttcactcgggtttttctttatgtctttttggtatattaaagctaaagcagtcgactggatgttttattaaacgtcgcatttgctcagctatgtaaccactcggattggatgatatttgcaccttgactatatgtttagttttaaactaatcacatagtcgggggctacacctaattaggtgcatctaatcgatgcacctaacttttttatttctttttcgcccttcacagtctttgattttagtactcgggaggtcagagcagaaggagttgaagcactcagattattgctttagatttcaagagaaggctattttgtcgactgcaaaggtctcgggggctactgtagagattatggataccccatatctacatggcatgtatagtccgactgggtacagggtgccatatatagatagaatatctttatgaggactcgggttaagtttaaacttgtatgtcaaagaaatatacgagatcctagtcggttacgattgtattttatctgtaattgcatattccgttagggatatggactgtattttgtaatacagaccccttcccctatataagg

SEQ ID NO: 101535 - DNA, 574 bp, Oryza sativa
ctattctcctatctaaatttattgctttactttacatcatctgctcttattggtctggtagtgcaccatatgcccgtgctaataaccgacatatccagtacgggaatttcctcattttacctccattacccatttaccatttgtgaaatttttagggttgttataaaccgcgccatactttccacactccaagatgtcaataattcttttgtacgaaccatgttactcattcttttcattaccacgctctttttaattaaccaaggttccactcctaaatcttttttaatgtcaactctaacctcctcttgatccctccaaggttggttttataatgattttttatatttttcacccactccacttttatgccaatctttttcctccctttttccattttcaaattaaaacgtttccaagtttccaaaaaaaaaagatctcatttagatctttttttaacaaaccccaccatttgaaagttttcgaccaataaacgtgttttccccccttttttttctcattttaaattttcgtcaaacccttttacttttaacaaaaaacccatttattctct

SEQ ID NO: 101536 - DNA, 649 bp, Oryza sativa
acaacttctccaccaacattctcttcccaactaatcacaacctttaccattcacttttcacacggtacggccactactcatccaatcacaaccctctaccactcacttctacctacttttttaataatcgtgtccaacactaaaagttcttatattccttcttgaccagattcatagtactaaaatgcatcacatctatccaaaatcctttatattttggaatagagggagtatatatttttgtgacttcaacagatatgtcgctgaaattgaccatatgacaacgccaagagtgaggtgacgtgtcaataacaaaagaaccactagcacatctctatcctaaattgtaggcatttttaagatgggcatgtgtatcaagaaagttgatagaaatgattaaaggaaggttgtgattggttaagaatagaaagttgatgaaataaataaatgaaaaatggttgtgattggttgaaggaggtagatgaaaaaaaatagtttcattttaggacaagctactgtgctataaatagctacattttggaatagaggaagcagtacttagaaatcctaaaacaaaaaaaaaacagagagagaaataaatgatatccacgaaaaaaacaaaaagaattgccatccgacgtggcgaaag

SEQ ID NO: 101537 - DNA, 753 bp, Oryza sativa
  unsure (1)..(753): unsure at all n locations
gcagtgcttgaaatccatttganatcgagctggtacccgcctttcgaacacttgccgctacaaagacttggatcttgcaggggcggtagctaccgcgctgctacatgcgcatggcttttcccttggttgcacgccgcccactatacctttcttttacttaagtccaggggctatttgatctttccgcaaaagaaaaaaaaactggttgatcactaatgtatgagactgttgcaaagtaaatttatatgtcagcgactcaaaattaagtaacttaaggcgaagaatccgcatccatgaataaacattgcgcggcttatcttagctaacacaattctaactcatctcaaaatttaaatgcattttttaggtttttaatatttgattcatccatttctgcctttgggaaaataacatgacaagatgagaataatctataatctagttgatgtcacctgatgatctgaagtagcactacaataatcccgtaattttttggtggtcaaaaaccatcaagtataacatgaaaaccgccaaaattcattattctatcgggcgtctagggatattcatatttgttggctgcttaccataagagaatatttttttggtagtcggaccacttagcaaattaaaaatattacgaactttataactttgtcggtttggaccgataagatatatcttactcttgcctgccangaaaccccccacgaaaatttcttttttttgaccgtaagacccacaaggtattaa

SEQ ID NO: 101538 - DNA, 637 bp, Oryza sativa
atccatgcgtacacaagcatttataacccacatgcaatatcttgatttgctattggctaggaaataatggggatgatgtatgcattgagtttgttgctagagtaaatatagtatgagagagttattagcttttcttgatcttggtgtacccatgaaatatatagatcaatttgaaattgagggagtaagggcacccgcaatggttatctataggctctctataagagatccatgtcagcatattttcctacttggaatagattaaatgaagagagacatagcaactctatccccttccctggagatagtgtattgatgaaaacgacacaatgcgttagacaccttaccatacctacgtatacatcctattgaggagaatgactattaatttatacgatggctgatatgtcttgtgatatttggacaagaactttgaagcttttattcgcgacggatcattatctcccccttaggataaaagggcatttcacgacaaagctttagcaactttcggtattatctgaaagggtgaaactacaaatatccagaattccaaccttaacatctagtgcttgatatttggatccctgatatttcttaaccgctttttctttagagcaacccagttactgatggt

SEQ ID NO: 101539 - DNA, 595 bp, Oryza sativa
attccggaagtcttacgtattttttaattagggtatagatagatggatgtagatatagattcttccatatatccgtaacaaagcacgtgcgtcatagcaatagattaatttaacttctatggatggaaagttcttatgtcaagggtaattagcaccaagattggtaaaataattgtctgaatgaatttgcaggcaaactagtttgacttagggaatggtgatgcacacaattaaggttaggttgctccaacctgagcttcacaaattctgaagcaagggaaggggcaagcaatcactattcaccgcccattttaagtaaaataatattttaaaaacaagttggacacaagaggagaagcttggtgtcgattaaaagaaattttatggtacttcagaaagtacatagagtattaagattttacacattaaaatacctagtatctagagatattaaattttacactagaaaatatgatatctcctgtaccttgtgaatggttaagaatgataaaattatctgtcaattaatcaataagacatgtgaatgtgagtcaaacatgagatccctaggatgaattcacacacatgacacacc

SEQ ID NO: 101540 - DNA, 621 bp, Oryza sativa
tagcatgcctgacttagatttcaccagcattaacaaaataaaggaaacaaggggaaaaaatacccacttcccataaatctgcacatgttgggtaacctcgtattgcatactgaaggctctgtatagcctctgaccatttcttctgatgaacctaaatgccccataattgtcaatacttattgaaaatacatcagtgcataatttagcatgcataaacaagaaaactatgaagaaaaatctagagatgttaaccgcataactttagctttaagcaaagcacatagtctacttgttccttgctccaggaaaaaacctacattttcctaagcaagcaaaagttggagattatagctgggcaatggacattgttaatttaaggtttggtttgaagaagaacggggtgttctttttcctttgggatgatacaaatcctaaggatttggatcctattcttcctatcaaagcaggcctgacaggctgatataatcacagctttgaataaagataaagctccaaaactaagtattgcagaaatgcgaaatgtcaagcctaaacttaccatgttggcctataaatttcacatattctctatcaacttatccaaaatgacaggaacatgcc

SEQ ID NO: 101541 - DNA, 603 bp, Oryza sativa
tcaaaaaaaatggcgcgagacgagacggccgacgtgtgtgttcccaactgattaactaactaaactaactccctcgcgatgatccagagctagagctgtaactatattacccacgaacacgcggattaagtccacgaactaaacgagattatgtcgcagattgggttagtttaggacgttatttaaggatcctaacttgtctaacaaactggagatatgatgctactctgctcgttataaagattagtcgttttcattttgttcgggggaaaagcgcgggtccacggctgacaggtggggccctcgaagacttggcgggaatcaaagtcaagtagtcaactgcctaaggcagtgggacccaattgagacgttaattggttttgtatgggaagacttgtgaaaatatacatatttggccccatctcttttcgtttatatttatcagctaaaatttaaatttttaatattaatttagagttaattttagagtttttttcattgttgtttgttttttaatctttatttctagatcgtcgagaacacgtatataaaagttttatttataaattattttttattgtaaatatgttgttttgcctttgc

SEQ ID NO: 101542 - DNA, 604 bp, Oryza sativa
caagtattaaaaccggtgttaaagaaagattgtaaatgtgtcgtccttgtggcacttttgctatttatcctgaaggaatatgtttcgataaagtgaagaatcctccgaggtaatttataaatatatactacaaattaggtcttatttgtttcagcttaagattattaaatataatctagattattgagccagattactataagttagattatgataagctaagttgttagctatttgtttttttattaatagttgttagccaccaaataatctaaaaaaaacaactttagagtgtattaccatattacagtaatctgacttatagattataataatctatcataataaactatctgtttgtttcagcccacttctaacgattcaggttataataataataaactgaatcatacaaggccttaaatacctccctccatttcccaacgaaaaataataataatcttccatgcccttatttgttcttaacagtataagtggcgtcccaattctaacaaaaataaccccttctacattagtcaccacccaagtgtttcacgtactactgctgttgctattataaatacttcttttgaaaaaaaaatat

SEQ ID NO: 101543 - DNA, 615 bp, Oryza sativa
ccatttttgcatttcaaggagcatagatatgatgtcgattctaacaatataactctgttttacattattcttaacaatataactctgttttacattacagacacaaggaggtaatttcctgtcatccattagagaattggatgaccaaaatcattcttcttttacatttaagaatcaatacattcaggagggccatctcggccatccttgagttaaaagaaaatatttcttccagcggtttatgttaatctgttccttttatttattggttaatgtaagaactttagcttttgtcattctaatgttaacatgaggaattaaggggcctccaattagtaaagataaatatatttattgtgcacttgatttatcttaccagattctccacttatattgcttacggccagtccaagcttgccaacattttgcactctaccgagcttgcacgaattctgaaggtagtgttcttatttgctaagcatgcctatgagtaaattttgtatgttgtctctgtttgcatatgattatagccaaatctatgaatcataagttggaaacccgtaagtatgaatagggagatggtgtgaacatttcagcaaatgcgatccatcccgg

SEQ ID NO: 101544 - DNA, 710 bp, Oryza sativa
  unsure (1)..(710): unsure at all n locations
atgtcctctaaataactgctcacaagtcatgatcagaagaataatgacaactatgggctaacaactcaagacatggatattacagtactggcttgtcatgaaaaaagcatcaatcaattaatagaaatcgttatagcattaggggatggtctcctgttcctgcacaattaaggctgtcaacttctgatggtcgtgtcagatctttttaagctttggtgttaattagcatcttataccatgcgtgcacaagatcttgcagagtttccttttagctcttccgaacaatgaaggtttctcatgcaagcaagtaatgttactgatggggattttttttgttgtttcctacagtagttttcagctgcattgtcaagcaagagtactcctttctgttgcttctacctcgcacattcaatccgtattaacatctataaccaatctgttggtagttaacacagcagatgtactccatccttatcagaagaaccctctatcacaatcaatgatttttttcctttaactgggccatgtcctttaaatattaatccttccaaattttcctaaaaaatattggttcaacgttcctaaaattccaattttcaaaaaaaaaaaaccttctttttaccatatggtatatatattaaggcatatgcgcaacttntttaaanaaattaataaatggtgtaacaatgggacattcggggcaattaatt

SEQ ID NO: 101545 - DNA, 809 bp, Oryza sativa
  unsure (1)..(809): unsure at all n locations
ccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagcctttagcccataaagtccaactactaccaactctcctctgccctaatttgtctctcacagtcagcctactcccccatcccacaccgcgccgcctccccctcacgccgcttccattcctccccaacctcatctcctccatcctccccctcatgccatccgctttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatgggtaccgagtagntgttcatcttcacagct

SEQ ID NO: 101546 - DNA, 718 bp, Oryza sativa
taattttcttgtggtgtttcttggcagccaaagtaagatatattcttatcggtccaaaccgacaaagttataaagttcgggatatttttaatttgcttagtggtccgactaacaaaaaaatattctcttatggttagcagccaacaaatatgaatatccctagacggccgaatgaataatgaattttggccggtttcatgttatacttgatggtttttgaccaccaaaaaattacggattattggagtgctacttcaaatcattaagtgacatcaactagattatagattattctcatcttggcatggtatttttccaaaggccgaaatggatgaatcaaatattaaaaacctaaaaaatgcatttaaattttgagatgagttagaattgtgttagcttagataaaccacacaatgtttattcatggatgcggattcttcgacttaagttacttaattttgagtcgctgacatataaatttactttgctacagactcatacattagtgatctaacagattttttttcttttgcgggaagatctaatagtcactggacctaagtaagaggaaggtgtagtttgcgcgtgcaaacaagggaacagccatgcccacctagcaacgcggtagctacccgcacttgaagaaccaagtctttttaaccgcccgtgtgtctaacctccctggtttacgccaaccccaagagcttaattaagtttt

SEQ ID NO: 101547 - DNA, 640 bp, Oryza sativa
cggttacataccaagaaggaaaaagtatacttaaggtccctcaactagtcatcggtataaaaaacgttctcgaaccacaaaaccagatatgcggggcccttaactatacaaaacgggtcacccgagatccttcggtggttttgaccccgattttagtctacgtgacgactgagtcagcatggaccccacatgtcagctggccacgtcatcaccctctctcctcctcaccctttctcctctctctctcactgtctcacactcttctcgtttgggtaggcagctggggaggatgtcggagggctgttgccttcaacggggctaggtgggacgagggcgtcggcggccggcgacgggcgacacgacggcggcggctggcaactggcgacgcaccgccgttgcaaaggccgcaggagcggaggtgggccgccgtcgagggaggaggtaggcaagcaaggggggcggggaggccggcgatgacctcctcaccggctgcggggggggggggggggcaaggcgtcggcggcaacgaggcggttcttaggcgcggccagctcgacccgtagtctctcaagctcctcgccgagcggcatggagggacgacacggcggggggaagccagtcgcatcgtcgggtttgattt

SEQ ID NO: 101548 - DNA, 536 bp, Oryza sativa
tgtataaacagtacacatgtctgaagcatggacagtatactatgcagaacaagaagtgacagataccaaaacatattaatagataaatgatacgttttcttaaaacataatttcttacgctgtaatacctccgtcccaaaatacttattgctttgagtttttatttgtaacttttaatcattcgtcttattaaaaaaattatgaaattattatttattttgtttgtgacttgctttattatcaaaagcattttaagtataacttatcattttatatatttgcactaatttttcaaataagatgaatagtcaaacgttataataaaaaaaagtcaaagcgaccactaatttgggacggatgtagtattgtttagatctcttgtcctaaactagtatttgttaagtttatttattaaaatatttaattaatatctatagtcttattggtaatcattttcagtaatccaataaatgtattaatactagtatagtaccaatacattacagtaacaaactgtacacatctctgaagtatgg

SEQ ID NO: 101549 - DNA, 513 bp, Oryza sativa
acgtgagatggggccgttctgtgccgtcatgtcctgcaccgttagattgaaatcgtgtggttcagataaaggaggatgaccccgcaccagattcatgtgtgtttgggccgtgcaacgaatgggccgggccctttagtcgcgatgtctgcatatgtgggccacagcccacagccccagtttgagcactgcgcgcggcttctgttgttgcgctccggatcgattcggttgtggtcacaaacagaaattcagaattgatgcttcgccatgatatggtcgtcagattcattagcttgatcgatcgatcgatcttacgtgttcatagatcagaaagaacgatcatattaaaaatgaaaatatattaattgatgatgatcacaatgcattggttatacaacatcaaattacaagtgagtgattccaatggtacaacaaattaatgcggatgcaacaaattaattaaactaacacaaggggggataatgggtaccgagctcgaattcgccatatagtagt

SEQ ID NO: 101550 - DNA, 510 bp, Oryza sativa
tgatgatgtcctactgaacaatcgatctccaatcctaccaactaataaacaatctaatcctttttatcgtcttttgcacaatcactcgaactctagggaaaagtgagacgatcaaattaagcaattcgattcataattctctcgagaaagcataaggtcaaaccatttttttttttaaaaaaaacagaacatcctctatcctgtgcattaatggcgggtacgtgcaatgcacgccctctcagtactagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgctaatattgattcaggcatgctcccctt

SEQ ID NO: 101551 - DNA, 579 bp, Oryza sativa
aagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaaaacaaagactg

SEQ ID NO: 101552 - DNA, 534 bp, Oryza sativa
gttagtacttaagcatggtctaatggggaaaaaaataaagcttcctaatagcgaaaatgaagtgtcgataattttgatactaatgcaactaaagataactcgtacagaaaaattactaaaatagctaaggaaaaatttaatctctcttgctaaggatgacttttggtgcttgttttgactaaactaatagtatatacacatattatacctattaaattgcatattttttgtcaaaaaaaataaatttagggatataactgtgccccatatgtcctattgagatcccccttctctcgggtgggtgcagtggtgaagatgctatacatcacttcacctaccaagccaccaaaaggttctatgaatataaatgtatttttttacacaaccatattaatcaatctacactcttataatctgaaaatacacattatatatatatatatatatatatatatatatatatatatatatatatatatatatatatatatatatatatatatatatatatatatagaggggtgtatatatata

SEQ ID NO: 101553 - DNA, 1160 bp, Oryza sativa
tgcaccccaccatcgtccaggcccaaaccaagcaagcagcggcagcaactcgaccccagatcgatcatcgccagacactcacctgctagttgttggcgccgcgctcgctcattcgtgcgtactcatatactgtagcagcctcgtgtacacacacacacgcaatgctctgttcttgagagatctggattctgaacgaacgaacgccggcagcagatgcttcttcagagtcaccgagaaagaataatttggggttgggttggttgaggactcttgccggtcggtgacaatcatggagaggagagcaaagtaagcaaaaaaaccgtgtctcgctcgcgagagagcccatatcatatggcgtgcagatcagccaggaatatttgagtaaactaacacccaaagtactgcaccgtactcctcgcgaagatggcacagctttcatccatcgtgtccctgttattaggcatctgcacgcatggagtagtaaattacacgcattgcatctaagagcacccacaatggtaaagtaaggtgctctctataaaacatgtacatctcataatagactagattaatagtaaaccacctcaatagtatgtctacatgggtatctatagctctctaatacattgcctctttttctctatagactatctctaggttagtagatagctttgctctctctcttcatttaatctctttcaattaggaaaatatactgacatggatattttatagagagcctatagataactattgtggatgccctaattagctgccttgatcattaccacagcaaagccaggcatgcccaacagtaatctaggtacccacactgcgcgcgcgcgcacacaactaccttgatggtatggcaccggtaattaattactcatcgctgttaagtctgtatctgatgagaattgtcgaggaacgacgacgtagggtgaagtgcagtgctgctactgaagattctacatggacatgattacagcaggtgatgaacagaacataaaaagttttgtgcgagacgcacatggagatttcaatgaaggataaggagtgtaaaattaataaagatttttagagccagtgaggcgacggatgagcgatgcgcactggcaggatggatgcattgccggatatgttcagctcatccgcgaaag

SEQ ID NO: 101554 - DNA, 601 bp, Oryza sativa
tcaaaaatcaaaacaactcaaccaaaatattgcattagaatatgtaaaattatggaaagataagcctaattaacttacatctcttttattctcaaaacaggtaattcttggtgatatattatgtacggttcaacttacagcatatttgacagttgccaactgccagctccatacacaaaatagagtttaaactgttaacatttgacatctttatacataaaagtttgttcagttgtaagattctggatgcttttattgttgttgttatttcaacttcctaaactattatttctcagttcggctttgcaattttttatgatggtttacaattttacaagtgctggcctgctgggccttgtaagtgattgtctctcagttcataactttcaatctagacatatggcattatcaaaattttaagaacagaagttacctttactcctgggcaaaagctcattatagtataatatgagcacatcaatgaaaacaaactctgaaaggttcttaataagcagggccggagcttgggctcaggaacttgagcacaaagatcactatatgtaaatctggaaaggaaacgagaacagattagagagagaca

SEQ ID NO: 101555 - DNA, 549 bp, Oryza sativa
  unsure (1)..(549): unsure at all n locations
aaggtgttctctataaaacatgtacatctcagcaatagactagattaatagtaaaccacctcaatagtatgtctacatgggtatctatagctctctcatgcattgtctcgtttttctctatagattatctccaggttagtagatagctttgctctctctctcttcatttaatctattccaagtaggaaaatangcnngacggatctcttatagagagcctatagataaccattgcgggtgcccttactccctcaatttcaaattgatctatatatttcatgggtacaccaagatcaagaaaagctaataactctctcatactatatttactctagcaacaaactcaatgcatacatcatccccattatttcctagccaatagcaaatcaagatattgcatgtgggttataaatgcttgtgtacgcatggatgcatgcatcaatgtccatttattcccgggcccaaatacggaatagacctaataaatgaacccaaatatgtaaatcatttaggaataacctcaaaaaaaaactatatgtagatccattt

SEQ ID NO: 101556 - DNA, 737 bp, Oryza sativa
gactaaaatcatttttagtcccggtttttaatggaaccgggactattatggatttgggtcgaccgaccaaagatagtttgtgtatccttcaattgatgaatgatggataccatacatgtgagaacatactagtttcctcttaaaaaataggaagagtatccttcatatatagaaagagacatgtttccaatgctatttatttttctttcactgctatattgtacttttgtaatagaaaaaaatgcattattatacagtgcttgtaaagtgaccagaagacagaaagagaaaacttgaaaatgacacatgcacacacactagctagctcaaacaagataatgtttctagcacttaatcaactcctatctagctagcaatagaatagactacagtgcattatatatcggtgtgcagaaagtggaagctatagcttactagctacttttacactggtttctcaagtggggcaaaacagaatcgcccaaaagataggatacatgcatggtgcacacactcatactaatataccgtacataagctagctttgcagcatgcatgggaaagctagcactctccttgccatatcattttttgtttgtttcacatcactgctctctttgccatctatctacatcagcgcatatacagttctacacatgtaattggttgctaaggtttttcacctaatttttgcaccatatacgtcaacgcgtgctgttcttttcggccttgaatct

SEQ ID NO: 101557 - DNA, 688 bp, Oryza sativa
ctgtagatgataaagaaaaagagaaaatgatcctttggaaggtcgcaatatcactaatcgggtcattgaaacattttggtgagatattatttagatatagaagaaaatctcacaggctctgcatcaaaagatgcacaaagccataatcttattaaatcaagtctgtgcatagcagattgaaaacaagattacaacaaacaagagtttctgtaaaagattgaagcagctctcagcttattacgaaatctccatctgttgttcttaagaatcaattaaaataattcattttggtgagctataagaatttgttactaggggtagaacaatacaggagtaattaggcattagaattagtcccccaaaaagatcttcacggattggatggtcattcgtggtcaacaataagtactatcatttcagcacgtgctcacaattcaattctacagcatgtcatggctatgttctatattgcctgaactcgaaaagatacttacagcaagtataataacacatgagccagattatgaatcatcatgaaaccaaaaaaaaaaagcacgtatagttcacgtgtaattttgctcatgtgatgttgtacacatatagttgcacacaaccttaatggaatggagggagtaatcctgcccccacttctaaagaatataattgcatatattgttgcacacaacct

SEQ ID NO: 101558 - DNA, 528 bp, Oryza sativa
tgcaatttgtagccgccaaattgatttcattcttcctgaaaattacacaaccgtgttgttaaatggacagggtcacataatactgtcttgcagtactcacctatttgggtggataagtacagaattaacagtgtttcctgcatggacaagggatttccttaccaccagcattcatgatattgttgagctgattaatggtgtaaatctatggctacgaattatttgagaaaatctactagctttccaaggtcaacataataatatgggatgaatcactaaattatgggtccatatattcatagtgctatgctacaagagtaatttgtaggggtaacttcctcatgtacagacatacagttcatgaataagttgtaagccggcctgcaaatcctgataatgacttggctcattttaggtgatgcataatacatctttgcaaaattatgtttaaattgtatcaacactgtatcatgcacccacattgatgctatccttcaaatactgcatctgctgagatatgtttgatag

SEQ ID NO: 101559 - DNA, 811 bp, Oryza sativa
ctctcattgcttctatttcttagctagtcgtctcgcaattcgttgcctggtcatcatcgtggggtgtccatggcaatgctcatccccatgaacagtgatgcgaactctcgcggcatcccatttgacccccacacccctgccttagtcgactacgaccgtaatggtgctagatatcccatggttgcaagtttgcaacgagaaagcggtgctatgcttgaccatggcagatccagcatggatccattggctgtggagcatgagcggttatattaaggcttaggacctagcgaattcatcggtgtggcgatgaagcagcaacggatccagtggccagggctgaccctaacgagataatgggaaaagatgaaaggatgtgtgatgtgtcagtggcaagcggctcgccggctgacttaggcagtgtgggacacgcccccttcctaatcatgcacacacgcagggggatgaattgccatccgtagcgcgcgcgcgcacactctctctctctctctctctctctctgagatgttaggattgagtttagtgttgtgaaaagacacataacaatgcactaaccttttattactcctatttaaattttgatatgtctatccacatatttggtagattttagtaagctattggacagcttagatcgcataaaaattatgtgtgaacaatagccttattgtatccccccctcccctttctcccaggcttgcatgctcacctctcacccaacattgtggcctccccaatccccatcctcgcgacgagtacccctcctctctttcacaccctcccattccaagct

SEQ ID NO: 101560 - DNA, 508 bp, Oryza sativa
tcctgcagcccagaacaaatcatttaaattttgaaacatgtttacatgcatgctctgttggtttgtcagtacacctaaccaaccgttttaccatacacctacactgttgttcttttaaattgagacgtccgattttttatttttggccggacggccgatggtaagcatttccggttttgcactgcgggtggcacggtgctctgcttgctacgcggcgggtggactgcgcgtgtgcgcagcagggttcgtggtcggtttttgtgaaatttgatgtttctttctttctttgaacaaaccgacaccagcataccaattttattgaatatagtgaaaaggaattttcgtacataacaaaggaaaaaaaattaatgttttatacgaagaggttgccatgggactaaggtaaaagctccgctatgtggttggctccccacatcgctcatgttttcccctccgtttttgtttggaatgctgtcattgacagtcctatttgctgaaagcctatttg

SEQ ID NO: 101561 - DNA, 567 bp, Oryza sativa
  unsure (1)..(567): unsure at all n locations
atacacctatatgctttcgtagcggcgacctggttggatcgatggatctagccttcacgactagaaaaagcattttcgccgatgttgggtattaattttcacaagtggatatgatccttagaatcaaatagccacctacaaaaatataaattagggtgaagttcactgtctattttcgcaaacggaccacttaagccgtgcctgcaaaaatgattttcgcaggcggaccacatgagatgtgcctgtgaaaattagcgtggtatatatacagtgacacatcggctgatatttttctaagtgtcatttctcccctcactcacctctcctctcccctccccttcaccttcccgaccgccggcggaaggggcagacgtgcacgggacggccagcggctggcggcgggtcccctcccccctcccttccagatctagccagaggagggacggnggaggccggcgcgggcaacggcggcgactacggcacgggcggcggcggcgacaacggcgcanggcggggggggttcccctcttcccctcccttctagaactatcccaaaggagggagggg

SEQ ID NO: 101562 - DNA, 553 bp, Oryza sativa
cctttcttataatttttcttgttttttaagccttttttatccttttggatataatttttttcacggcctttttttcgcttttttttacgtatttttcttttttttctttttttcgttgcatagaatcagatcttatttttgctttcttttattttttttacgaacgacttttttcgcagggaatcggacttttcttttgggacctttttcgctctttttttttctttttttacggacgtttttttcaccccttttatgccaaggggaaaaaaaccaaaatacagataaaacaaacattctgatacggaaacatatttaattaaaaccgattctaacatagatgatgtatcaaattttcatgcaaaaacacattgaatttttataataggtatagatatagatgagcaaggaaacactctaactcgacgattagatatattattatgacagaaaaatatgcttgaaacttttagtaatagaaatgcattatatatatctatatctatatttatatctgaatatgtcactacccaccatcattaccatgttggtc

SEQ ID NO: 101563 - DNA, 768 bp, Oryza sativa
ccctaatgtttgatgtaataatgattattgttgcagtcaatactttttatatgttgtacctctttagaataatttgtgaagtgggttgaaacatctccacaaaagatgaaagaattatttttaaatagtttaacataagtttgttttcttctagaatgcatatatatttttatcaaaatatattcatgtgagatcttgttataaatgatagattggatatatattttagaataaaattttgtttaaagtttgattaagagagagaatgtaatggtgcctcaggccaccttggcagccagctctactcctgcatgcatgcatgcgacaaccttgcccctccaacgcgtccctgcatacagacgaagagcagcattcgatatttgaaaaaaatattgaacacacgatttgtaacgtccgatttaaaaatatttcaacataattaagtatttgtgcaaaattctaatggtataattgaaattttgatcagatatataattttggagaaaaatatttacaatttgaggaaaaaaattaggcacgtgtaataggagggagagggagagagagtatgcaagcagcagcgcaagcaaaacacaagccgaacggtccgatttttggtgtgatgccgaacggtccgagccgtagcgctctccgcgcaaaacacaagctatagctggtgagatcggcagggctggcgcggctgcgcgcgcgcgcggccccggaatccggtgcgagagagggtgatggcgccatctcgcttgccggctc

SEQ ID NO: 101564 - DNA, 762 bp, Oryza sativa
tacacaccgtttaatggttggagaaacgtaaacgtggaaaacaataaggtagaggttaaaaatgttgagtgaagaacacagccttagtgttttaaaagagcacttcgtttgtgcgtacgcattgttgttttatctcgggcacaataacttgcatgtactagtgagggggttctaatctttcgagatgatgtcccctcctgtatttttttcttcaaattcaatttaagtggttgtgagaaagtttgttttttgaaaaatgtaaagtacaatgacatctatcattccacaaaaaatatatgctagggaaaaaaagaaatttaagaataaatagtactatacagtttataggttggatttgttttttctatttctccgtatgtgagttgagtttggtttaggttggtggagtgatatatgtatgctgtatgaatattgtcaatattttatggattttctcgcactccctccggattgataatacttgtcgttttagactagggcacggtcttaaaaaaacaactttgaccattattttttattataatatgtataaaattgttagcaaatatatgatcttattaaagtactttttaagactaatctatatatgtagtcaccatatttgaaagacaaatattttaaaaataattcataatcaaagattctaaagtttgacttcacccttgtccaaaacgacaagtattatcagcccggagggagtagctatttaagtggtgtttgaataaacgaggggggctgcag

SEQ ID NO: 101565 - DNA, 637 bp, Oryza sativa
ctgcacccctttatatggttagttgaaaaatcacaattaattcttcaatgattttgtcgtcatcaccaatgcggatcatatggttggcaaagctgcctccaaacctatcgcatggctttataatttcaggaggaaattagagtaatcaaacattgtaatatatatccacatccatcttaaagctttgattccttgtgctacatgcatgacggccagtaaagcatgctgtggcaggagctggagacagagcacatcagactgcatatatattttctaatggagcatttagcacattcggtttagcaagtaaagcaccatgaacctagcttccatggcagggtagggcacaactgcacaagcccaccacaaacaagcaaagaatccatccacactactcctacatagtacatggagtacatacaagttacaactactcgatcagcatcgccattgctgcatcaccatcacctccatgatcgatctcatcatacacacactgacagaagaatacacgagacattcagacattcagagagaggagtgatcactgtactgtacagaggctagctctagctaggtagctaaggtaggtagaaggtagaggaaataagaagcatatatggatccacggctgcac

SEQ ID NO: 101566 - DNA, 626 bp, Oryza sativa
cggttaccgatcatattaatccatttttcaattttttagactaacacttagttaatcacatgttaatgggttaacaccgtttttcgtgcgacccgaactcagccataactttggatggtatgtggacaccaaaccaaagcaagtagattgatttaattcgagtatttggatgatgggctgtggattcaggtagggcttcgttttcggcactgttccctcgagtctgggggcccatgatactattcgtcggcatcgccggtgatacactgtgttggggctgcgaacgggaccgctcgaaccggccgatgttggttcctgtcgtcgtcgtcgtcgtggtgatgcgtgatgccaataaaaacacatgctcgatggccgatcgatcttcaactgtccggagttagtaaaccaatcaaatgagactttgatcactccgcagctataggatctcactgtcacgtgtcagctccaaaattcaaggatttgatagcttggatcccgagcttgtaacctgaaccacgtctgtgttcggttgggtttaaccttttctcttgtatggaaaaatacacgatgaattagcgtatgattaattaagtatccgctttagaacttaaaaatagattaaatat

SEQ ID NO: 101567 - DNA, 551 bp, Oryza sativa
catagcattattgagctatccagtttgcgataaaattccttaataaatacatactagtactgattaaagcaccatgcacagaacagaatgttggaaaagtggcaaaccaaaaatagtcttttcaggggaaaaataaaaaagaatgaaatttaacaagttttctagttaacaaaaagtatgatatagtaaactgaaatcatcagatgttacaaacaaagaaagaaaagaaagacagaaaattttacattccaggattatgtataacttcagaagcagaagaaattgaaaggagaagtatttgttgatgctgggtgtcaacagttttcaaatgcccataggcaaaagtattctttatcctcaaagatgcatgaacttgacaaatccaaagttccaaaccaactctgagctagaaagcataatagttaaacagtacagaactgccagttaaacaaggaaaaaattcagaaccagactacatcagctgcatgccaatggcaacgagcgattaaaagcatctcatggagatcgcttgatttgctttgatattatgc

SEQ ID NO: 101568 - DNA, 697 bp, Oryza sativa
gggggtgaaacatttcttcattgctatttacttgatggcacgcagttcagatagagactgattaattgagcagaattccataaaccacctatatggcaaaggaacatgagcaatcccagaattcaagagcctggtaatttggacctcaagtcctcaactaaaaaggaatatatgagcaatcccacaatcacaagataatttacacaaccacgttgctctgtgatgtatttcttttttatctgtagaggtatgctaagtagctcaggtataagttctcttcctttttgttacataccaccacccagccttcccatcggctgccattgctctttccaagatcacatccagtaagcctactattgaccaacccaaatttgcggctataaaaggacacaataatatgagttggatgaagaggtgaaatcatctctcaatatagattaatgtaaaccattgcctccgatatcaaacgacaacagatgtacgttttggttccaaaccatttgttacctacctcgatcatatggtcaaaccaaaaaatgcttcaaattattaaaagctagaaccatgcaaagttgtcaacttattagtatgtcatattgctatgagaaattgaagaaataaacactaatgtacaggaaggtgtagtggcaattttaaccagcctaccaatgcattagggttctcatagattttt

SEQ ID NO: 101569 - DNA, 614 bp, Oryza sativa
gaacaccaccgagaccgtgtttgttctttgatcttagaaactaatcctttccaggaggaaacgtcctgaaggttacaacccaaagcagctaattcatgcgctaccttattacagtttcgtgggcagtaattaatagagaaagaataaaaacagctagcaatcacatgcttgatctcaaggattactccacccatcactgataagttgaaagagttactctggagtaatccttgagatcaagcgatggaacgactggtgaccagtgatttagctggatcagttatataaagtttcggtttccctaaaaaaaaaaagaaactaatcccttccgcatgtaaaacgagcaccggcaacggccatcgctctatccaacatgtcagccagcgtatagcacgaatattgttcgcccatccaaaatcctcggaaaacccgccgtaatcccacgaatattccgtccacaaggctggaaccaggtataacaagcggaacgcctccagtgtcgcggacaggtgggtccatgtcccagcatcgcggaggtgtgtccctacatgtcagtgacgggtaggtgtcgctaccgcgtcctggaaggtcatctacttggttgggatagcgta

SEQ ID NO: 101570 - DNA, 769 bp, Oryza sativa
ctatgctgacgtcagcaaggggtgaggcgcggaccgcgtcacaaaggggcgggccccacacgtcagcggcaaagcccaccgtggaccgagtccacggcggcagccggccacgtgggcgcgcacccgacgctccggatcggccggggccgatcggacggccgggggcggccgagcggcacgaccgggcaggcacgcccacaggcggcggcgaccgccgagcctagaccaccggcgacgacgccggcggcgggcggcgacggcgcgagaggcggcgagagagtggagagggaggctgttctcaccgagcgaatggggcggcgagacgaagacgaggaggtggccggcggcacggattaggcggcggcgggctcaccggggatcaaaaggaatggagcaccggtgggttttcggtggtttggagcggcgaccgatctgtggcttgaagcggccgagccggtgaaggaaacggcacggcttggcggtggccagggcgacggcagaggtgcgactggaggcacaaaagtggctgtggctcgggttcaccgtggagcgggcggctcgggggtggaatggaggagcggcgtggtggccgggcttgccggcggagcagcgaagctagtggtggtggcggcgcggcttgaggtggacgggaacggcggcaagaggctgccgaaggcggcgaaacggcggcggtgctcgggtgagcgatggaatcggtgttttgattgtggtttggggaaacggagttgcggacgggggctgcaggaat

SEQ ID NO: 101571 - DNA, 1031 bp, Oryza sativa
tgcagcccggtcttttaaagacaacggcagatatgagcagtattgaacttcactcgatcgtgctgctccagtgctgctcggatctcgacgcctcgttggcgcgctagcaagtactccctcagtcccaagtgcaattttgtacggtttatatatacaaagtttgacagttcgtcttatttaaaaaaatatataatatttttattgttattagatgataaaatatgaataatattttatgtgtaacttttttttatttttttataaattttttaaataagatagatggtcaaatattgaacacatatacccacggctgtacttattttgagatgtaggtagtaataactttaaatacttgtactcgtagtcggacttgaatccctcccgatttgttactgatgtgcgaaaaatattcgtactcgcatctcgcggtacgatccgtcatcggtggaggaaaagaatagtactgtcaatattttgatagcagtacaactagcaagcactactaattttttggtaaatattggcattatcaattctgagacaaattttataatacagtaaaaaaattctagatctatacttcaatgaatcatcagctttaccaaccatatatgatcaaactaaactatcacatttactgtttaaactaaactatcacatttactgtttaaactataaaaagttagtaggatattgttttagcatcaatccaatgcaaaccagtactcctactcttaattcttaagggacactccttgattattagaacaaatttaatagtaatagtatagtcaactactaacttcaaattatctatatttaatttaataacacatttatataatagttatctactacatcattaatatataatctcacatctcacatatacgtaatgttttggagtctgtatctggctataaatctttaacttatttttcttctctcttctctcttatttttttcgcacgtgtttatagctgatttataaagtagtacttgctcttggcatccacaatgtatgaaaa

SEQ ID NO: 101572 - DNA, 710 bp, Oryza sativa
ctgaactttgcagcatgtttggctgtggttagatctagggatgaaaagttctaacatatctcacattggatatacggacacacatttgaagtattaaacatagatagactaataattccgtctgtaaactgcgagatgaatttattaagcataattaatccaccattagcaaatatttactgtagcgccacattatcagatcatggagcaattaggattaaaagattcgtctcgcaatttacatgtaatttgtgtaattagtttttctttcttttttttttgtctataattaatattctatgcatgtatccaaacattcgatgtgatatggtaaaaaaatttgtgggatctaaacatgccctttgtctctattatctgttcatcaggctatccggttgcccatggtagcgttggcttgtgtaggcggcagctagcttagcttgggttggcttcacccaaaaagagaacaagaacaaaattgttcagaagaaagcagctctaccacttcgactcgttcagtcctcttcagatcaacccccttttcttctgaaaagcttcttcaagtcagagcatttacaacgctctagagtggctgagagggcagggaacctctcctgcccacatcaatgggcgaagctgccatggacgatattgaaatgtcatgaaattgccctatcacagaacgagcaaactctccatctaaacttaat

SEQ ID NO: 101573 - DNA, 601 bp, Oryza sativa
aaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacct

SEQ ID NO: 101574 - DNA, 636 bp, Oryza sativa
gataataaatacttattaaccgtacgttaataaatttctatagttaaacgtaatatctttagttgagttaatttgttagctactcattccgtcacataaaaaaccaacatagtactggaagtgacatatttcagtactacgaatctagacataactttttttagattcgttgtatgtaccacatccaattctaagtttatttttttggatggagggagtatcatgtacgtacaatcatacatatgcattaccacattagtatccaaatccctgcctaggaataattaactatttgtcacttttgcaagtggtgataaatgatttgccagttgatctacatatcatagatacatgaggactcacgagccatagactactagtggtaataaatcattaattaccaattctaaaaagtgacaaaaaaaaaaggttaaatgtcccccttgcccaacctgaccgggggagacacgcccggacgcccgcggtggccggtgccgtccgagtccggttcgggcgcttgctttccacgagtctagtctacgacggcgacccgcccgaccccgtggttgcgaattttaccgtattggcccctctccctctccatcccctacgcggaatcccacttttacccctcct

SEQ ID NO: 101575 - DNA, 703 bp, Oryza sativa
ctgcaccccagcgtatctttgatgtcgataccggcggcttgtcttggcgtatataggcttctatgttgattgtgttgggagttgattgtctcatggggggtctcgatcgtggtgaccgtgttgatcgcgttggttctccctggtgggtgtccgccctcttcccctcctagggggtcttgtatttatacccataggtgtccccttgtctaagtagaactagggaaaccaatatggatacaatccgagtagtccttgtcgtttccatgaagaacttttgttgtctttccttatcggaactcctcctatatccgaaggttgtttccgtataggacatggtatgtggtgggtcctgccgagatgtagtcaactactattaggtatgtggtatccataaccctgacagcgccgtcaaatacattgttcatcctatagcacttaacggcacggaatggacgtaaccctaatggtgatgtcatttctgaaataaaatcgtttgtacagtggcatttcttagaattcatacttatcgatggcatttcttaaatttggatgcttgtcaatgacatttcttggattatctctaactaaatatgtttgcctaagtttatcgaaaaatttagcaacatctataacaccaaattagtttaaccaaaactaacattcactatattctgataatatgtttgttttgtatcgaaaatgt

SEQ ID NO: 101576 - DNA, 669 bp, Oryza sativa
ggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctggaagcgggctgcagg

SEQ ID NO: 101577 - DNA, 578 bp, Oryza sativa
ctagtcctcactgctacaacaagtagtacgtgtttcggtaaatctggttcagaacatttaataattgcagtactatatttagtggtggacattttcaaaattatcattttttgtaagatatcactgtgtaaaatacatttggtggtcttggaaatttaggtagcatttggctagctgtgaagcaccataagtaacaccaaaatttagtaggataacattgtcaaaaatatgtttgctatgttattgatagttttctaactaggaaccatcgatgatgtgttagtgatgtcataggtgcataatcttgtattctaaggttttaaatcctaatgtccatagatattgcgcaaaagttgtagcagttacgccactagcctcttctgtttgagcgtgtgttagctgttcacaaggatgtgtgatcgtgatgtgtgtacgtgatgacgtgtgtgcatgtgtgtctttcaagttattggaaaagacatacttcttccattcccaaagaaaaactaaacatcgtactaggatatgacaaatctggacacatgcagttctagattcgttttttttatggatggagt

SEQ ID NO: 101578 - DNA, 522 bp, Oryza sativa
ccaggaagtccgtgggaaaatactaccccaaatccatccttcagtcacgcttctcctcgaatgatgcctggaagtagcttccgtatgaatccacctgctcctcttccttttataccatcttctgttacccctcttacacagtttcctggaggttcagcacagcagtctgagaaaaggccacctccacctccacctccaccaaatgtagcccccccaccatttactcgtcaagatataccacccccaccaccatctccaccaccactacctattactcagccaccttctgtgccaccacccccaaattcccctcctccgcttcaacctgctactgacccttctgactcacaaaagcaacgttctcatcctcgatggcagggctctctttcaaaaagtggtttacattactgttcaatctatgcaagtagaatagagttggatgcttgtagatatgaacatgcagtttctgaaccgacagggtaagagatacatcaatccagcctacacattctattattacaa

SEQ ID NO: 101579 - DNA, 556 bp, Oryza sativa
gtttgcagcagttatttctgctgctaaacgcagcccacaaaacttttggtatgttgtctgagtctgcattttctctgtggtacagatactggcctagtttctctaatcttgaacttgtttatatgtccattttgtgtatctcttctatacattttagatccttattgaggtttctagaaaattttggcattcctatgagaagctatttcatattcaacttctggatcataggttgcacatctgtgagtgtttaattctttattttccctttgaactaatcatgtgttttgtgggtaccctctttatcatcttcccacaatattatggtgtctttagtttttatgcagaaaagtttagaattgtgctttggctgaatccttgcttcacataatctggtactagagtcgcttaagtcctctcgtcatagtttgacatttcattatttattcactgatggagacaactttgtattgagtcatccagcaacgggaattggcgctcaatttggactctggaattcatagatggattacagcttgtcgaaattaaagggaaa

SEQ ID NO: 101580 - DNA, 540 bp, Oryza sativa
gggggtgtaatgtcatgggctttggaccgggcgtcctagactcattggataggattagggtttgttaggattagataaggtttgttaggattagattaagtagtcctccatctatataaggagggattctatcacaggtcagttaggcattagatcaagatttatcttagtgcccatcgacctgccttctcagtgcgacggagagcgtcgcgccgtttaggttcaggaccgttccttgttatttcatctactataatccaatctatccccattcatcccgattcttctccacaaatccttgctcttgacattcctccaatccaaagaatcatataggaataaaatcctaaggaattcaatcccctatgaaaatcctccaatccaaaggtgcacttaacagtttattaagaaggatttggaagttaggtgttgaatattctcaccactacttcttggttatgatcagattcagtcaacttttcagagttgatatggagaaaaacgatattaaattctgcatatttctacactacaaattac

SEQ ID NO: 101581 - DNA, 1247 bp, Oryza sativa
aactagccaaaatttattccttgtgctagaggcagctcgcttccatagttgatcgtactgcagaaatttggattgagaattagtgtgcaggaaatgcataactataacataaagaattatctatgcaaagatttcgagcatggtgaacacacactagaattattgccctgaatatcttgcaacagaagctactcttgcagtaattatcttcatggcatggttcacatctcaaggaactagaattcaatgtacataggataagcctttcattgggaacatctatacataagatattgtgatccctatgcttcacagagttttgggacgtcgcaaatacccattgaaaaatatggcagagcaaatcaaatggttttctcagtgctaataatagagtaatatatatgtgtagttctatttgaatttattgcttcatggcattctaagcttctatttgtatgatggtactcccaaggccttttgggtaaaagtgctatcccaggtcagaatgatcacaatggatgacatggaatagcccggtgggcggtggcagagatgatattctgacaacatttctatggcgtaatggtgtctacacaaccgaaatgttacagcatccttatgtagattagttttatgtacatcgtaacatcaatgagagaatagccagaaacttcaaaactcaaaatcacagtgaaaaaagaaggtactgtggtggctggatcccggttatgtaaatattctccgtgcagtttgatacagagttaggtggtgtttgggaaagagggactaaactttagtccctctcacaaaaaaattagaccctgtttagatgggactaaaacttttaagtcactatcacatcgaatgtttgcactaattataaatattaaacgtagactattaataaaacccatccataatcttggactaattcgcgagacgaatctattgagcctaattaatctatgattagcctatgtgatgctacagtaaacattctctaattatagattaattaggcttaaaaattttgtctcgcaaatttgctttcatttatataattaattttgtaagtagtctatatttaatactctaaattagtgtctaaatatagagactaaagttaagtccctggatccaaacaccaccttagtccctaactaaactttagtccctctcacaaaaaaattagtccctaactaaactttagtccctctcacaaaagcaaaagtccctcccatagggac

SEQ ID NO: 101582 - DNA, 698 bp, Oryza sativa
gtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtactaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgaggg

SEQ ID NO: 101583 - DNA, 1181 bp, Oryza sativa
acaacatattccgtgtgagtacggcctccgcaattgcatcttcagtcctgcacccaggccatcagggcaccgtgctccttggaaaatcgatcagacgccatttggcgttgccgcttcttccaggaaactgcccatttgtcgtcgactggggtagatgcgggcaaccggagattatggatttttatggtagagagagagagagagagagagagagagatcggtggtccattgcaccaaacgcggttaaatttctcatcccgtattcatcgcccaagggccgtgcgattggtctagtccggagtccggactcctgcctgaccggccatgaatcattgacgactaataacttcgtggccacaagaaacacatgctcactttgatgaaacgcaaattattgggagctcagctactccagtccctgtgtagatttcaacttttttctttaaacctacaacttttcagtcacatcgaactttcctacacatacaaactttcaatttttctgtcacatcgttctaatttcaatcgaacttccaattttgacgtggaactaaacacaccctcatagttctacgctaaaattggaagtttgaagaaatttgaacgatatgacgaaaaagttgaaagtttctatgtgtagaaaagttcgatgttacgtttttgggattcaaacttggcatctaaatatggcctcagtctgtgtagatataacatcttctttaggggctacatgtactgagcagtgagcaagaacctcattgttcatcgttgttatgattatcaattcatcttagagtttgtgtcgattacaatatcgtaggccgcctaagagttgtattagatgttagaaaaaaatgtagtagaacttttaatctacgctatctcttgaatgaaattaaagcaaactaaatgagacacatgatgtatcgcgtgaatgacaatagggtaggtgtagaaatgggtagttgaggtatttactggtcaaaaatcgttaatactatgacatgttgtaattatgttgaatctggttaaagcgtttgtaattagctctagtagatgtcgggtttggctaaatattgttaataaataccgtgtcttgatgtcatcgttaaatatggtttttttatttggttactaaggtatatgtcgatgcgagtttgataactattcatgcaccaccc

SEQ ID NO: 101584 - DNA, 698 bp, Oryza sativa
aggcaaatgatttgaacaaactagctaaaattaacatgctttccatctatgtatgaaaaaaaaagaaatagtgagagctcccatagtccttgcaccaatactgcagactcggccccaccacctcatgatagaaccttccctgcctcacatgagttcaagatatagacttaacatggctcgagcccggctgcgccatgatagaaccttccctgcatcacatgatttcaagatatagatttaatatgagtgtttgtatttacaactaatttttcttttagtggtaggtgacgtatcttctaaaagaaaaattaagctgtgtgttatgcttccaggtcctgggaaaaaaatgggtgtttcgtttgggacagctaaaagtggagttacaaacttatacaatatcaaatgtttgttcaatggtggctttctactaaaagccgggtctctaacctctagtctaaaaaaaagtttgttcgatgatgttggcacgacgatactgttactagtgttactaccctggaaattcctactaccattgcaaatgggggagccttaatggacgatcagtcgctctctctgcacgccgcgcgattagttcaaacccctctagtctttcctctctactactagtgcggcggacagcgcgtcgcttggattgtccgtattttccgttttttttcggtttctcttgagcgcccgcg

SEQ ID NO: 101585 - DNA, 674 bp, Oryza sativa
agtaggctttatcttgcctaacaaccaactgccaaacagttgtttcatgaaaaacggaacattatcatggcaaagcaacgtgaattcagaataaccatcgtcgcattaatcagaatcttcaaaagcaagctcaaagtgatgccctggcacaacgagccaaaaaaattgtacaacggattagcaatccgccgctttagtccactcagccatctctccctgttccaaatcgaaaggtttccatgatatgacagaggcaagaaataacgattgcaaaaaatccttcctttttccttcaaaagttcaaaaaaattatattgccaattccatggtatcaaaaatataccaaaagaaagaagagaaagtcgagccttgattccagagggagacaaccgtctctctggactgcactcttatactcgacagctctatgtggactttccaacccccccactctgcaccgtggtcttagctctcacactgagaaacccactcttcccccagaagactgtcttcctcgactatacattctcctaccccaaacgatctaacccagacagggattagttttcgataacaccaggcaagaacaggttagagacttgaacttcatcggacaagaaggcgctggttgtggtttgattcccagaaaaactacgggtactggtctcaatggg

SEQ ID NO: 101586 - DNA, 538 bp, Oryza sativa
cacgcagttatgcaaatggtcaatgttaatctccaatttacaagtaggtcccataacttaagctctatacttgacaaacaaacctccatatcaacaaaaccacaggaaattacctcttctgtgagccattgcaaggtttcccagtcaacttcttctttgataaaaatctcctcatacttggatagccccagattccttaaccattccataacacgcctcttttcaacattgctttcaccgcagggttcattttggttatcggaattcgggtcctggaacagagataattcaaaaaacttaaaatatgataatttgttgattccatagtaaggaaaaggaaactattaaataacataagaattatataattgctattgtctccattctcaactaaactttataagggatagaaattagaaatgtatccatagtatggtagcatcaatcttatattcttattcagtggcaaacccaaaataaaaattatggaggtctaatacggcaatacatactaatcatctaattattgagtgatata

SEQ ID NO: 101587 - DNA, 616 bp, Oryza sativa
aaacataatttgaggagataaataatgagagagaaaagcagtgggtacagatttgtagccagctgtagcatagactccaagacgcagtgtgtgtatgacaggtgggaccaggtattaatagtgtagtatgtaactattgtatggataaactattagattggctatagataaattcaagctagtagttagagcatgtacaataacaggctataagctggctgcaaccatattttaagaagttaaacagggagagagaagagcagcgggctacagatttgtagccagttgtagcacggactccaagacacagtgtgagtatgataggtgggaccaggtattaatagagtagtatataactattgtatgaatgagctattagattggctatagatgaattggagctggtagttggctttactattaaacttgctcttagctatactactccctccgtccatagtataagggattttgagtttttacttgcaacgtttgaccactcgtcttatttaaaattttttcgcaaatataaaaaacgaaaagttatgcttaaagtactgtagataataaagtaagtcacaaataaaataaataataattcaaaaaagaattgaat

SEQ ID NO: 101588 - DNA, 660 bp, Oryza sativa
  unsure (1)..(660): unsure at all n locations
ctcactgagcagatggggtagcaggagacaagaatcaagggcgtacaagacatggcgatttggaacataacaatggccttggccggaacaccatcgggtacagccactgcaaggggtactgagatgaggaatactaacactggggacagcaccagcgagcaccaggggaggcagttaagcgtactttttttgacagcgctgcaaaatatagaattggaacttatgcaatagaaaacatatgattgcggatatgatagaggtgttcgtgctatatactatgcaaaaggctacagttcaacagtgaaacggtaagtactaaccttgagagaaaatatcacactgaactcgtattgcaataaaggagcggtgagcgcctgacagacctgagatatgtactatggctctgttaccaaatgtaccgaggctatgcatcttcagggacagaggcgcggngcacgttaaatcactgaaggtgaatgatgcataggatgcatactcatatgcggagactggagatgagatgcacatgtgagagaaagcgcaactattgctgacagtttcaattgcacaaacagagattggggcaatggcagcgcattcatgtgtgaatgaatggtaatagataaggtagagtttatggctatataatatctatttgaa

SEQ ID NO: 101589 - DNA, 510 bp, Oryza sativa
aaccatgcttaatttaactagtacacaatgggggaattacattaatgcatagattccacaccctaatattgatggtggattaatgccaccgctattgtggaaggtaatcaaaatatattaaatggtgggtaaagggtgcatggattttatggtcccacccatggcaattaacgaccgaatcgcggaaaactctggaaaaaaagaggcaactgatgttatttattatacagatcaaatcttagatttcaggggcatctctgcttgatttagtgctcggtttccttaactatctatcatcatgatgatgtttcctgtatgtacatgatagctttccttagctttctatcatcttgatgatgttttctgtatgtatatgatttacgctcttgaagagcataaattgccgacagtgctcagttcttgtgctcaggacaagcccgtctactctaactgttctaggaccgactggttcactctgaattctgaaaaaagaaggggccatttctgctg

SEQ ID NO: 101590 - DNA, 664 bp, Oryza sativa
tatttttattacaacttgtagaagtcgaatttgaacttgcatgtttgtggggtgatatattacatatgaatatatcttgtcaatttttttttgattttcttttcatacccatttagttgacatgcaacaaatgggtggatgtccacctaggtgattaaaagtgtttccccattgtaacagctctataaactactgagaagaatggacttaaggaagctgactcttgttcttctctaccaatcaaccagtgtagttcaaaccaaaaaaacaaagcatcccgtaatgaagttgaaacagaaacaaattttaaattattaacacgtaaggtagagtttgtttgaatgatcttcacaacgagtaactgcagacgagaaggcctaatgtgccacttagaagaaataaatatcactagtaggctagtagacattgcactattacaaactagcacaagaacaaaaaaaaaaactcacaattacgttgtcccatgagaaaataagcccacatgcttcatctggcttcatagcatgtcttatcctttgaagcgaggacggaaggcggacggggtcgcccttgaccttcagaaggagaagagggagttagggaggggaggaccgatgccgggtgactggaaacgaaaaccgatggcgatgacaagaagtagagc

SEQ ID NO: 101591 - DNA, 544 bp, Oryza sativa
ctagttcattttgtgagagctctgctcttatgttaggtggagctgaaactgtttggctgagctccagagctagagctgtgctaaacaggcaaattgaaaggcgcacacctgcagttagataagttaggggctctataaaattgggctattactgaatatatgctcagagcaattacaatttattctattgcttcagttggataagatggaatacaatttgttgtattgcttttagatctttttgttgaaactgtaccactaatctttgcttcttactaccattttgcactccttacagatataggcaagagctggaacttgctgaacagcttgagcaaatattccagaggtcgcctcctagcaggctagtctttttgcaatgggagatttgctctggtccagcaaaaagtatctcgaggtaacggtacctcacggtaccaaatcgtttccgatcgttggatctacctggtcaggatgtacaatgttagatccaacgatcgtaaatgatttggtaccatgagataccggtacctccagctacttt

SEQ ID NO: 101592 - DNA, 713 bp, Oryza sativa
accactccaccactaccttcttcctgtagttccttctctgtggctgactctccctccctttccgccaactcctctcctccatctcctcccccaaccaccaaatactagcgactttgtctctatctccagtgcaaatcgaaggagcaatacgcgcggatggggaaactacttgatggcggatcgagcgaagaccttgaaatatccgaccatggattaggtgatgagttcgtggcggtagacccctcttctctcctcttgcactgttctcgttctcttccccaatcctgttcatcacgtcaccgctcaaaatttgtgggactattgctgctcgggagttgtgggggcatgaccttggccatggcggcttgtgagtcatgccccgaatgcgagtgcccttggtcgtgccggggcacccgtgccctttgcagggcatgaggaacctcgcaggggcacatgtttggcctagttgtacatgccacatcaatgttgagagccggaaacatttgttaggctatatctgtgcactgggaataacattatgcttctccatcctctgtttatgggatcatcaagagcatgttgagttaggaagtcactgctccccatcttagctctagcagagaagtgctcaacattgtggtgcgctatcataacgattgtagtttattatatagggacaacagaggcacgccctatgtggaaaaataagtgaa

SEQ ID NO: 101593 - DNA, 612 bp, Oryza sativa
  unsure (1)..(612): unsure at all n locations
ccacatattacactaattttataaattcacccacatcaggaattaacttgagaaattcaccaactttttgggcctgatttacatgtactgattttatacacaggaggtgacgacaaggaacagcaagtgaacaaaacagttccatatattggaatccaaagtacacaagaccccatttaattggctgaatgcatatccaggtgacaaaatgcaaatgacagccagaaaaggctggtctgcatactctgcaggtaagtaagcaggagaaaagattggcctccaaagctacatcaaaatgcagccatggatgaaatttctggtcaaaagaacagagaggaagcatgcaacaatctgatgggtatagcatgcaatgcaaactcatgtacttctnnnnnnnnnnnnnnnnnnnnnnngccatgtgaaaatgtatggatctctgtcaggtactgcttttagttttgagcagtcacgttatactgacacgcagatggtagtagagcaaaagacaaagttcttggtgtttttttttttttaatctctgatcatgttgatattgttggctagctaggggaacttttttgtgttatcctctgaattcttgtggggaattca

SEQ ID NO: 101594 - DNA, 502 bp, Oryza sativa
caatatacacagtgcttcgagccttattatgacgattagttattctacacacacagaaaaatatgcattggtttataaaagagtttggtgacttcaattaatcaccaagttgcttatttttcagcagcaacttagattgcaagtttagggctcatttgacattctgtttgtagctatgagcctacaagctccgtttaagttggtttgtatatattgcttctgttaattgttttcttagtaatgtctgactatagttaccttaactccttactctccttattgaagaataacatccatgagtgatacattgatactttaagggctccacatattctctctgagagagagagagagagagcgtctgtattcaatgattggtaaaaaccacttctgaggaattaaaaagttaacttaccattgtagatcagcctattgttggtgtgcatcccctgctaactttcctactgtcgtattaaattgtgcaagcacatggcattttttt

SEQ ID NO: 101595 - DNA, 575 bp, Oryza sativa
ggatataaagcatgtgcagttgttttgatggcttttattcataacgtatacacacacactctctctctctgtgtttaaaaatataagacgcgcacacacgtattttaagatttaaattttacaacttttgatcaacaagtagtctaatcatgtatatgtctagaaacaaaaaaaaagataatcgttgaattcgtatttgcttgcactttcatctattttttagtttcagtaccaataataatgtaatttgggagaaattgacggtcaaagtttgacattggagaccataccaaatcaaaccaagtcttatattttttttagtggagagagtatacctgttaagtgtagttactactacttactatagtagtattctagatgatgcattggtcctaaacccttgaaccctaaaatgtaacaagctaatataagctggctgatctcccccaacatgtatatatttcttctgcaaatgtaattaattagcccccaaactttttttgcaaataaataaatcaatcaatctcttggttaaattaattaattaacatgtgtgtgtatattataaaaaaaaa

SEQ ID NO: 101596 - DNA, 505 bp, Oryza sativa
gctttcaatattacacatattttcgttgtgaactttgaagattaacttttacagctgcatatgcaagttggaatcatttttttcatcaaaaccaaccaacggatttagtcaaggtaaaatatcaatggagagctcgaattcaaaatatgcaagtaatcgggtaaaggtagtctgaatgtaaagccagatcttcaaatggtatcgaaagtggataaccatgaaattcatttaggaattttgttgtggttgtattagattataatgattcaccatgtaaataaacatgtgtaatttatagaagttcagagatatgtttattcatatgtaaggttcaatataaatttgataatacattctaacaaaacaaattatcaatattgactctcttttctttagcatgattacaagcttctttatagtgtagcctccttagattatgttgatttgcaaaattttggaactccctccgtttcataatgtaagtcattctagcatttctcacatt

SEQ ID NO: 101597 - DNA, 564 bp, Oryza sativa
atatcaaagttgctcaaagtgtacaagcatgttgccaatgaattatgggcggtgattttatatctaactgggctttaatttggtgttgggcttcaatttagcttcagaggttgggccacttccagatttttaataagtaaactgtactttaaaaaaaaaaccaagcaataccatgccagatggcagcatttttttttccagagaggtacactaatttaatctgctgctgcgtaacctttgaattcaaattagaagcaattccactcaattccacccccattcattcaaaagtggcttaaagagttggtttaattagtgagcctaaataggccttaccaaattttgtcaatgttaaattttgacaagttttgacataactaattttggtaaggaaaatgtgtttggattaaagttaaaatagcctaagttatactattgaaatgacttattttcttaggcatgtcactaaacactattgaaattacgaaatattagtaaatctaatttaggcttcaaaccaaaccagcccaagccgcaaaagtggacaatttgccatcttcaatt

SEQ ID NO: 101598 - DNA, 712 bp, Oryza sativa
caatctttctaaaaacaacattataatcattgcattaatcttggcgaaacagattatcccctcttaaagggccatccagggcaaataagcggagtcgaatggttcgctaaaagtaaaaaaatccgactcttcgtagtcgaagagaacaagaacgtgaattgaggaagttaaagaacaatcaatcgattccagtgagtttaattggttaacatttggttggttactcatcacacaggatgatcaaaagcagaaaattaagcagcagctgccctaggtagaataagatttgattacaagctaaggtgattagaaaggaggctatttgctcaactgaaagccagccagatcaggagtagccgggaaccttgacttgactattcagagacttaatttggaacagaatttttttttaatccccttcctcttgaggtaaaccggatcgaatgtaaagaacgaagtatgcatacaaagtagcgggtttgcggtagagaggagtacgcaccatcaacacctggatgtacctatcgagagggccctcagcctcggagatgtcgagaccctcggccgcttgttgatgtgcagccgtgtcggcagcgctttcgataacacgccgtaccggactgccctcccagccgccgccaccgccgccgcagccgccatcccgccggttcgctcctcagttctcaggcgttagggtttgcttttttttttt

SEQ ID NO: 101599 - DNA, 1557 bp, Oryza sativa
gggcgttcctcgcttctataaactggaatttcccaaatataacgacaaagacgatcccctcaattggttcaatcattgtgaacaattcttccgaggacagaagacaccggatggtgatcgtgtatggctggccacgtaccatctcaccggtgacgctcaggaatggtattttcactacgagcagcatcacggacccccagattggtacgccttcaaggaattgtgccatgcccaatttgggccgccaatccatcgcaatgccctgggcgaactgaaacggctatatcaggcctcctcggtggctgcctaccagacaaaatttctggcattggcaagccggacgacggagccgctcactgacttgcaacaaatccagcttttgatgacaaatacaaaaatacttatgttatgcttaaagaacatttgatgacaaatcaaatcccaataaaataaataataattacataaattttttgaataaaacgaaaggtcaaacatttgttaaaaagtcaacagcgtcatacattaaaatacggagggagtatattccagtgcatgggtttgctgaaccaaagtagttgaaagcttagaaagtgtagagaagcatactataagcatgttaccatatttgggaaactagacccacaaagaaatttcatgaaccatgcatccaaagaattctgactcatattccatcagcgggcaaactttgacatcttgaaaggaaatcaggagaaaaaaattatccccatgtggtatgtgaagtatatatattgcattagtgcaattatgttctatgggtatcctttattggagatgcatttagtccaagtgacagcacatgggaccgcccgaaaagtcgattacccccatgaaagaacatttccaacccccctaaaaacaacagaataatataaccccagtccttatgccaacaatgtgtgggcaataagaattgaattaaggtctgatatgcaaaaagaagtgaatcaattatgatgagtcaatgacccaattgtgtttattctcaacaaccaccgcagactattttggacaaatgagtagaaactttaacaaagcagttatcttattcgctacagaccaccaaaatggagtgatatccagcaagaaagagaaggaagaaatgaaataaacatgccccctttcacatcagttggtgggaagtagatgaaaagtactcaataccaatacgaattaagaatccaatcccaaacagaaagatatcaagcaacatgataactatgcccatctcagatttctataccaacctttaactctcccatagccaagcaggtaagtggatgaaacaaaaaggcttacacaggtaaatttatcaactgatgcatgtcaccctgctaaattacaagggaacgaacctgagtaagctaacctactagaataccaaccacaggacaattgggagatattcccccaaaataacttaaaacaactattaaggaacaccctaaaacaacatctaagaaagaaccgagggcataatcatgtaatagaacaagtggtatcacacagaaaaag

SEQ ID NO: 101600 - DNA, 700 bp, Oryza sativa
cttgttaaatcgtctcagtttctgacatatactccggttatgaattagtactatatagtaatagtagaaccatgcgtaaattttcgtattgttctatctcgagataaagttgatcttgtgaaaagatcgatcatacataacctttcaacattttgagactgtatcctatgggttgcgttgcattatttaatatacttatacattccctcctttttctttcaataatgctaagctgaactgattagaatcgagtgccttttcctgctaaatattgtgctttttttaaaaaaaaaaacgcagacgctcataacacacgcacactcacgtacacccagctcaactcatttccgttcacttttagccaacatctttgagccccatcatttagtttatgcttatacttcctatgtgttgcgttgcattatttaatatacttatacattccctcctttttctttcaataatgctaagctgaactgattagaatcgagtgccttttcctgctaaatattgtgctttttttaaaaaaaaaacgcagacgctcataacacacgcacactcacgtacacccagctcaactcatttccgttcacttttagccaacatctttgagccccatcatttagtttatgcttatacttatacgtcaaaatttgaatttcaaatttaatgtggaagttgcctttatgattttttttca

SEQ ID NO: 101601 - DNA, 785 bp, Oryza sativa
tataagtgctccctccatcccaaaaagagtccaattctagagatgaatctggacatgctagctactagctatatgtttaatttagacatataattagaatcaagtttgagattaagttatggaatgtttattccattattaaaaaaaaggaatgtttacacacgtctatatatatatgtgatttcgaataattgaattgaccaaatttaataggtcgttggaattaatttgcattataaatttcttattaggtactacgtatgtaccatatatatagaattgtactatatagtagtgtatatatattaagctagctagctagctagtgaattgaaacacaactaccttccgttggtaattgttaattagggaaaatataattatatcatttcaacgctaaacaaagttattgctaagacatgtactccctccatttcacaatgtaagttattctagcatttctcacattcagattgatgttaatgaatctagatagatatatatatgtttagattcattaacatcaatataaatataagaaatgttagaatgacttacattgtgaaacggaggaagtatatatgtatatttagctacagctagtttctcttaaaaagaatagtactccctccgtttcacaatgtaaatcattctagtatttggacattcatattgatattaatggatctagattattattaatgaatctatctagattcattaatatcaatatgaatgtgaaaaatactaaaatgacttacattatcgaacggagaaagtagcta

SEQ ID NO: 101602 - DNA, 727 bp, Oryza sativa
ctctcccgcccagatccgacggtgggcatcggtgaaaggtgacgatggcaccgccaccaacggtgacaacgacgacaacgacgacagcggcaaccacgaggagggcggcggctagggttatgttttttattttatttttttgggggtctttttttttgttgcgtgtgggcgacataagccacccgcatacgaaaaatctgatttttcgtgtgctggtgcgtcacccgcacgaaaagtttcatattttcacaggcaccctgttgtagacgggcgtgagatccgcacgcgaaaatccctttcaactgcaaacaaaaatcgttttggtattagtgtttgatgtatgcctcgcgccgatgtagtagtcatgatggctgacatggtcgaacgatgttgcacggaaaggttcttataaaatgcatctaaggaaaaaggaacccgtcaagtcgtcctcacctcctttttcatggccacactcgaccgtctgctagtcacccatattttttttatttttgaaataaaccttttcaatacttaagatatgaaacttgaactgatgtgacaaaataatactaccacaccatcctggttgccgtggtaggattaaattatcacacccgcagcaagtagcgtgatagtaatttttcctcgccagatgggctgacttggctacaaggtttaaattttaaaaataagttttagaagagtttatttttaaaataaaaattta

SEQ ID NO: 101603 - DNA, 633 bp, Oryza sativa
agttataacattgcagcagcatcagaaataccgaatttaaaactgagtgaagtttgatgttggcacttgaaccgaatatttgggaattggtagtagttaaaccctgacaatatgggaggacaagtatatttttgtaaaaagaaaaaaaggaaaaggtgaaaaaagatttcccaagtttgtaggaaaaacaggtgtaactgtgaacaacacagggattgttttctgagccacgagggtttcaccaaactaactttgaacaacataggaaggaggaacaaaagatgaaggctttaaatgcatcatttggcacaagtgcactgtgcgcaagaaagcttttccttttcttgtgagagcgttcttaattgaacctctaagataaggtatttaagttatagagataaataaattagagatggaggcttgaacaaaagacaagcttttaatctgtggtaacagcaagagtcagaattctagtgcaaattaagtgacagatgcttaacacacaccttaaaaacatcacaacgcctgaaaccttatgaaattatataactcaattgtacaaattcattcatcataaataagcatggacaatctatggcataatggaatttgacagtagtgccatctattacc

SEQ ID NO: 101604 - DNA, 1636 bp, Oryza sativa
ttcaagggtgcagcaacatgatcttatattcactcagtgatcataaggaattttgcctcattaaacaagaatcaaaattttgtcgacaaactactttcaagcaaagcaaattgtttctgaccaaagcgaaaaacaagcaaaagatttggaaacaacagtgaaaaaaggatttttttttcttttccagttgatgattcatctgagattaactatttttatttatataatgagctagagaggcctgactatctgttattatacccagaggtaaagataagagggatatgatgtgacagaacccaacaataaggacacaagagcaatcaaggcaccatgctcattttctgatgccaatgctgcaccagacacaagaagcagcatgttgtgttcagattttcagaattcagaatagagcagcttgcaagtttcaggctcagtgcctgcatggaccacatgcattctggtcgatcattagatggtgcagtgcaactgtgcaaaggcagcattgcagcaacaacaagatggtgacaagaacaagcatatgcatggacagtggcactcaactcatggtgttggtctctcttggccacacacacattgggaacaggttgccgttttttttttttagcctgtaaccaagatgactgttgaacatatgatacaagatttcagggtgagcattggagcattgtcaaaggttttcttccaactgaaacttggtttatataatagggaaactaatacagtgtcaaccatagattgaggttgatttacaatgatcggcacctcgattcggaagaactcgtaagtcaagtagttggttgatactgctgaatccaaagtggttttcagaacctcttctatttgggagtagcttggagagagtgatgttactagcttcagtatctgcatttcttcagggacaacaggaactatagtaatcaagttcagttgcaaggcaattctagtctgattgctgcaaattcaggccgcctatgtattttagcatcttccaaacttcctcaatacatgagaagttctgattaggtaatcaaatcgtaatacaaagatacgcaacgtgcgaattcccgaaaaagttttgtttaggtaatggaatgaatattacagctgcacataaagcttgaaacagtatgatacactactcaaagctaatgctttggtacagaaacagtagaatgaaggataagtggcagttagattccagtaatgtgttatcgatatcagatcgattattacagtataagctatgcgcttcgctacaaaaaacgtcgcaatgaggaggatttttcttctctaaaagcctcttgtctcctctttgaaagagacaagagctaccctgtttcaatattgacatatgatgactgttcctcaatgatgaactctaagacctctcacagaaaaaaataataataatagtaaataaagaaaaaaaaaacagctccggatatgactgaatgaaaggctccttccttccatggcaaataagataatatacaaagttccgtacatttcaggttttctagcctatgattaaagttgattaggagtagtagtaatcctgaagcaactaatctgcactgcttgactgcaaaggatggcttataggaaccctgaa

SEQ ID NO: 101605 - DNA, 604 bp, Oryza sativa
ggaaccctttcagcctttcagatcgttgacattgatcttaatccacatcagaaaggaatttaagggaattaaagaggattaaaggaacaatgcttaaagattatttttagatagtacgtaaaaattccaaagttcccctcaaattctaaacttaaaaataaaaacattcctcaaattccaagccgttggtcccaaataatcccctttctctggaccatttgtggcagtccatcatctttcttcgttctcctccccttcccttgccgtggaagtcgccatggctcctcggatcgcggtgatgccaccgccacactgggtcaaactcaaactcaatcctcctccgccttgcgcaactccggaaacggaatccccatcgccgggaacacatgcttctcccccgttctcatccgttaattagttcctccattagagcaatgatatgatcatatgatacactggtggagaaacccttcgtagtcccagttcgtaacccccctttagtcccggtttccaaaccgggagtaccaatccgggactaaagatcgagctgacctttttttttttttttgcatggccctgttgctgcatggtttatatatatata

SEQ ID NO: 101606 - DNA, 739 bp, Oryza sativa
aagcgcggagcattatctagtatatatataatattaaaatacgcatcatctcgtagcaaagctcgtagaagtgttatgttagatggaccaaacctttgttgctttgctactaaaatggtgcaaagcccagcaaatgcaaagttagacaagcctcccattggcagtagatcatggtgagttcctagttagtgagaatgagattacagagaagttagggctcccaaggtaaatttatgtattcttccgctattatagttcacaacgaatggctcggaataagtcggtgtcctgaacactaaagctagcatcaccgatgtaattatcgacgacctgataaataagacttactacatctctatattgagaagctcttgtataaactataaagtaagctagccatcaataaagagatagacaagactttgttcttattatttttattaaacttacaatttttaacataccttaaattaatgttactccttaatccgtataagttttataaaagaaagtttatccaatagagcagtacatttgatgcacatgtatctggaactgagatatgattggactgaaatcccagaaatgccagcgatcaggcgcccgatcagtggcaaaaaaaaatcgggcgcccaccgcttcccgcgcctccgcgctgttcttaccacgcgcctcaccacacgcgccattgcaacaaattacccacgtattagaaacgctctattaagtgaatctgttt

SEQ ID NO: 101607 - DNA, 534 bp, Oryza sativa
gaactaacacaaccttgatttcttgtttgtatgttttccaagctactagtactactttaaaagtcaaatggctatcacaaaaatcacattatccatcaacctatcaatttcagctatctcagacgaggccttagagagcaaaatctggaatatgtgaatgcaagaacctgtatgtagcatatagaattttcacacaaactttattgaaatttcgtagaaaacaacgaagatatatgaactgaaaacaaagataccataccagtactaacaacatgactgtacagcacacaagggtcaatcaaggttcgcacaactttacttgaaatttgaagggtaaaggtgtgttctaccatgcaaacgcaaacgaatttcagcagcaccacgcaaacatgttatatacctgcaccagttacactttcattaacccaaccatctcaagaaaaaagaagaggatatgcaacccgagcaggtcaattttcttcttcttctttttcctcttctctttttataaaagattatcacaagctacaacag

SEQ ID NO: 101608 - DNA, 640 bp, Oryza sativa
taagaaactccttccctctcaaaataaataaattaacctaatacggggatgtgatatatcttagtatttctgtttaaatttatagtattagaatacgtcacattaattctatattttatttatttattttgaggcagagagtagaggctatcaccttctcaatttacattcatatatttatattgtcgatagtactatagttcgtatagcctctataatttctgtatgcctcgtatatgtagggatgcatatatgtgtgtgtctggcttatgctaccgatcaacacagctacaaaggtactccaattagtagtattgtacatgcgtgcatatatattttagtttgtcatttatatattaactagaaaaaatgtatgtgcgttacaacaggtgaatgctattttaatcttattattgttatacggtttagctaggatgaaattcaccatgagaattcatttggatttttttttagaaaatcatgagcttcaattagaagtctgactttcctttcaagttagcatacaagttttttaaagaaatttcttatacgacttcttttgtatttttaaaagcaaacgaacttaaaatccaactcatacacggatctctatttccaaaagtgaaataacttaaaaact

SEQ ID NO: 101609 - DNA, 1087 bp, Oryza sativa
ccgttttcagccctaggccggtccgctacctccctccgtttggcttgcttccttcgacccatcaaatccggctgaatctttctcgatcacccaaaaatggttaagggtttttgatccacttacctcttttcgttttacccaaaatcaaagcgtaaaactcgagataaaaacaatgggggaagatcgtcgtcatcatcggcaacagttagattaaatccgcaaaataaagctaggaaaatcatggagaaaataatgaggaaagagtgggaatcgatttttttttcaatcaaattggagtgaaaacgcacaatcgatatggcgccggcacagcgcaagggttcaactcggtagacgtgccgcaaatagattggataaaaaacagacgagaaaaaccaaaagcgcacgggataaaaaaacaggtgacaaaaaaaccagaagtgctcgggagacacgcggtgaacaaatcggatttaaaaaaccggaaaaaaaaccgatagcacgtgcatagaaaaaactctttctcgtgaaaaaaaagcaaacggactttttttttgtttttcactggcgagacttttcttttccttttttactgtagtcggacgatttttttttctttttttactggtgacgacataagctttttttttctttgttgagtcggaattttttttaccttttgagtcggactttttttttcttttttacctactatatggaaatttcttattatttttaagtggagatagagatacagagattaaaccaaaacataaaattaaaaccgattgaaacacggatgacgtatcaaataccggcaaaaacatcttcaatttttataatagtagagatagagatttgacaaaagtgtgagtaaactataacaaattcttttgacagcatccaccaaaaaatgcatatatcgaatcaaaaagcatacgtacatatatattttagatcaaaaggctatcgcccagctttactgaaagcataagaagtctgtgtacagaaataaggctggggattccagcttacatatcaagttcttagccaacgacaccggcaacaaagctgctgactcagcacaaac

SEQ ID NO: 101610 - DNA, 830 bp, Oryza sativa
tagacatgtacagatattcttgaactatcataatttaaacactttgaaattaaattgcccctcgttccgtcgctggcctggcgaatttttttttaatactctgaatttgaactgagagtgatagcctgataagattatcactacttacttcagttcagatagtcacagaagaaaattgcaagtagaaataaaataacatacactgatcaaacaaagggtatgcagctataggtttgttataaaccatggattgtcaactgacacaacttttatggtacacaaagcatattgtagtgatatatttttcagttatagatggttctaagataatactcttcgaacagtctcctggcagtatgctaatgcatactaggcctcgaaattctgtagaaatcttatgggaattagtcaattccttcaatgtctgcagaagttgggaaaacattttcagtatttctgtggatgcattagcaaaaaaaaaaaaattgtgtcaaataattgtggcagataagagctactactaccagacacttcggggcagaccgtgggccactaaaatacgacagatttgatgaatccatgtgaaatgctgcaccaaccaagtgggcctattggcaactgaccttcagaaactaataaaataacctgacaaatctagggaagatttacacggtttgttaaacccaaactgaatcaagagaaaaatcaagataaaaattaatcacatattctcctgtatttacaattggtttcaggaaagaaaaaaaacaaaaaccaaaaccaaaacaaagagaagctaccacttacaaaacttacagtaggttccttcc

SEQ ID NO: 101611 - DNA, 589 bp, Oryza sativa
cccccccccccccccccccccgctatcagaggcgacgtgtgcgccttcattcttgcagaaataatgaacaagaaaggacgttttcatgtgaaatagactcatgaacttggctagataatttattgtgatgtaaaaaagatgtttttataatttcttgtgatgtaaaaaaatatgtttttatggagtgcaatgtaatttactttcatatgtgcaatatttatggtagtttactaaattgtcatcaaatttgatcaactacgatttacgttgtactattcatctgttttctcctttttttttccttattgacaggttgtggaggttcacaacgaacagaatacaagaaattttggtaatcatttgaggactttcatggggtatgaattgtgtgctataataaattaaattgctgcatatgtgatgttgtaaattgttgctttgtgatggatctgtgatatgtgatgcatctgtgatgttgggcagttggagaatatgtgatatgggatggtgattggcacctgtgatgtttctgtttttcagagggcatggctagcaattcctgaggctagccaatatttagcattttatt

SEQ ID NO: 101612 - DNA, 520 bp, Oryza sativa
ttctaaaacaaagcgctaatgcttcagatgagaagaatggccagagatcaatggtcaatgccattttgtttcctattgctagttataatggattaggcgaagaagcattatgtaagtgcgagcctaacactgctgaaatctgtcaaaaggtcaatgcactagagctatttttgacgattaggtaatcttctgcagaaacctgcagttcaagtaaagccgtttactgtgcaatcaaatgaacatgggttgtgtaggatctatgcccaaattactcaaaaattcagcaaatcgacacgcttattcgtgacaactttcatcaaaatttcgtttacaaatgagcacggtgaaagcaatttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatata

SEQ ID NO: 101613 - DNA, 714 bp, Oryza sativa
ttatttaaaaatttatgtaattataatttattttattgtgagttgttttatcactcaaagtattttaagcaacatttatatcttatacatttgcataattttttttataaactaatggtcaaacatgtattcaaaagtcagtgacaccatctattaaaaaacggaggaagtatatacggatttagtcctctttggaattttgtactataatttcttcttttaaaatctgcatgaaaaaaaatatagaatacatttttatcgacaagataattatgaagcaaaagacttagggcttgtttattttgctaccattttcaaccttaccaagttttggtattgccaaattttagtcaaattttggtaagttaccaaaattttggcaatgttactaaattttggcaagatttcatatgtacttactaaaatttggcaacagactgactaaatgtagccaaaattttggtaactttgtaaaaaaaaatggtatggttgaaaatggtatcaaaatgaataagcctttaggtgtgttctttttcctcttactattatggattataaagggcatgcttcacaagcttatggtttattatttgatttgttttatatcaatacatcaactttataatatttctaagctctgaaataattgttatacaccaacttcatctatagtccatcatcaatcgaaacttaaacgctacagcagcatcgtca

SEQ ID NO: 101614 - DNA, 575 bp, Oryza sativa
aacattgcccccatcgaatatagacacgacctaatgcataacccccaataaattcccgactgactgtcgaataaactccaactaaaatttttctaaagccctagactgagctaattttttttttttttaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactag

SEQ ID NO: 101615 - DNA, 626 bp, Oryza sativa
caaggcttatggagattcctgtgagctaacagttaaataaggagtaaagccattaccctttttttttctcaaagtactattttggaatggtaatgtgttgccaaatgataactcatagatactactcgctagctctatcctaaaatataaaatataaatacttctagaatttctggattttttacagcaattaagaatagacgtgaagttatatgagtgatggatatgattggttgaaacaaataagtagtggagaaattagataatagatagttgctattggttgagataagtgagtagttggagaaattagatgatagatggttgtgattggttcagataaaaaaataggcggaagataactatagttttgaataacgctaaagatagctatattttaagacaaagcgaataggatgttccttttgtttggacaacacttgaaacttgatgttgcaacattgagttcttgagttggaacaactgcttttttttagttggaacaacagtcacgcggctctaaacgtgttgggtgctttctttattttaagagtatagatgggagattcatacacttatacagtgacatatacatgcacaacttacaaatgcttggagctttttgg

SEQ ID NO: 101616 - DNA, 508 bp, Oryza sativa
ccaagaattggccgcccagttcgagcaactctacctggatccagaccaaccccagtagaattttgttagaagtagttctgacctttgagctgtactcttttctttgtcatggttttctcattttcccctatgagtttttacatgacaaattttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattactttttttaaaaacttttatttccattttttaaataccattttttcattttttaacattagtaaatcattacttttttttaaacattttatttccatttttaattttttttcattatacatttcctttgctttttttttta

SEQ ID NO: 101617 - DNA, 682 bp, Oryza sativa
ttcttttttttcatccaaccgctctcctcatcaaaatttccctatcttaccttaaacacactcctatttccaacatgttctgagttattaaggggtatatagaacattttcttttgaactaatttgtcttttcctaaatatttggaatgtattttttttagaatgaaggaaaacatgtttggtagggctccaaatctactactccatccgtcctctaatataagggattttgatatttaacttgtattgtttgaccattcgttttattcaaaaaaattttagaattattatttatttttttacttactttattatccaaagtcctttaagcataattttttgttttttatatttgcacaattttttttaataatacgagtggtcaaacagtgtaaataaaatattaaattttttatattataggacggagggagtactcccaagctagagttgtgtagcttgaaaaaaattagcttcatccttcgtatatatttttctagagcaaattcttccactccacttaagaaactaacgatttaataatgtttggttcccctaaccagatcaggtctaggagctatagcccctgtgtggctgtgtggcctgatactggaaaaatcttttgtgaggtggtcgtcggctcgtcaaaagccgttgatcggatgggccatcacaatcggat

SEQ ID NO: 101618 - DNA, 550 bp, Oryza sativa
aggcgcagtgccctccgccgaagaaggcgttgcggctgcacagacggcggtgctgcgcccgacgatggcgacggcaaagacgatgcggggagaccgggagtgagtcatgtgaaaatatgggcgtatcaatacgaatcagcaaagtatccgtaattctttcatttgtttgaaaatcgagaaaatgtcagatacgtacgggatgcatatcggagcgtgtatccgttggcgtatccgatacagatacgcgacactcagcgacgtatcggggtaacatagcttggaaatggtaacctaacaaaaggcaagaaaatacggaaacgaaaatgattttgatgttctacttgccattttcttatttaccatatttgcacgaaaattatagtttttataatactgtaattaattaccatatttctaaataccatgtctctattttactagaggcccatcaacttttcaacccaattcctaatttgagtacatgcctaaagaaaagatggtttgtgatttacgtagtgtaagtttgaatttcttttttttaaaatagtgt

SEQ ID NO: 101619 - DNA, 690 bp, Oryza sativa
ggtagacaccaagtgaattagcatattatgattaagcattcgaagttggggttgcacaaactgaactagcgacgaaactacgatgacagaaataactaagcaaaacccaactctaaacgataatgactactgaataaatatgattagggacgctatagggttagacttaaggcgtctatctcttggatttagtccacgacctgatcattacaagacccaatgcctaaatcagagtcgggctggatgaaatatgtggcctgttttacagagtcccgactaccgaggaagaattttagcgtgggaccaaaaacatataaaatcagaccctataatctttctagcaagtacacatggactgtagcgcccgttccgtcgtggcgcctagcgggaaaattaattcctaaaaaccctaattgcgaaatttgtttcttcgcttgtcgtctagtgtccgtgccatctcaagatctcaaatccccgatctatcgtcgagttcaattccgaatccaaatccttccaaatcaaattcctccgtaaaagtctattttgactcccccggggtcgatgggccgaatttcgctcggaccaccttctcccctcccccggcgcgctcccgctctccctctccctctctagacctctcccctcccccggcgcactccccctccgctgccgccgcgccgagcgcccccc

SEQ ID NO: 101620 - DNA, 1445 bp, Oryza sativa
gtacaatggtgtttaataacgggctctgttcgttgtcatgcaagtaaatttggtgacgtggaagaaagagaagtaaggaatgagaagcatggttgctacgcataacaccggctcagagtcgactcttagcatttattaacagaaagtttgttgcatgagggtatagaaaaggaaagaagcataataaaaaaatatttagtgcattaatggtttagaaatcttattgtctctactattgtagaaggatagtctctagtgatattaattaatatagagagctcatattaggccctgtttagatgggactaaaacttttaagtccctatcacatcggatgtttgaatattaattataaatattaaacgtagactattaataaaacccattcataatcttggactaattcgcgagacgaatctattgagcctaactaatccatgattagcctatgtgatgccacagtaaacattctctaattatggattaattaggcttaaaaaaattgtctcgtgaattagctttcatttatgtaattagttttgtaagtaatctatatttaatactctaaattagtgtctaaagacagggactaaagttaagtccctggatccaaacaccaccttagtctctacctttgtacatgcccttatgaacgcggtagtacatcccatttggttgaattaagatttttctgcgaagaagttgaactgccataaaaggtaagatttgtggaaacatttggaaggttcaaagttgttggaacaactgaaaaatacagttatgtttgttggtaacaatatttgagtacatattttatcccaacaaatattcgattacaattacttagttattactttctccgtttcacaatgtaagactttctagcgttatccatattcatatagatgttaatgaatctagacacatatatgcatatatatgaatgtgggcaatgatagaaagtcttacaatatgaaacggagggagtattgtttaacggtcaccggggaggaaaactccccacctgaatcttattgaaaagaaactatacaaaaccttcccttggccatctgctttcagatctggccgtggtctctttcggtgcttgaggagtttgttcgtccacggtgttggtcttgcctgtctgtagttaggtctcttaggcctcgccggtgcttcacgtgtcctgtggcttattgaactcgttgtggtgctgagattggagcggtgtgcttatctctccatggtgcgagagttttgctttggcttcttagaagttctgcaccttttgagggagtccggggcgaaagccttgcttgcccgtcttctgcggttcgcagttgttttgtctcagactttctgtgtcttctgcgtaatgttttcgtcggtttcactttagtatgcttttttttttcgattttccttacaaacaggttcaacactat

SEQ ID NO: 101621 - DNA, 889 bp, Oryza sativa
attgcaatagaaaaggtagtcttataaacttcttccttataatgatttcaacattttatttaattagtcgcgagttataagaaaaatcaagattcgttcataacgtgacacaatcatcaacatttttataagaaattagtatgtaaccaactccactgaaaacaattaccgcatattctctccctctaaacttctgtcatattgagcgggtgtgctgggagcctgggatggccaaactggagcctgcagtttctagataagcttcgctcgtgtgatctatggtgcatcatgtttaagtttgttttacaaacacacgttcactcatgcttataaacgcacacacgtataccatatttctatgtacatatccgaaaaactggaccggcacatttttagattgacaaagtcatcacgaatgtcttgctaacgacggatacgacgtctatcactgaaaaaataaatagccataaatacgacttgaaattgggtagattgattctaccaaaagaacctaactaattatgctcacttcgttaaaccggctaattattttttttaacgaaccagtacaagataataccgacatactccctccatttcataatataagactttctagcattgcacacatccatatatatgtcaatgaatctagtcacacatatatatctagattcattagcatttaaatgaatgtggataatgttagaaagtcttatattataaaatggaggaagtattatatgtagtaagagtaaaactatttacaagcatgtttctcttacgcgtgttgtgctagttagataggcgaaaacaagctaagggcgtgttctaaaccagggataaaaacaacacattagctgcacgtaaaacgagaaacatatcaggg

SEQ ID NO: 101622 - DNA, 706 bp, Oryza sativa
ggatgtatgagcgtgccagttgatttgatcctgcaatcaacaagaaacaaagacaaagaaaccgggattatttctttttatgatagccgatcggctagatgccgatgacatatcatttatctttgagccgatgtcatatgtgaatcgatcggcaattgtaaggaaacaagtcagaactaaatctgctcgatcggctgtaaatatcaatgatgtataatccttatatcgacatatacttaaatcgagtgattgggatagatcggtcaccttgccgagacaatataaatcacttagattgaaatatatattaataatgagattatacatattcatagcatagccgatcaaatagatctagcatgtatcggctaatactccgatactactttatattaagatatttaaagcaaatagaatatactaaatagagatctaatatacttaaatgccacaagatcttaacatgaagggcatatctaacatattaattgagcatatagagcaagagcaattagatcagataagatcggctgaaactccgatactaccctaatcgcaaccagtaggcaggctagagaatgaaattctaaacacgacttaatagatcaaactcaactgatacagcattaagtatgaaaaaaaggacaatatctagacaatcaagccgctggatgtttcatagagtggtggatatctcatataatct

SEQ ID NO: 101623 - DNA, 612 bp, Oryza sativa
attcctgcagcccctgattaagatgtacattttctctcgatttctattagcacgtttttcaaactactactagtacgtgatatgtttcttgcaaataatttctatataagtcgttttggaatatcaactaaatttatttatttattgtaaataattaaaacacaattaatcatatgctaatagctttcttattcttaatctatctcaaatgccattgtccatcgataattaattactggttgattgatcaaacgagctcatcattgagatcaacaatggcgtgcagcgttcaagtacgagccgtaccacaacgtggtggaggtgccggctgagacggactacgacggctgcgtctcgaccaaccccgtctccgtccactccggcggcaacaccaccttcgagctcgccgccgccggcacgcgctacttcatctgcagcatcccgcgccactgcctcaacggcaccatgcacgtcaaggtcaccaccgtcccttactccgcctcggccgccgccgccgccgccgcggacgccggcccttccccggcgccgctcccctcgcctcccgccgacgagcagcagcacaggtcgaactcggcgtcgtcgccggcggcc

SEQ ID NO: 101624 - DNA, 814 bp, Oryza sativa
atgcaacatgttcaccttcaaagtaacatcaatgcaatacacaaggattgcactaatatgttgattagcagaagatgtttgttcgaacctggaagatgccgtcctgcgaggttaggttggctgccaaagtgccaatgaactgccacagccagtgaagtcacgctctgagtcaatggcgccactcgctcccctgttgctcccatgatcaccaaggctgccagccgctagtcgctagacacatccgggaccaaatttttttattatcaaatagcttacctgtactttttcttgaaaaatcatcatccaattagatcataacttgtctatattcaccagccaatttggatcctcaaattacttaaataacttacagtgcatgattccttaatacctccttaatatattgtcatcaacccatatttgtatcgtaacttgtctatcaaatagtgagcatagagagaatttatttaacaaataatcctgcagaacatgaataacgagtatagaacattcagaagaaaatcagtgtaagaaatataaaagggtgaatacccaacatgatccttgaactttcgtttaaggatcattttagtccctgacatttcgtattgtccaaacaagtaccttaagtttattgtgtgattcaatatagcccttagaccctctaaacatgccatgtgtacatgccacatcatctatgcatgcaaattcaatatttaaatgtcctttacacccttatgttttcataggaaataaaaaaaaattattgagaaaacacaaaaaaaaacagcttttgaccattggcaaaaatatg

SEQ ID NO: 101625 - DNA, 603 bp, Oryza sativa
tgatgaatcgtgtttaagtgcaataagggcaccgtggacaattgttcataataagccatttctttgtaagtttgaatcctttttgttcattagctagtgtaaacaagtaattctacatttataagggctcatctagctccagaaaggcattcatattgagcttctggtatttgagaacctatgccttattattttttagttcaactgttgggaggatggttggattaaatttcagattcacctaactaaattgctattctaaagaaatggtcgacttagcatgtttttttctatgtttatggctttcaacatttcttttaagcttggattctgttgcttgctggttcaatatatttgtttcccttccttgaaaataattctgctaatggtggatcactggaatttgatgtcaatttattagatacctgtgcatttttttactttatacctcacaatctatatgagaaattctttgtgtaaactatagattttcggtcaatgtcttacatctgcttcatttttggtaaaacttccaatgtttcattcatgttgatggaaaatatcttatgcgttatcttaatattttactatacaggccctttt

SEQ ID NO: 101626 - DNA, 573 bp, Oryza sativa
aaaatgtgtcatgcatccaaaatatattttttttcatgtaaagtcggaacgttattcatcattttacatgaaatctgagaattcacttttaggcatagtagtgtagatttttaagtgaactaaaataatttagaataatttcaatctgatgaattggctcatgcgtaaaaatatattgagactggtttctggccgggccaaacaaatacgggaagctacagttagccgaccatagataagccaaaaaataaaaaactgactctataggttagattaactaggtgattccccgtgctttgctgcggaaattcttaatatattttttcgacaatcaaactaggagtgcaaaggaaaaaatgatgaaccctcacatatatgccgtacttatcaagaaataaacaaatgatactcgcactttaatgtgaaacatattgataagtatgtattaaatattataaaaataatagatttgttaaagtattgtgcaaatgatgtgaatgtgatgattggatatgtttgcatgttgatttgtggaattaaataaattgtagataatgtaatatgcttgcgtga

SEQ ID NO: 101627 - DNA, 681 bp, Oryza sativa
gttgcatagatagaataagagggtatatttgtaaaatagttttttaattaaaagtgtgcattgtaaaattatatccatagcctgactgttttttcttagtaggttaagaaagtttctagataaagtgaatccaatggctcggatttcttcttgccattttgtcttcatgtggatccagtggctattatcttgttgattatgtggttcatcctatattaagttgtgcattgtgcaactataaactccctctctattaaatatgtctatagattgtggtagcaataataagcttacatttgtaatgatgattaatcataacatctttaatgggtgcatatctaatagttacatcagcatatctcacacacatatatatgctcatcgctaatatatataactttgaatgatataaagcttagttggatcatattaatctttattaaaaaatgaggtttatttgtaaaccgtgagagttgtaaaattatatgcgcaacatttgttgaatatttctaaatataggtcaatgatctatttgtatttttttcctcaaaggaaagttgcatagatagagtaatagggtatatttgcaaaatagttttttaaataaaagtgtacattgtaaaatcatatccataaccttactagttttttagtaggttaaggaagtttctagataaagtg

SEQ ID NO: 101628 - DNA, 615 bp, Oryza sativa
  unsure (1)..(615): unsure at all n locations
tcatttttttaatataaactagccacatgtcttattcacgtgtttaaggattggcggggagggatattttttctctttttttacattgattagctatagttgccacacgatttaatgcccctcgaaagtacctctactttcttatagagacattttataaaatgcatcttcacttctagagataattcaccaaaaggtattttgaaaaatgcctccattgcattgtagaagcattttaaaaatgtttctatagtattaaaaagatgtctctacagtgcatttttgttgtagtgtttgctggatcgattaacaagcaattcgtgtggatcaaatagcagtgcccaattccattntaaattttatgattgttggtttataggtgcctttctagtgaaccgaggttaatagttggtcagccatatattcttgatgtcatgttattacaacacagcagatacctggtaacttttcattgtgataatttgcatatgaaaattacaaataaatatcttgtgacctgtgaattttacagaggatatatatgggtggaaatcttgatggtttgctaatgaaaaattttttgacataaatgaaaaagggcccttattttttgca

SEQ ID NO: 101629 - DNA, 565 bp, Oryza sativa
tatgttattttgctaaatattccatgtgatgcacacttatgtatgtttttgcaaagggatggaagagtattactttttctacttgaaaatccataagaagatatatagaattacaatggaaaacaaatgtttgaatatttaagcacgaattttgcaattaacaggagctggtgggtgattaagcaatgaaatgtcacatgtggagtggatgtttgagtatcgcatatttttaacttgtatgctttcattgaagattggaagcataaacaatatatgggttagttattaaaagaaattgcatgacataatattttaagagacactgcatgatctcaaagtccacaaaaaggacgatggaccaattgaattctacggtgcacattatgccaaaaccggagaacttcttgagcaacatattacttcaactattaataagaatttggttaaaaaattgacatagattgcatctatcattctctaccgtatcatctgctctgagaaatggcatatacaaaggtgtgtatttaactactttatagcaataatatctatggcggcgctttta

SEQ ID NO: 101630 - DNA, 569 bp, Oryza sativa
  unsure (1)..(569): unsure at all n locations
tgtcaaaattatgctacacctgtgctaggaacaccataccatcgtagcttacttgcgcgcggtctgttaaccctttttcctaataaaaacgtattcctccgtatcgatgttatcgctttgatcgtgtgggtttcactttatatccgttgaaacctctgttaacacgtccaaattatttatatcggtattatcactcaagatcgtgccggttgttttgctttttacgtttcttgaagcttctaaagaggggacaaacctatataaataggagaggagagcaccctctcaactcagttcaaaatttaaaaaaaaaagaaaaaaaaagagaagaaaaaaaaacccatggcttgcgtagccgtagctttcccaccatttccttctcttcgaagcctnctcctctcccgttccttccgcgaaaccaaaatccaaagcatttgatcgaatttctcccaaactttttcagccgtataaatttccgcccgatttcggatcgaaaacctcttgcgaattcaatttaaactcgttcgagagcgcaatggagcacgtgttccggcgtcaacaagatcccc

SEQ ID NO: 101631 - DNA, 669 bp, Oryza sativa
aatttttttaaataagacggcgattaaaattaagcacgaaaacttggacggagggagtaccacgtagtccaagaatttctttattccacatgaaatgaaattctttatctcacgcttggtgttaaattttttgaagaggaatcatatttttccatcttttttctcggtgtagctctattttttttctaattctttcagtagtaggtgataaatccttccacagcgaagcacctgtaataacttcatcaatctcaagacatattggtcaatctttaaaagtgctaatagggataggttgtaagtgtgtgcatggatagcggtggacggtgggtctgcgcgcatatggacacctatatctatattatgtttagaaaagaaaaaagaagaatctgccacctaaacttcggttgattctcatctgtataaccaaacaaggggagtgttcgctaccaggggatgggaacggtgtacagcgcacacgaaaaacggggcggaacattaacacgcgattaattaagtatttatttttttaaaaaaaatatttaatttgatgttcaagcagcttttatattaaactatttaaaaaaacacaccgtgagcagtgcgaaaaacgtgtgctcggaaaactagtgagagaagttaggaaaagtactatccgaacacacccaa

SEQ ID NO: 101632 - DNA, 525 bp, Oryza sativa
tttccgatgctaacctacattggctaagtgttatctgcggcatatattgggaacggtgaggggcgtacaccaattaattcaatctaaaaacttaattaaattgaccagcgaatacttatatttcaacactccccctacactatattggaaaacttcccctcgatcaaggctttcttacccaatgggcccttatatctcaaacgtcgaatataatatacatgagtcatactattttatttaatagtgctacctaagacttggacttaaaacatctaactctcataccttattgaattacatgagaaaaaatggacaattcacaatatacgaacacaaacaaattttaactatagttatgctaggaaaattggaaaaaaccaatttagagcaaatccacaaaataatttgtctagttatgaacgaccttgtgaacgcttatcagatagcttcgcatgagcaatgaattagcttaagcccaggtgcacggagaatcacatgtacacggaactaaatcaaattggtgta

SEQ ID NO: 101633 - DNA, 786 bp, Oryza sativa
ggcgcgtcggttccatcgcgtcgcgtcgcgccgccccgcgcgggggaggacgagtttttgtgtgctttggtggaggggtttccgaacgaggcgtcgctgtcccgtctcctggtgcgtgtttatgcgctgacacatgtccatgtgcattttctttcacttaaaaaaaatcttttttcttgttatattactctctctatccgaaatacaaagaaatgagagagaggggtgcatatcccaataccatgaatctgaaccgtactgatactcatcatgatatgttacatccctccaaaatcttttatattaagggacgaagagattatgaaccaaatgagtttcggatttgctaaaatgatgtcgccatattttatggctaattatagttgaatttctgactatctgatgttgttcggtccacctcggcatctctcggctatcataacatgactaattaaaacttaatatgattcattagttcaagcttttgatgttttaacccacaagtatctaatatagtagatattatatcaatatgtgtaatttacaatgcaaaatatagaagttgcattgcacttacattataattacattggacttacatatataattttagaacttacattatgaatacactaaaattacatatgtaatttagatacttacaatgtaaatacatattgatttttttttaaaaaatatggcaccataaatatagctactcccatgagttttcttcccaaaattcaaaactatgaacacatttagtatttagagtatattttactg

SEQ ID NO: 101634 - DNA, 648 bp, Oryza sativa
tttttggcttttccaataaatcaaatactctatccgtcctgaaatatagcaacatagtatcaaataatatcatatttgatataacttataagaatatgaaggaagtagtaattaggatatatttagtactaattagtactaaaatttttaggatggagaaagtactaatttgtactctcgggtcaaaatatagcaacctatgactgggtgtgactcatcctaatacaatgaatttggacatacatacatatatatatatatatatatatatatatatatatatatccatattcgaatttggacagatatatccagattcgttgtactataatatatcacatctagtccttcgttgctatatttgggatggaggaagtaagaaattagcagactagcacaagtaatgtgtatttttttatgtattttattacaaatcttaatatagaataccttgaacatatgagccttgcaagaactaagataggtcaaccacaagtcttcatatcaattttcataactataaaaaaagtagccaaatggttactcataatcttttgagaacaaatccatgaatatttgcccgggtttcctcacccaaaaggtataattatatcttcatggaacttaacttatttctctttttttctg

SEQ ID NO: 101635 - DNA, 638 bp, Oryza sativa
tgctaacaaatcctgtaattgaagtacaaatgcgaatacacctagatgtacccaccttttatatgaacacatacatatacattaccaatgaatacacatctaaaagactaagccggtatattgaaaatatattgaaagtaacgaagtaataagagctttgttgtagtttggcacatatctacattagtgaaaagtaaatttcaagatttcatcacaatgagccacgtcacatattgattcagggccattggatcagaagcaaagaaaaggtgaaatgaatattaaccgtccgatgtacagagagaaaggcaatcaaaaagtgggattctagacaatttcacgataccttacccagcgggagaacaaaataatctactactacttaaaaaataagaggtgctttcatcgtccgtcaaaaaaaccgggtaaaaaaaaccgggcagaaaaaaccaagtttgtccgataaaaaaaccggacgaaaaaaagtccgatccaaaaaaaaagtgaaaaaaaaaccgggcgaaaaaaaacacccgtcctgggaaaaaacacccgatcccttaaaaagggaaaaaaaaagttcgagagacaaaccgtttaatgaataaaaaaagcgaaaaaaaagagtcgattccttg

SEQ ID NO: 101636 - DNA, 732 bp, Oryza sativa
  unsure (1)..(732): unsure at all n locations
cgtgtaaactgagatgcagtngcacagtacnncatcagncacaattatttttgtaacttattccgaaatgtatgtaagacaaatatgtttcttaaaacatataacttattttcaaacttattatcagtagcacactttaggatggttaaagtcgcgtgaatgtgcaacttcataagctagtagtgttggatttaatatgtaagtagagggggcctttgtcccctcaaaatttacatctcacgtataccagaattacttgactttataatttaatatatacgagttataaatttatcctgtaagttagtataaatataatatatatgcatgccaccggtaaaaatttattgtgctttcacccctatgcacacattcaaccaagcatcatgatgatacaatacaccggcgtcgatagcggtctcaaactctcaatccttcacatcatctatcaaaaaaaaaatgtccttcacgtcagatccgaacatccatggcggtggggaccatggttctatgatatgtgcatatacaggttacggttgcctcgacgcgcttcagcttgggattgcgaaaccacaactcgggaccatgcgttgagcaacaccggagccctgtgatatgcatgggaaaaaattagaggtcgaggcgaggcctaggacttggtgtagtcgttggtgccactcgccgacgttgtggtagccttgccactccccaccactggcaaagacttttctc

SEQ ID NO: 101637 - DNA, 691 bp, Oryza sativa
ctaaaatgctaagacggctgtgtcatcaactgtttctatgaatgtctacatgcctgcatatgcatttggacaaaaactcacacacattacagctgtattatgactatggagaagtctttttagaccctaacatagaacatatataactggaattgcttgcatgcatgccatgtaaataaacatggaaaatttgacaacatatactatggagccatgaatcactccacaaatatgcaaataaacaaaggatagctaagtttaattaattgatatgccatcaaggaacataaatctcacagtacaatctgtagattccctcagcatatgcatattacaactactggatccgggacatattataagactttctagcactacctatattcatatagatgataatgaatctagctctatatatgtgtttagatgcattgacatctatataaatgtgggcaatgctagaaagtcttataatatgaagcggagggagtattaccaatattgctatacttccgacattgcctagggataaacattgagaaatgacatggataacattgcgatccttacgtacacatatgcatgaaagttatttgcctttaaatatgctaagaaacatatgcatacattagtcatgggccctatctcgagcgactacccttcatgcatgctttattgaagggtagcaact

SEQ ID NO: 101638 - DNA, 651 bp, Oryza sativa
ttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttggactgcttctagtttagatttgcagtagtgtagtaattcacttttaggttgctttacgtgtattcttttatttctagaagagtgaacatgattaataaaatgcatgaatttagatggcttaagaaaatggaccatacaaatatatcggtatagtgtatagggtttatatgttccaaagaaccaagaaatattacatatatttctattaaaaaagctaggcattgcattcccgaaatattaggttcctttttgctaacctttatgggtatgggatattggcactcatcagcgatatagcagtcattgccaagatcgagagcattgactctttgaagaactggaggagataatccgtgcttcag

SEQ ID NO: 101639 - DNA, 599 bp, Oryza sativa
ttgctgtagcaccacattgtcaaattatgaagcaattaggctcaaaagattcgtctcgcaaattagtcgtaatatgtgcaacttttttaagcctatatttaatactttatacaagtgtttaaacgttcgatgtgacagggcgtaaaattttggggtgggatctaaatagggccctagtaacatcctagtaaaagtcaagtaaaagtcatgagtagctagacgtgttcagacataacgcatcaattcaccgagacttcgggtatgcgtaaaagatattacctccatccctaaatatatgaactaactgacgtgatatatataaagaagaatggaagagtatttgaacaagtatctacccccatattcgatcatttgacaaacctataagacagcatcaccaaacaaattgatggtctaggccttaaaccctgttctgtcaattggatcatcggcaaccaacaaacaaactttcatggatggatcttcattgaggacctcgtaaatgtagtggcaatcgacatataggtaagagagacaaaagattcttaacaaatctaccttcataagaatattaacgataaacctaattacctcacgca

SEQ ID NO: 101640 - DNA, 528 bp, Oryza sativa
cttttgtgcttaagcattattgactgcattaccaaaagatacataaggttaattaattttaaattcgtccatgtgtccaagtgagacaagtccttcagagctttcttgagtacggatttgacattaatgaaccatggatagtatgaattgcatacagcaaattggacccaatacaatggcagacacaatcttcaagtgcatgtctcaaatctttattgcaaacaaagaaatgaatataaatgagacactagtatagtcgtggataagttttatggaattaatgtacgtagctgaaagcatttcgcatcaagataccaaacaggcatgtgttaaaaacctttccgatgtatgatatcaccagatatagaacaaattttgccaaaaagaaacagtgttcttttcagttccccaaataatgacataagccttaattgacactatgtttatgacacgcttgtcaagatgcatagttaaaagtagctatattttgcgggaaaatatgtagtgcaaaccatatatgtagtggaa

SEQ ID NO: 101641 - DNA, 553 bp, Oryza sativa
acacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaacatcaagttttcttcttgccgttgtcagtcgggggctattatcataataatggagtgtgattttttttatcaattcagtttgcttacttggtttatcattgccttgtttggtttttctacttagtttgagaggactgaaagtttttaatagcttctttgggttttaggctcaacaaagcttagcaaaaacttttaagaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcact

SEQ ID NO: 101642 - DNA, 635 bp, Oryza sativa
cattcccaaaataagtatttctataattcaaattttatataccaaatataaacatttctaaaacactaatttcaatacatattggagtagctcgtgttcggaaaaagccaattggagtagctcaaattaaatttgatagtaagtgaaaaaagagatcattcctccttaatcttactctttactaaacaaactagaaatacttatatatagaaattaatgaagtatattagagaacaaagaaaataacgtacttacgaaaccagtcccttcaattaatatcaggatcaatggtctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagt

SEQ ID NO: 101643 - DNA, 872 bp, Oryza sativa
ttgttcttctgctttgaagttccagcaatatctgccataaagcttggtagaaatgaactatttggcaattctgggacacaattacgaagatattcattgctagtgcccaaagacaagttgggaaatagatccggtactgacttcaaatgcttaagtggaatactgtcttccagactaaaattaggaagacccagtttcccttgaaatgaaggaatggacgatacaggattttctacatgatcaccaatccccttcccggatataggaggaatctgcacacaaaaaccttgtcattctttttctttaatgatgctcttaactagataaaacatcatatatgctgtactcaagaatggattctttttttcccaattttgcatccataaaaaatattttaaaaactaatatcagggtaggttgcaccatttcctcctaataagtataaagtggacaactatcttatatttttcacttttgaagaaaaagcatgaacaacgataaagcaactagatgaaataatatgctaccaaagaaagaagaggacatacaggttggaaggggaagtaactgtctggaatgatattattcagccttcgcaaagtctcctcggaggaaccaggaaacataggcttacaaggagttggttggccatcatgtatttgttcgctagaatgaccaacagcttgagtcaacagcggtttgttggctaattcaccactagctcttttttgctcctttgtgcttggcccacaaactgaccctttatatgagttcatctgatcagcatttggagcacaaaggccaagaacaggtaaaaggtgatgtggagttcctgaattggagatatctgctgcctttgggtgatgttttga

SEQ ID NO: 101644 - DNA, 649 bp, Oryza sativa
cccatgaacgtgttgatctcttatttcttctttcttcctttgctgataacctgacacttggttttgttatgcacgtaagtgttgtctattggccatgctttgcagctcgacaacaccagtcacacacgatcacgagtccttccaccacggcaccattagccagattgtggtgaactcatttctcgccaccaacaaccatgttagtcgtaaaaaatgcattacccttattttattgatatattcatacataagctttacttattgtattctcgagcatggttgccctaataatttatataccttttccctttaggtgtgactcaaacgtgcctctcaccatgataaccctttgaaaagaccaagacaactccggcctatgttgacagcccctatccaactagatccatctttcgtaaatgttaagtaaaggaagaaagatactctacagacataagggtaaagacactcctagacgtaataatagttagatctttgagggaagacactttcaaaatatgataatttgctaccgatatttgcaaatatttaattttggttgactaagagagagaaataacacgaaaagtcaaaaccaccgtagacccacgcatattcttcctcttgctctctatttttccttttctcctag

SEQ ID NO: 101645 - DNA, 737 bp, Oryza sativa
agcccagtcgttcggttgtggaaacggctgcaacccactccccgcaaaaaaaaagttggtttctcgcgaaaaaaaagaaagtacctatacatctttcgaaagatttttataatcgtatcacacagatttttaatctttatattaaaatctgatagatataataaaaagcaaaaagcataagaaacaccataatggacactaaattaccatatcctcaagaaaaagaccaaatcaaatataaaatttaaaatttacatgcgaagattcaaaaattacagtgtaacttacaaaagttatagtgtaagtttcataaattacactgtaacttacaagaaaatgcactgtaagtttgagttagaaaatcgagtgagagataagaaaaaaatctttcgagtgagatatagcgaaatccaaaaaaaatgacgcccctcttctagttcccatctcccagtcctatcgcgtagcccacactccaccctatcgcgccttctcttccatcgccacggcccacactctgccgagcgcgtctcgatcccctccgccttctctcccgtcctcctcctgccgagccacgccgtgccttcccgatctcctccacgttctctcccatcctcatccctccgagccgtgccgtgccttccggtcgcgcccgacgccaccccttcccatccccttccttttttcctctcaccactcccgatatgatcgattaaatccaataggatgtgaagttcatc

SEQ ID NO: 101646 - DNA, 733 bp, Oryza sativa
ccgaatttgtcgtgatactttctaattggtgtgcacgggaagatatgttcccctttccagacaggtggtgaaaatccttttcgcgtgttattttggttacatttggtttgggggagtttgagaatgctaatggaagcataggatgaattagagcattttaatctttgaagaacatggaatttgagagagattgaaatgggaaattgatcgaactcccatcgattccatcccaaccgttcatcataaattatgataataatttcttatctcaaaacccacaaccgaacaaataacataaattcccttttaaacatcccctattatttctctctagcaactaaataaggaattgacagcatgtttggttagggggaattgttaacagggatggaactttgagaggtacacctactgtttggttggtggatgtggaagcttgtgagggatttgagaaggagtttaaagagcaaactcccaattgggtaagggcatgtaatttctagggaatttcttttctaagtatgacgagataaatctgagctttacatcatcacttaaaattcaattatcatccatactacccatgattctcatctctactaccaaataaaagactgggaataaaaaaatgaaactcccataactcactcctctaaaacttccaatcccctttcattctcttggcaaacaaaccatgggactaaaaattaaattctgatattaattctctttg

SEQ ID NO: 101647 - DNA, 1217 bp, Oryza sativa
tgtcgatttttcaaaattgtggacctaagtgacacttcgctccaactttaaggaccggccttgtattttactctttctaaattattagtcaatactttgcaagatggatatattcgctgctcatttgcctggatgttgctcatttgccttgatctagttttttttatctgattgtttatctatttatctagacatttaactcagataatattatcatcacttgtgatatgtctccctagaacccgtattgctgaaagtgaacagtaaatctaaaaaaataggtccttgagaaggtacctatttttttatagtaaaattttgctacctcgagttacctagtacttacttgtagataataagttttacactagaaaatgtgatacctcctactaccttctgaaggatgataaattatcattcttatgataatgtttttttatgttgatatacgatatattacctttgggaagccttaaaatttgatattttttactatattttctaattgttatgatcacttgtcaagttgctcccctcatgcttagatgctggcttccccagtgaatgcaccactgatgatagaggcatggaggttgatggcttgactggcctttcatgatatggagatcaattaaactggataccattatatcattaaagaatacaaaatggagaggaaaagtacaagggaaactaaagccgttttactaaggacaaaggtcactagatactaggtcgtggaatagggtcaagggaagcatggaccttacctgtgaaaatcatatctgtaacacattgtgtttgtatttcttttggggaaaatgaggatgataacatgaagtggaagaggtagcagaggacaaaaatgtggatgattattgtaatctgatgagcgccttggaaacttatacctgacatttttgaagtaaattttaggaaagcttgactggtacggttgaagttgcacaaatcacacgtgttatgttacaccagatattgtggtagaggcttacagcctagagtatcacgaaatcatacattaaccaatctaacgtgctaatactacataataaaaataaatacttaacttaggagtactccctccgtcccaaaataaggcaacctgtgaccactcctaatacaacgaatctagacaacccttcgtccagattcattgtagattagatgaccaaagaagatgcgaccataagttctca

SEQ ID NO: 101648 - DNA, 511 bp, Oryza sativa
gtaaggcacaagccaaatgtgaagctcttgcatcatatctcaaactaactcctgcaaattccccgtggaactggtgcaacgtaatcttgaatatttgcccgtattgtgtacatataaaactgggtatctattatatggctgcattagaatactccgttggcattatgttcctttcaggttctataaagggaactaagcaacaagaagctcccctgggagatagaggctcaggttagctgtattgtaaatttcagaaaattgcaactatagagacactctgttattgcagcaaactgaaataggtcactaatgttgcagcaaactgatagttttgtcctacgttgcagttttctaaaatttactctttcataaatgataaatctaaagaatgatttccgttttgcttcttctgtcatgaacttctgcattgcctgtgcgggcgcaacaatctatcgtcatgtctgttggcagcaataatttctaaatgaccacttgttattgctacgtgtta

SEQ ID NO: 101649 - DNA, 663 bp, Oryza sativa
ttcctgcagccctcaatcgtttctcgaatgaaaatcgtgttcccaaattcacactccaaatttgccattcaaatccctgcacctctacaaaaatttctactgttcattcgaaaacacaaacaattgtttattggatcatcccaactccatacatatatactatatgatgcccgcggatcatatatcctaactccatacatatatactagatgatcctcgtgcttttctgcgggatatatgttagatattggagaaatgatgaaatgatttagtttgaaatattatgaaaatgatttgtcaataatgaattagcatgtgtatgtttagttttataataaaatagattgtagatataattactatatgcttgcatattgagttttgtgtgcttaatgggttaatgtagcatgcttgcagtaggttttaggagtacgaataaatacaatgcttgcatgttatgttttaggtgcttaattagtagcttaataaaaagaagggatatgaaaaatcgacaatctttccttcattttattggtctgaatggcccaaaattaagtgcagccaaagcaatcccagcgaacacggccacaccaagggaccccaagatcatctccatggagctcaccgtggacacctcctccctcttgacatgcgccgacgcgg

SEQ ID NO: 101650 - DNA, 719 bp, Oryza sativa
ttcctgcagcccctttctagcaggaagcttggacggcagatggcggttttgttgacagtaattatcttcaacttggaaggcttccccttctccatcttaacaggtcctttccaacagattcctcatggctttcaccaatcatggaggattcaagatcttctgtgaccactgggttcagtttctgttttctcctcgccaggagaaatggaaagcttttgggacgatggactacttttaaaatttttttcctttagtatagtgaaaaatatgataaactgtaccataaaaaaaatgaagggacaattgcttatttaaccccttttcagagcctaactaccaatgtaaccctaccttttctagttagttcatttgaccccacttttcaataacaaaggtaccgtcttaccctatttcattacaccgttagggttatatatatttagtaaaaagaaaaaaaaatcaaattactattcaaactgaccaaaatacccttgaggacccaaccctatccattcactcccaacctcatccctctcggctggcactaggtgaggaggccgcgacggcagtggtgtgcagagaaagggagcagcgcgctggtctatctgccataacagggtcaaaataagcaagggcaaaagggactatttgcccttagttaacactgttatcttgacttcacaaagtagggtcaatcttcatcttcgattttgaaaaac

SEQ ID NO: 101651 - DNA, 733 bp, Oryza sativa
atcacccccttataaacaaggcatggactccccagcgacccccgtgggcttatctctgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaattaagccatcatgaaataatagtgaatcataagttatcccaatagtgtgctaatgtttctaagcagggctaagcaattatttctaatatctagttgaaccaatataaataaagctcaactagtcaaattatagtaacccaaggtatcaaggaataaagtaatcaagaacaaaagggctataacaatgaataggttaattccacccaatgacattcgaaaataaatgcaatagttgaatagaaataatagctttaaataggatcaacatgctcaaagggttgtttgggatctgtgtgacttgccttgttggccttggaactcttcaaactcttctccggcgaaaacggactctccggaaacgacggaatctaagcagaaaagagcaaaatcaccaaaacagcacataaacaagcatgaacagtacatgtggatatttttaatg

SEQ ID NO: 101652 - DNA, 753 bp, Oryza sativa
cgaattcctgcagcccttttatacgtttactacacattgtcatttttaaaagtatctttacatagtttaaaatgtcacaagaaaatacctttacatatcaggcgcattttacagtaccgaaagaatgcctctacgagataaaatccaataaactgagctgaaaatgtctctagagtaaaaattttctaggcaatttataaagtgtctctactcctgtaaatctctcaatgcgatgaaaatatctgagctcctgagcatacaaaatatactgacttgctgctgataaagatgttatttgtgctaaactagactagagggcagaaaggcaataatagtttggaaagatagaatatatctgttggtcactcttttctttcagtgcctatatgtatgcatagaactaaggatttgagaggagaacatgtatatgtttgtcttcaggggtttccatgtctttatagatataccaccacatcacttcatgaaactttgggaggcattcaagagtgttatatctccatttaacacaatgatggaatattgctggctaacttagccgacgtgtaataacgatggaaataatggagtccaactttggtaggttcaaataattatctcttgttaggaaacagtaataatacacacactcactccctctgtctctaaaaacaaatctacaccttttatttttagggatggagggagtatatatatataactacagaaaactattaaaatgtacctccagtacct

SEQ ID NO: 101653 - DNA, 513 bp, Oryza sativa
ttgaggagtcctgttcagctaaacctgaccataagaatggtaatgcccattggttcattgttgcaatatagttcaatgacatatcttattattcaccatatgtaatggctagacattagatacatctgctgattatgaatctgaaatgtgtggtaatacaacttctgatccttagtgtcaacagctctaaccataaacaatttctgcatctttgttcttgttaaaagattgcatgatttcaatcacacaacaatcctactatttatatcaagtatatatacctgtcatttatatcagttagtacattatgaagttgggataaaaaatatgttctttgttctgttccaactcctgatcaaacatacaaaatactaaactagatcatctggcagcacatctaatgattgtgtcctccatcttaactagctgcaaagtatgttaagatcagcacttgatgccacaaattttaaaatattataacatttcagaaaaaatcattgaacactatcatgg

SEQ ID NO: 101654 - DNA, 509 bp, Oryza sativa
tttttaactaaccaacctaaatatttaaaaaaaacatagcttaaatgacttaataatttctaaaattatattttgatttttaatttgttttaattattgttttattttacagttaattaaataattcaatatccattatagttgtattttactatatagaaattaaaatactcctatgcagggcaactgaatgaaattgaaaaattataacagaatgaaaacatgtattatttcatattaaacaatctacgcaataaaaaccaaaaccaattaaagacctttagagcacacttaagtcaccatatgtcacattttaaaattataaaatatttcatttaaatcgatggacccattattttcaaccattagatttaatttacgaaaaatcttacgctgccacgtgtcatgtcctgaaaatcataaataatcttaaaaattttgagaaaaaattaaacctatcatcattggttttaagttacattatttggagaagttataaaaataaatcg

SEQ ID NO: 101655 - DNA, 731 bp, Oryza sativa
aaaaagtgacactttgctatggcaaacccatcacttatgatcacaaccgtaataggtgcaattattggaagagcataaattacacttaatttttctgagggaatctatcctactatgtcatatcaaatatataacagcaataaagtaagatagatataaaaaccccaagcgaaatctaaggggcaacgcacacggcggtcccgccatgtgaaaaccttaacgacataatcaaattatgccgaaaccgagtcaatctcattggctcatttttctcattggcatgcggttccagtggacatcggactattcgatgaacacaatcgcgctcggccttggtgagtactagacattccattgaagtcaccaacacacataccgactgatctcatcaacccatgcggctattggttcatctcatgttccgatcacctaagaactcatatacaacataatagatctcatctactacatccgcatatcaattatatgcaatgatctagatcataaactatacaacgcggctctgataccactgttcggatacgcgtaggctacgatagcataaatcaaaattttctatcggggaaaccaggaaacatgcaagtattagatcatagatcgtaccactcgacgcgctgtggcagcggaagaagacgctgagaagtcgaaggaactctcgcgaaagagcgcgcgtcgatgtaaaggaagtagtcgattgcaccggattgacc

SEQ ID NO: 101656 - DNA, 1866 bp, Oryza sativa
atagattatataacttgtgattgactcctcaatcacctttggcatggtaatgcacttccataatctacaacatcgaggggcctagagatatctctccataggaagcgcaaatcccatcttgattattcatatcccactacatgtttcatagcatacccgaaaactacttttataactacccaattacggagtagcatttagcagtccctaagtaagctattacacatgttgagaaccatgataatctcaggtctaaggattcaacaccaacactaaatgagatcagtgatgacacaacacatatggctcttgcagtgtctcatgttgggtctatccaacaacatgttcactaacatgtgtccacattattaatttggtatctctataccatgatccatgagacatgatcatcaattaatacatgtgctaatcatataaacatatttgttccacatatgatatttgatcagggatcctttagaaatagtaacaaacaacataaagagtctcatgaaagaatcacatattcattaaccaataaggagttatctatttcaacgaacaatgtcggataaatatgtaaacatagtatgagatacaatcatctctatgattacctctagggcatatcactaacatcctcaacgtgccacacatcctgtcgactccagagtcgccaacccgacgcggtcgttattctagaagcccatggttaggacgtcgtcgtcaatgatggcgtgggattgggagaaaaagggaattaaggaggaagaagaatttgacaagtgaggtcaggggtatttttgacctttcacgccatttatctctcctattcaaccgaaaattaatattttaatgggcgcggtgtccactaacaaataaccatgtttagagagtattttccttgcaaaagtgatcatgtgcggtattctacagcttaaatcatcaagtcgcgatatcctgtagctaaacttgcctttcttcttcataatttcagcaaccatgatttctccatgaagaattcactagctcaaaaaatccctcaagctccacccaaaagttttcaaatatgaaaatagaggccttaggaattgaggtaccaatctataccaaacactgggtgtgtttgggaaattctctgttgagtgttcttggattagtgccctaaataagtaaaagaatagagagagtagacatcatgtttggtctattaaatacacatggtatgtgcgatattccatatactaagtctgattaattaagtgacacaaataataataaacagaattcatgcaataaaaaaatactatgtaataatagttgacctaacaaaagtgtactttagtctatgatgtttaactatatatactaattatatttttgtaattgtgctcttattttatttttaattcatttcttcatagaaaatagcaaagcatataaaaaaagtgggaggagtaaatagaagtttatttttaattagataaaacattgctatttaccttattttttaatacaaaatatcttcaattaatatatccttaaatccacaaagacaactgtagtatacaagaaaataatgttaattaaagtttaggaactccaaaaataaaatatgccaaatatattcaaaaaatatatgcagactacaaatgatacataggaacaaactcaattatagtgtgacacaattcttataaattcaaaatcgcaaggtttcaagtaatttaagtttagaatttatttgttgcaaggataattacaagaaattcataaccaacaaaataattaatcccaaacaaattattgacgaaaacaggtttagaacaaagataatgaatatttcaagaaaaattaatcaaccac

SEQ ID NO: 101657 - DNA, 656 bp, Oryza sativa
ttgacaaagccactccctcagcctaagcatgagacacacactagggcaatgggtgtaagatacattcatgattgactctagtgcaagtggaagactgttagtgacatgccctagagacaatcatagagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatgggatagagataccaaattaataatgtggacacatgatagtgaacatgttgttggatagacccaacatgagacactgcaagagccatatgtgttgggtcatcagtgatctcatttagggttggtgttgatccttaaacctgaaattatcatggttctcaacatgtgtagaagcttacttaggactgcttaacgctactccgtaattggatagttttaaaggaggttttgggtatgctattgaacatgtagtgggatttgaataatcaagaggggatttgccctttctttggagagatatctttaggcccctc

SEQ ID NO: 101658 - DNA, 2360 bp, Oryza sativa
catatgcaatagtactattcatatatgttgggttgtcttttttatttctcaacttgtgagttaagttttaacttgatttttttgagtagtttgtgtgtgtgtgtgtgtggagagagagagagagagagagagagagagagagagagagagagagtttgaatgttgttattttttagaatttttaacaattatttgggtgacatttgaacaaataggaaacatctcctcgagagtttaaaatacttaatccaatagtgcaccctaactttaactgtccaaaatagcagctccttccgtccacaatgggtgtaatggatcatatggatgttagaatcttttggaaagattaaggatgtagagaaaaaatagtatccacttattaaaagaggggtggttgagaattggaggacgattgaggtaagatgagaaagaaattgaataatgggtgattgatgggataataccctaattttattatatttgtggacaaattgtgacctccaaaatccactatatttgtggacttggggagtaggtttaaaatgaaagctaatacaagattcactccgtcccaaaatataacaacttctccacatgaattctcttatcaaccaatcataattcttttctatttaattttctaacctactttctctttctcttgtcaactaattagaaacttctcctatttcatttcatatactttcttaatatttatgtctaataaaaaagtaggagaaagtataaaagatttcagaatttgcagaataccaattgggaagaagcagtcatatgctttagcactgtttaactttttttccccctaaccgtagcactgttaattttcaccatatcttgagtccaacatgccatgcatcttgggaaggtcagaattcagatgtgtcaaatacagaaatttgacatgtcagtccaagtggtggatgaatagcatcatgggacatagacaccttaggaagaaaatgaaataatgatacttgtaattatttggttcgacttgacagatgctggccatcgacagaacttgacaacagacaaatattccaatggaacagaagaagcatcggttcatattccaataaatcagaataaaataattaatactacctctattctaaaataagtgcagccatgattttctgcgcccaactttgaccgttcgtcttatttgaaaatttttttgaaaaaaattaaaaacataagtcacgagtagagtactattcatgttttattatcccataacaacaaaaatgctaattataaaaaaatttcaaataagacggacgatcaaagttgagcgcgaaaactcatggctacacttattttgggacggaagtagtaatgaattaatttatggtagtagaaaattagggagatagtaattaattatgagaccacaatctttcatgctccatacgtcttgtccttgaatttatctctatttctaacaaagaaatctaatgtgatgaacagaagttacaagttacagaacgaggttggaatattgaatgagtgcagcggcgaaaaaggactgcaaaaaaggcactgaagaaaaagaaaatccctctcttgtgagcatctctagctaaacgaattcacgaactaaagaaaaagaattatttttttctcttaattcgcacttaccaagaaggcaagaacccgctaattaatcgcgcacgcatctctcaattctcatggagaattacaaggtgagatccaagctcacattctcccggttaatctctgccaggtctcccaggcggcggcgctcgtggtgatgctgcgaagacgacgacgccgacgacgacgaggacgacgaccgcgacagccgcgagccgggttgcagttgcaccaccgcggcggcggcgccgcctaccccgttccctctccttacctccaccattgcgtcctcctcctcgcgtccaccggccagcgacagcggcggctgccgttcttggcgcgccagcggcgcggcggccgccgccacggcgatggcggcggcggggacacgccacagcgcagcggcggccggcaccaccgggctgccgttgatcgggtgcgagacggagcctggcggcgccgggccgtagtacctcgccgccaccatgggcgcgggaccgccgggcgggaggtggtggtggttggaccacgaggggtacggcggcggcggcggcggcgccatgtgcggcggcgaggggccgaagcggtgcgagccgtactagctgggtaggcagggtaggccgggtagtgcgcgtgcatggccatggcgctctggaactgcgcgcgcttcaagtgctgccgctcccgcttgtgcgcgttctggtgccctcccaacgcctgcg

SEQ ID NO: 101659 - DNA, 617 bp, Oryza sativa
aaaaatacacgtatacaaactttgtatacgtgtatataaaattgatatacgtacgtaaaaaaagcccaaaaaatacacgtatacaaactttatatatgtgtgcatatgatatatatatatatatatatatatatatatatatataattttttatatgcatgaacttttaatgtataaaaaatatacacatgtatataaaatgtatataaagtttgtgtgcatatgaataaagaactaaaaaatacacgtatacaaactttgtatacgtgtatataaaattgatatacgtatgtaaaaaaagcccaaaaaatacacgtatacaaactttatatatgtgtatacaaaatttgtatacgtgtatacaaaattggtatgcgcaggtataaaacccagaaaatacacgtatacaaagtttgtatacgtatatacaaagtttgtatatgtacatattaaaaaaccgaaaaaactaaaaaaatatggaaagaaataaaaacagaaaaagaaacgtgcgtaacaaaaaaaaccgcacggcaaagatacagaaagaaaaaaaaacagaaaaaacaaaaagaaagaaaaccgtccaaaaaaaaaagaaagaaaaatcgttcggaaaa

SEQ ID NO: 101660 - DNA, 586 bp, Oryza sativa
tgtgttaaaagtgaaatcttacatcatattgggttctgtttattctcttcaaggaagagaaagtcccaccgaacacgtgttaaagtagcagaatcacaaaagacggttgattattcctgggaaattttgttttattcgggagacatttcctggttcaattctcttctcattttctttacggagaaagtgagagctttcttactcaattaaagatgctttcgttcaccaagaattaaagattcaattaatggccggtggaatatcacccaaattaactatttaaccaaaccgctaatccagctgaggaattttttttttagaatgggaaatcgcaaaaatatagatcggtaggcaaaatcgtaagtttagcaccctgtcaaacaaccgtggtttgacggggacctatcaaactgcaacagttcaatagggtagttggtcaaaataaaaaataaaaaaagtacataaacagtgacgctacagtgattggtaggggcatgtcgaactacccatgttcgatatgtttgatgaacagtgccactacagtgataattctcttttttaaaatttttttatcacctcgacaagt

SEQ ID NO: 101661 - DNA, 712 bp, Oryza sativa
ccatagtatggggtgcctcggagaggcatatgcaagagaaagaagagcgaagaaaatgaacaagctcgagatagtcaaaactatatttatttattacaatacaactttgtgctattcactgaaaactttcttttttttagtttggttgtttctcttttatcgaaacaatatagtaaatcttttgctagttcctcctggtgaccctctcttctgagttgttcatcagagtatactgagtgtggacccccgtttttataacaggaatcaatcgtgtaatcagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaacgtactaagacctactggacgccatcgtcttcatctctctcctgataataggcatagggatcctccgaggcttcatctcccgcatctgataaattttatatttgcaaggatgagtaccaaccgtactcagcaagccaccacagcaacaatgcatatgaaaggggagttcaaaggatggccatagttcttttgcgcaaagcaagtttttgtaattcttt

SEQ ID NO: 101662 - DNA, 512 bp, Oryza sativa
taagagaagcgtttcataaccttcattctcaatatgtactatgccttctcatgtacatcactggtggactgcctttttaatttattgacagcaaaagtgtggttgacaacaatgatatacgaacatttcttcactttcagttaagaaatataaattcagaggtcgctcatgcaattcttttctcccattatatatattgaaaaaaaatacaagagacagatcctcgcaaaataaatggtgtgttagcttatatatattgtgtcttaggaaaaaaatgcttgatggtatgtaatttcatttacgcctgaaatatacatgcaaatttctagcaaatatttttttgtgtttttgcggatacatacttctagaaaaagaaaggctcaatcgtggctttggagaaagggttcttttcagttgtaggcgatgtacccgtcaatagtgaaacacttgtgatgattttgtcaatctgatgataagttggcttagtctttgaggtgcttataagatagggt

SEQ ID NO: 101663 - DNA, 564 bp, Oryza sativa
cctgcagcccttaaaaattgcctagaaaacttttactctagagacactttagagacattttcaacatattttattaaattttatcttgtagatgcattctttcggtattttctgaatgtgcctggtttgcaaaggcattttcttgaggcattatttactctatagagacttgttagaatgcaatgtattactaattaagggactaaatataagtaacacaagtcacaaacctacaaggaatcgcatgtggttgagttgattagtgcattgaagatacaaatgatttgcccaatagatcttaagttcaaggattggcaatatcaagggaaaatattttattatatttttttcccgtttcatatgttcgtggtacaatttaatgtctctaggaaatacctctactgtcttcattgggggtaaattaaaagtgactgcgctcctcccacagcgatttagccaatttcagggcagcgtattcgactccgccgctatccacgtcgcccgcgctccctcccgcacgcgatgtggggtctgctgtgggcccgcgtgcgcgcttcccgcgcg

SEQ ID NO: 101664 - DNA, 832 bp, Oryza sativa
gttctttggtgggccatttctgcaacataacaatttatagttggaagcccaggtgattggtgttgatagaggaaattagggatatgtagttagtctctctggattgattcgtgaaacatggcttcgtgataacaagaagggggtacattgaggcatgcaaacctatgtaattccatatgttgaaacatggcaccacaaattcgggaattggcgcactatttggtttggttttgttaaattttgttcagttgagttcatttattggttcaatgttgaaataggtttattgcacatgaaacttgtttgtgatggatcactaggggctgttaattgattttaaaatagcttctgaactatagcaagtcaactttgaataaagctcaattaaactcagacttggcttgattgccatacatgttttcagacaacagtctgttctagggggtgaaaacttctgaaaaatttcaaattggtttttcaggtagatttagttaatttaattgactagtgtaattcaccaacttaggatagttaatacttcagtttgccgcatttctcttatcaactgtattgggcattgtatatcttctatcgtaataatcaaactatgcaattttctttttcttactctaaaatattggatatgtgtttttcttttgaggcaaactcatatacttatgaatcgtcaattgattgttctctcctctatgtagatgttactaccagggttcaagaatcaggtatcgacatgatgattagctcctacatttttcttctgcgccagcctgcccattgtcactcctataatttgctcagactgtcgtatgtgtag

SEQ ID NO: 101665 - DNA, 530 bp, Oryza sativa
cttaccacccacttttgttcatttaatattgtagctacaacaataactaatacccactgaaacaagacctaccattatacacaaagtaggtatttcctccgtttcacaatgtaaatcattttagcattttccacattcatatcgatgttaatgaatctaaacatatatatctatctagatcattaacatcgatatgaatgtgggaaatgatagaatgacttacattgggtaacggagaaagtagtaaacattggtgatgcccttatagacattagctttttaaacctaataatccagagaaacaaataactcatgacttattctactatagcttatccaagggatccccttagttcatcgatcgccttctcaggcctgtatctaggatgcaggtcgttggtctgaccgcttccgaagtaacgattgctttgtggtctccatctggaaagctattttctcgcttccgctgcatttgctgaaacttactctgtgcccgttcttgggtcttcttcttcttctactgcctgttg

SEQ ID NO: 101666 - DNA, 633 bp, Oryza sativa
cattggttgaggcttccgtcgcacaacactccatggtcggttgttgtcgccatggctagcctccacatgagtggcgtgtgctttcgtcagtattatttttgcaatttagtcttcaacttgggccagcggcgcccatgatgttgcacgcctaccttctctttgtttttgagggaaaggctcaacggacaccatattgacggcatggtagtctgggttgatggcatctgcatcaagattgattcttttctcgttgactgccctttggagccattctttgaaggcgatgcaatcttcaatagcatggccgacatacctatgataaggataatataatggattgtcagtcatggttacctggtcaggtctccgtggttcaggcagattcaaggcgcgatgttccatcaactggttgaatatatctttcaccaactcccggcggaagatgtattgctttttgagaagatcttgaagcgtggagcgttgcctgcccccaacttgctcattctttgctccaatcatgggcacctgtccttgaggtgcggtggagaagacttttgtggaattagcttcggttggaactttgggtttgttcccactaccactaggctttgttgcgttaaagcgtttggtagg

SEQ ID NO: 101667 - DNA, 620 bp, Oryza sativa
aaaaagatgccgctcggtttggatagagagaggccaaagaaaaaactaggggcagtttcggcacaaaaggttctaaaagagagcaaaatctttttcatcattaacccaaaatgataaaaatagcaaaatatcaaactgcactctgttgacaatggtattctagtgaagcccgttttaataataggatgtatctaaactcattcttatgtatagctagatctccaatatgcatggactggatggcactgattccttgacttgttcatgcttgggctgcaccaatcgacctgatcaacacatttctttcacatttatgaaccaaactgctgaacaaataagtccaacttcgctggaatacaaatttatgttcgatataatttatataccttaaccgtaataccctaaaactattaaaaccagtctaatttgacttccaagacagtaattacaacggtaattgttgacgaggcttattgatatggtccaactggctgactcagcagatgtcagtggctgactcagcagatgtcagtgtcccctcctctgtatctctctcttcatctcttctatcccccacattggattgcaagattgcgactcacatgactttgagtcactaa

SEQ ID NO: 101668 - DNA, 3621 bp, Oryza sativa
tttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgtcatgttttggttacaatttctgacttttacgtgccatttaaataattccaaaatattatgaaaaaataacgatatagattttatcatcaaacataattacacaataattaaattagaaaataaattactccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttcgttcgtacacttacggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccatcggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactaccatggttgtataaatggctaattctttcaaacaacaaagataaaataggataagcattgtaggcttcatatttaggattatgcaatataaacataatcactaaaggcctaatgcatgttagctaagataaaatcacaaagtgattgtttgcattatgtaaaatcctaatgtttaatcataaattttagagtaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacgtggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttcataaatagacagatccacacttattctgtgaaaatagaagcgacgaactcaggttccatacttaagctaagtcaaacagcatccgtaatacctctcagatataggcatatatcgtgccatgaaaagaataagtggacataaaaaatgaaacagttctacaagttctgctgatctgcatctttgatttcagggattaaatgcgtaagattaataaaaccaacattgatgcactaacacgttactgagattagcaaacagaaaatggctttatgcttgaggggaataatgaaaaactacaagaataaatttggcatcccttcaacataactcaattttctcaactatgcataaacagatttagattgttctacagtaccccttcactgtgtatttaagacattgcaagttgcaacaactgtcatgctgcatcgcaaaatgagattgcctaaggaaacttggacctgttcaagtactggaatttgaaacacgttgttgaataattcaaacaatctcacagtagaaccacagagatcattgcatttattaacaaaaagagtaaaaaaaatgaagaccaaattttggaattctgatgggcacaaaaattctacataatgacatatatagcaaacatcttcaattgtactgcacgaactaggcagcaaattagatggttatcagagcatccaaaataattgccatgaccatttccatatgcgcatcacggtacaaaagcaactcctacttggcaatcaacacaatgtagcatgcctaagtgccatattttcatcagtactgtctgccgctgacagcagcaaggcaaaattcttactttcagttcaagttcgcttcctttttttccaataacttatgtcaataaccatagaatattccaaaaacgggtactaaaat

SEQ ID NO: 101669 - DNA, 1251 bp, Oryza sativa
agaaaataactgccatatactcgagacatatctacatcagtatgcacctttcactttacatagctaggcttagtgcttttttagcatttttcattgttttttattagaaaacagtttcgaatatgcgtaatttactagtcttaggaagcatcgggaatataaggtcaacgatcatcgtcctcatgatagaaattatggtagacacgtgtaaaaaaatatacatgtcggaacatgagagtttggttgttctgtgggacaggacacatcagcaccttatgtttagattcttgacttacacctgccggtggaatattggtggtaccttccaccatggtgcatcaagatgcaagatgtggacaaatatggcatttgcatagtttgcttaagaaccagaggcagatttaaaagtcactaggaatatggtagatgtgcttcctttattagtccttccttgaatactagctttactttgtgtttcttctcttttcttcgaccatcacatttgtttctctatgacatgattagtaagcatcaggaacgaaaggtcaaccttctcagtgaacgctcgatatcaatcattgcacacatattggagatgaccaggatttccttaggtgaattctggcaaggaggaatgatcacacacataaccccagcttcaaccgatggaagaagacccgaaacacaaccaatgtaaatactaatgtaaatcaaccgtgtgtacatttaatcatactactagaatactaacactacgtgcaggggttgaggcaagatttcaccgagagtaggaccaagctatgctgtttcaaaattttcaccgagtttctatctaaattttggtatatattttgccattgaaattctttgtcacgtgtggggcccaagcccaagctgcctcacacgtggcttcgtccctgactacttagtggaatgtactgtaaaagctcccacaatccttaaaacaagagataataccttctaatagcttagagcttcagtgtacaactcgaggttgggctgtggcggtgcagttgggctagtagcaaagcaaggtcgagggttgggtgaagcatcgctcgcacaaacgcatctagctagctaccgttccgacaccacttgtggaaggagctcatgtgcatagggatcccacatgcatgcctttcactttttctgtgatattttcattcccgagtaagatgtgttcgctcttcaagctcacgccacgcatttttggcccaactaattaag

SEQ ID NO: 101670 - DNA, 748 bp, Oryza sativa
tgcgcccccaccacccccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatagacggtgcagcttgacattcaccgagggcttgaggaggtcgtggtggagagaaatgggaaaaaaagagaagacgatgaatctgacaggtgggcccacgtgcagatgaggaagaagactgaaaacatgacgtcgatagtatggttcccattttgtaaaatttaagtggcacggttacgaataaatgaattataatgatatttatctgaatagacacatttgtaatgacacggatcaaattaacccttttcagtttgag

SEQ ID NO: 101671 - DNA, 635 bp, Oryza sativa
attatagtcctgaaaagaaactttaatgaatcatacatttgtgctgattctggatgttatttccttccgttaagattatacctggatcatggtttgctgaatatattgaatcataattcaggacgcatttgtgctcattctgggtatgtgtcagtcattaagcttccatctggatgcattactcttggttacaacttaaaaggcatcatgatttgctgaataagttgtatactcttccaactggctgatttccagggaagttcagctcttgatttggactcattcatacgactgcagctttgggccaggtactagtcctactacctagtatatcatccatgttcctatttgcattattgtcaaggtatttggttctacaaccagaatttctggaaactagaggtctagagctaatagctactagtaagttattgcttaacgcatcatcttgcaactatctgcactaatagccactagttgtcgacaaatctgtctgcagcattcaaatgggcgattttatattggggtactattggcagtgcagctagtgaatccattgaaggctccggtcaaatatgaatggtagataatgaagctgcttcccccttaagggtcaaggaatgaccattttcaaa

SEQ ID NO: 101672 - DNA, 740 bp, Oryza sativa
gactacttgagagtttggatgtccagcatgtgataatgcaacaatagtgagttttatgtgtgtttagcataacaactatatgcaaattttggaaggttggagagcacaagcgataagcacggagggcaggatatataggctgatgtgggtgaaatttgtcgctagatgaaggctttaggttacattgttcaacgagagtaggaggtggtggaggtgacctgatatgaatagtggtgagaaagctcaatttgattgtcaaatgtggtatgtggagtaagcaaaatagaggttggttgtgcaaccgcgatcattttggctcaaccgccaaccaaatgcaacagtaacatttgtgtcgatctgattctagttatgtgattttggagccaatactttggagaaaagatgagtattaaaaaaaactttgcatgcacattcaatctgacgtcaacatttcgcttttggaatataatgttgctttactgagcattatatttgtgtgaatcgtttgtgttattgtgtacattttgctttgagcctaaattcttccgttttagttcattgatgaaccccaaaaaagagagcagctactggacaattaatttatcaagtactagtattacggaactgctattttcaaacatattactgtataccatgctaagcatacgtgcctctgttatactagagttgaaagtttgtgatgttcatagatctacctcccatctctgatgtccatgtaa

SEQ ID NO: 101673 - DNA, 713 bp, Oryza sativa
tgatcaatgattcgatcctctccttaatggatctagctatgaattagagggatctgcggtgaatcagggacgggacggggtgggctagcttccgagttcccaactatgaacgtggaagtatatatattgtgcgatgcgcgccccctgcggcttccagcttcctgtgtgtacgcgggatgcgcgcaaataatttcatggaagttctccgttctgaactttgacgaagggttaagattaaatggatgatggataatgaatggttaggatttaaaaatgggtgggaaattatttcccttagacatttgccaaacactgccaaagcgtcggtgacgtcaccctccatttatgtccctccctctattcgtggtatgtgtcgttactgctgtgattatgatggtgatgtttaatactataatatctaatctaatgttctttgtgtatgatccatggtggtttcgtgtaatctactgttttttcatgtattcatgtccctgtgatgtttaataaattaggcgggtcgttaaagtatgcagtagtactcctggttcctgtgattgccacaacgaagggcctgtaattaatttcttttctaattcaggattctggattgtcgcgggcatggtttccaagttccaagctcctaaacaatgtgttttgtgtaaaattaattggtaaagaaacattagaaacatcacatcaaaggggctgcagga

SEQ ID NO: 101674 - DNA, 725 bp, Oryza sativa
aaaaaaaagagacgagaacaagcaaaagatttgcttgtcttttgtacaagtagagaatgatttataatctgcacttccatcactcagaagaacagcattccacctattacacagtacaaattttaaaagttgaatgttttttccgagacgcattatggtatttcgaaggtaccaaatgccctttatatttctcctaacacctcctctgctctggttctgctatttctttgtttgctcctaaagtcctaagtttgtaggaatgcctctaggccctagttcctggccttgggttgccatgccgctattcatcgagacaaaaaaaggtcatcttgaacaattcaacattacgagatgttctcaagcgttcagcaataagtcaaaacgtggacactaactactatcaaccacagcatatcacaacaaaatatacagctgaatacacagcttttttacatcaaaacaaaaacaattatagatgtaatacaacagtagggagataagcctattcttagaagtttaacaattagagtatagtgtgtggattgacatgtatgagttatcacgtgttgccccgaggccatttcacatcaaaataaacacatacagttcacatttcataaacctatcaggcaaacagataaccatattcatgtacgaaatatggctgcagtgctgcatcattgggtatagaattttagttgatctcaatgtcttgtaaaaatgga

SEQ ID NO: 101675 - DNA, 753 bp, Oryza sativa
gcccctttttttagtagtgcttgttgccaggctttacataggctatcttttccttgttatttctgctcattagtttctccttccattttctctgacagagcggataccccataaaattaaagaaatctgatgatccaaggaagaagaaactacaaagtgagctagcgttcatacttcataaaaggactgagactgagttctttccccaacttttcaatctagatcacttccctcgttttccgtgcgtacgcttttcaaactactaaacgatacgttttttttcaaaaaaaaattctatacgaatgttgttttataaaaaaccatattaatctatttttcaaaaaagtacttaattaatcacaagaaaatacgtcactctattttgcgtgcgcgagaggtgagttcccaacctcacctcccgagcacagcctaataggttttatgaaactcacactttcttttaaagactgtgcacatgcacctgattctctgcactgagatttaagtcttccatgtattctgaatactatctaaacttaccacgtatcacataaaaaatagggtgtacagtactaagcaaataaacaacttaaacaagcctactgattactgaacaccggtagaagaggaacaaggttttgcgcaggacactgcatgtgtatagtggtgcgcacagagtaaatcttatactcccaaaatggttcctagtgctttgcatgttgtattgtaatatgttttcttctagttttctgt

SEQ ID NO: 101676 - DNA, 752 bp, Oryza sativa
agataaaagatgagagagaagagaagcgggctacaaatctgtagccagctgcagcacggactataagacgcaatatgtgtatgacgggtgggaccatatattaattgtatagtaagcaactactgtattaattggctattagattggctatagatgaattggagctattagtgggctatactattaaacttgctcttaggtgtaacatggaggatccctataggttgtgtgcactgtatgcatgactctcttggttgctacactacaatgtttgacggccacatctgtcctttttggaagctgtgtcactttctcttttcttggaccatcaaatttttttaaatttacggggtatataatagggttcgtaggcattaggaatgcagggtcgagcttgcaagtgaacacgatatcaatcattccacatatatatagtaaaagtagtaaggcccaccatgattatctgctaggttgtgcatcgagagaatggaaggtgaaattggtgaggaaaaataatcgaggagggagacgagtaaaaataaaaagtgagagagagcatatattcctaaagcctgggaacaagagcattatccacaaaagagatatgtattgagtattgtctactgatgagatggctatggggttaaacataccagggttcaatttgtgaaactcaatagatggatgacatagttagagccgtacataattccaatcgattttgctatatatttatcgaaaaatttttctct

SEQ ID NO: 101677 - DNA, 653 bp, Oryza sativa
cgtggtttccggcggcccgctcgggcagcggcgaggtggaaggagggcggtgggggtggtgcggtggtggcggctgggtcgcctcccgtgtcgcccctaccctgggagtgacgcgggggcaaagggtttggcctagcccccgagagaggttttcgcagtgaggcttccttgacgacatctccagtgagaaaaacgatgatgaacaccgacatcgccatccgtcgagatctcaaggagaaccaagacaataggttttctcctggtagcccacctgaggaagaggggtggctcgacaatgccccaaagatggaaaacaatgcctaaaacaccattgttgtcgacctggcaagaccaagctgggctttactatgtcgctcggtccatgaagacctgaagaaaaagctccaaagctccaccacctaccatcctctatcggtacatggtcaccactgtactgacgccctccaccagatagcctcaccgacctctctttcgtcggccctccgcgccatcgaccggggcggcctccctgccatcgcccgaaccaacctcctggagcaaccagcatcagccttcctgaaccactgacgccacctgcgtcgtgctagcctcccttcgttccccgccggatgcccctcgtcagtcagcctcag

SEQ ID NO: 101678 - DNA, 731 bp, Oryza sativa
aaaaaaaagaatttctaggaacaaatctcgacaagtatatttctaggttaatcctaagaagttgattttttttatagagagtgtatcttgtaaccccccaccctcaatgcacacactggtaactagttctttgcgtagtgtacagttgatttttttttttggaaattaatcttctgtaatattgatccttcataaatctattgtttgctctttttttttttgctgatgaatgagctgaagatggaacagttcaggcacgaaacaaaatgtacacaatcacacaaatatgcgtaatgctcaggaaaagcaacataaagttatccgtccttaaacaatgtaacaataacccttgatcaaattctaaaaaaaaaaccttgatatagctaccaactccacaccccctttcgtatcgttgatggacaatgcgtcacaacaatcgaaggcccgagacatctgcttagctccagtataggccctaaatcttgatgaggtttggacgtgccagttagtttgatcctgctactaacaagaataatagaaagaactgaaccaataaactagttagctaatactgatatagtgtggtaagtgtaagtccgaaggtaaaagcatacatttgctagagatctgatgcaagtagattcacatatatattgcctagttagctgatacatcccgatgaacgatgaaacattgcacaaaaacctatcggcttactaatataaaactta

SEQ ID NO: 101679 - DNA, 714 bp, Oryza sativa
taaaactttggtactgcacaatgcttgatactgtggtttgcttcaaacaaaacaataggcctagcaaccctacaagaaattcagtttaaattcggcgacaaaaccaaacacaactttatcaaaattttggaaatgcccatgatttgctgactatttccatatcaaaactttactatgcaacaaccatgcatgtatatatttcgcttcttttcttcaactactgccgactatatatagatattagcattcttggatacatgctagagcaaaccaaagttaggagtactccttcgagtgagaaccaaagtaagatctgcaagcctctgctcccattgctcgcccattaggcttttgctacttttattgaattcaagatttgcccataataatcatgtgtatacattttttgggatcatgataaaaataggtttaggaggtattcggaagcttgaaacacttgtggttgatagcacagtagatggacatgcctttaccaggaggatccttctctggtttgctatctccatgcaagtcagacctcctcgcaaactttgaccccatctacgatctgctgtgagaacaaccatgatctactctgcgacaaactccaggcagaacgtgctgcaaccatttttccaagaagctaaagaggtagacaaaactctgaaattggggacaaaacctgaaaccaatgacctccctgtagaggcattt

SEQ ID NO: 101680 - DNA, 670 bp, Oryza sativa
atttggaaaaagtggcaaacacagattttaaaatataggaaaagttacaaagcggagaaaataatactgaatcacattttcaaattttgttgagaaaaaaaatcctaacccgatacagtttagcacaggcgcgtcaagggggttatatgtttttacgatcgcagtcctctatatacattgaaaaaatataaatataaaataatgataacaaaaagtgcatggatgaaaggatttcataaaaataaaaataaatcacatttcgggtaaagacgccatgtcagcaatatttgttatgctcctacctcaaaaccggaagtactattgtcttgttatcgtatcaaatccgacttcagacaaaattgcttttgaatcgaaacaaatatttgttggtatattgtggcaaagacattcctgtgtgatgtgcatcctaaattactgagcaacatgatctgacttcatcaagagctcttccgtcaagatagtacttcacttggcaagaaatctggattgggaatcgccaaaaaggaggaggagggctggagaggaaaaaaaaaaaaagaggcattcaacttgaagtacaacgtggttgtgcgcttgttgacttaatgaagacaatacgcagacgaagggaaaacactttaaaatggttaatttgagaggagagaggagc

SEQ ID NO: 101681 - DNA, 519 bp, Oryza sativa
aaaaacaatttcaaaatgagataaactctgtttatacaattgtatcttattggccgatcaccttccagaacatcgattgatattgatcagaaagttgctaaacagtaaacagcaacagttttcacagtgatttcagctaataaagtatcactcactgtcatgaccatacgttaatctcgacgggtttatttgacattatacaggtaccttatataatgacatcgttatgtgatagtttatacatattttccagcttcacacaacttttacatatttacaatgctcctacttatgtatagccgaatttgcatttatagtcgctgatccgaactaatgtctttcgatctacacgttcgcaaacatttacaaactttattttcaggaatttaagtatttttcattattaaacatcatttgtcatgatcaaaaagcaagtatcgaatatttagaaactaaaatccaaatatttcatcacactatcttaaactaaaggacatatgagcattatccatccatgcc

SEQ ID NO: 101682 - DNA, 1233 bp, Oryza sativa
  unsure (1)..(1233): unsure at all n locations
gtccaaagtaacagaaagcttatgtttttttttttcgtgaaatgaaaaaattattcattactgaaattgtttcaataaaatttagaaaattttggtaaactgacaggccaggaagcaaaatacaataatgttcaaacatacatgtctttctcgtgggatgggctgtcggtggccttgtgggctgtatagccggtatgagttataaccatgctaaacataaacattaattgtgtatgcgaaaaagaaaacaaagactctatcattcatctactaatgatttttgtaaaagtatattcatattttcttcttgtttacataacatttttttgttcaaaggtgccagaatanaaaaaaagccaaatgtaaaatctttgcttaatatgattaccctcaagcttttaaaataatacacgttattacaagtcaaactttgcgtatcattactactaagatcacaaaattacgttatattcatgactttaatatggatgaaattttacagggttcgtgcatcacatccgcttctttttattagcatgagcatgtatacatccatgcatggtatatttggttttaaaataaattgagaggaatataatatacagtatagatataaacactttgctgtgccttttctggtctgcctaagcgtatttcgggtaaattaaggtaatgcgactttaccaaatatctgatgtcgaatatattacttgaataatcaagtatccctgaacaaataaatacaaaaataaaaaatttagggggatactggggtgataaagttcggattttaaatttctatttattttttgataatacgcaaaatacacaatatcttcttcgatcatttatcaagtagttattttgaaatcatgtttgcgaacgatcttcagagaaatacgtctgttcacgtgagataatttgatccaaggggtaaaatcttcacaaaccaatatgaaattcatatttcaaaagtcaggctttatcttattataccaatattcgccattccaaaacggaaggaaataaaagtttgagggaaagaaactattacgcatgttaaataacttcgaggattttttttctggaaatggattacgaattgaatgtatatgatacaagcattttcttttcatcataagttgttattaaagatacctttattatgtctttctttgtttttactttatttgatttcgggggtcaacattaattgtttttcagtaccattcc

SEQ ID NO: 101683 - DNA, 672 bp, Oryza sativa
aagaggaagaagaaatcacaaaacaaaagttaaaatccagtttcgtagcaacctccacattttgtttctggcataagcacctctacgtttaagttggaatgctgcttcttgacggaggcgccactctcttgtcagtacaaaagtcgtatactagtctacaagcacagactctaagttgacgctttaccacaattcctaaagccttgaatagagcctagatctgtcagtttctggatgtgtcaggagcggctaaagtacagaccctattttagtcttatagtgcagacactgagcagtgtttgtgggtgcaaaaatagtcgtatgcagtgtgaagaaataaagaggggaagagccctgaagtagctgtaatgcgatcccctcactattactgaccagtgagcaaaaggccatggaagtagaaaaaatgatgaggtagaatgcactgcaatgatcatgtataacaaaaatatgggggggggggggggagtgattcattcaaaccataggaatatgaaaggaggatataggtggacaaagaaagaaatcagaatcgaatagggctccttgatatgccggtctgttacacaatggattgctaccaaatttaaattacatgcaaggaattttaagaaaatgttttaatttcaattttgctcgataacgaacgcattt

SEQ ID NO: 101684 - DNA, 516 bp, Oryza sativa
cggccataggcactatttgaaatttatcaaaatttaccgggagcaccggtaaatttttatattcaatttttcacgaaaacagaagtgttttaggggctattttttttagtgcttataatacatccacaggggcatccaaatatatcaaaattgtaaagattcactatccacccaattttcaaaatctcacaaaactttgtattacctttaaagaaaaaagtatagattagattaaaacatccagataaagcctgaaatatttcattcggatgtatttcattcttattttttacatttgtaaggcataatcagagcccagtagcaaagaatgacaacttcattaaattcccattaagaagggcacgcgcctgctaacgtatattatttattttcagataaggtaacggcaaacactaaaccgtgaatggcatggtgataagctttatctcttagatattgaagtcctacaataatactcgtatacatcagcaaatacattgataaatcatttgtttg

SEQ ID NO: 101685 - DNA, 553 bp, Oryza sativa
tacactaaatacactacccagtagatcagcggcaatttgagaacaaatacctgatgatttgtaaaaaattacgatgatgcccggtgattcctcatattttattgcgattgatataagaggctcgaatattgctttcggcgaatgacaataccttaacgatttatgcgcttattttacagacaacgactgcgtgagtcactgaatagatttggtagtgtataaaaaggtttgttgttatcgaaacagtattttgctgtaattatgcaacaaatgataaactgagattttcatacattaatgaaattaatgatgatgtaatgatgggattactatatatattgacgatctaccaatgtaattgcttttttttgtattgttatgatagaagagcgtggttgaagtttattaaatatatttatatcgtagtaaaatacaatcgtcgacatttgtatcagtagctttttaagtaaatgccttattcactagacggcgttgattaattaattagatgaaaggaataagaaattaaaatttaaaattaaagatgaggaaa

SEQ ID NO: 101686 - DNA, 604 bp, Oryza sativa
cttctcgtgtattgttttgcatttgctcgactatttgcgattgaggatttcagtttgactccgataatcgccacattttatggtgagacagggccttgtccgtatttaaagagaaatatattacatgttacaattttaatgaagttgtataaggccagaataaacgtcccagtcggtaccctgtgcctttataatactactttctatcaatatatttgaaatgagcttactgaatccaatgaaccggggtaataatatatctgtaaaagcgctaggcacatcgttggatcggtgtattgagcgctatataaaaaaaacagattattattattattattaatcattgaatttgattggatatgagcatcttcttaaataatcctgtggcacctgttttatctcgtaattaagctcatcaaaaatttgtagtggaaaagtggacaaaacttttttaacacgtgaaacattgctgttaataaaaagaaaataaatattcctatgactttgagaaggaatcgccaaacacgcggagagctctttcctgcccgtcaaaatgtaattaattatctttaccttttttttgtttaacagagagaaaaattat

SEQ ID NO: 101687 - DNA, 537 bp, Oryza sativa
cacgccaatggacgctgaagcaaatggcaagatatcgcaggtgtatgtagtaaacgagtacctggtttgaagtcattgcttgaagtaatttcttgagcatttctgggatgaatatgtcagaggtttaacagtagattgtatcatcatcctatggccgtggttgtctacagttaatccatcaatgcaaaaacgaaaaaacaacactaatagcttaaataaaagtaaatcaaccaattatggggattgttatttaatttcctttctgaggacttttctcaaaagttcatttattatgggttctatttcatatagctgtacttctcacaagctctttcgttattttgttgaacgtatacaatgacaaaattcggcttttttcttcacgtatgatttcatacgttaccggggtgaagtaatttattgatgtgtagctttgttttatatgcgcaaacttaactacagaaaaaaacataaatttgtcaatgtacaatctgatatgactcgagtataatgcagaaatcttgcagttatatctct

SEQ ID NO: 101688 - DNA, 1135 bp, Oryza sativa
ttttttttactttcacgtgggggaaatcggccttgcggggtccaccttgagctgtgtctgagccgagactttcggcgcctaagccgacaaggatatgcactttagcacgtttccttgcgaatcttatatattcattatcaagacgaaaggttgatgatgaaacgtgaaataatcgactataaagagaacgtgatgcctccgataattgcgtgttcacagtgcggtgcgctttcaaaggatcccccatttgttattaaatatcttcctatttagaggataatatccttctccgccttcggtcggacactcaacggtcatgttcgtgtctaccttaattttgaaaatctcattattgactctattctgtattctcttgtggcgtatatggcattacgattcacagtgttatttcactttatagatattatacaactttgtgaatattttgtttattatatcgaatctttcaagaagatagtaataacctttgatcagaatgttaagatgtcacgttaccactgaacgcacaaagcgttgtgtaaaccacattttcacattcattatcattatggcacatcctccccccccccctttataaatcctgaatctgcccctggatcaggtggtaagtaaaaagtaatttatttatcccgggcaggatgtaaagtccaaactgtaaacatgtgtgtatgtgtgtgtgcgcgtgggtgggggtatgtgtgggtttgtaagacgtgtgaaacggggataatcattatgtatacatacatgtaccttcctagtggggatacactggcactatggatttccttagttgataactttcttatttttgaaagagttccaagatatccacatttgcatagtaggacgccacattttcgagcactactttgtgtatcatctgagattttaaaattttgatataaaatgaacagcgcctcgtaaactcccacataaaaataggtggctattaaaattcttgttattctttgaaaaaatgtaattttattcatttatctggcgttacatgcatcaaagaaaaggaatctttgaaaaaacacctcaaatactaatatatcctatttcatagttaaatatagttcaagataaatatccccatttggcacttttt

SEQ ID NO: 101689 - DNA, 1150 bp, Oryza sativa
gaggataagaagaaaggacctaggttaatgagggttaagaaagaaaggggaagaaagaaggagacaataagattatatttgaaaacagacggtattggaacctaataaatgataagaagcagacagataaacaagtgaagagaagacaactgataagaaaatgagacaagagagaagaattgggaaaacatcagcactacaaaatttcaatttcaagtgaagagggcgcaccataaagtcaattccaccgctcgcccgtttgtcacgccatttacatgtacatgtaaatgacgacgtttttaacatgtattccagtatgccatagacagtgatagatatatacgttgttttctctttgtttagtctataattcaaaattttggcgtattaggtgagaggaattaacaatataaatggaggcatgtgtgatttaccattgtttcattacgatcctaaggtctaatctaaatttttaataagtgttttgggcggcacatattcgtaaaatgtttattaaactttactctatttaggatgtatgtaaaatagttattatttgactgaagttcgtgtttctatagccacggataagtgcagtgccaactaaatgcagagagttggaactccctgctagagggaagaaaaatatgggacgatcgtcactccgtttcagaaatcatgataattgtcttgaaaatcaaccccttcacctccttttttctctttaaaaatcgatgacaataagcacaatggtggatattaaaaatcattctctagtgagaaattataggtactttttgaaaaaatggaattgaacctacggcgccggcacggagttaaaatgctgtccgggatcagacctctaagcccaattcaaagttttcttttacaatcaccaatttcaggagacgacaatcgtaaattttatgcgggaagctgtagaaatgtttcatgtcccaattaactcgaatcatatcgcgagaccgactctgttctcttttgttaatacgagaagggtgtgtaggcacggttaatcggactccaatgggtgcccattttttttttgagtggaaaatcgcacctatttagaggataaataatccatgtttgttgaataggtgcaaagcagttcatggtcggacaagagccc

SEQ ID NO: 101690 - DNA, 2132 bp, Oryza sativa
  unsure (1)..(2132): unsure at all n locations
tattaaactgttatatttttttctacgacgtacgaaatgatcgcgagggatgacggttgcatgcaaaataagcaagtcatattttcgacgtgagatggcaagatttctgtagttgatggagaatattggaaggttaagtaatagaggatgatatccaatatgcaaatggttgaagatgaaatttcaatattctgttcaaacattttcattataaaaataataagattctataaattaggaatttaggaatttgaagatctgcttttactgagacgggcatggttttagaatcaaattctaatgctgtattcttaaactgcatttcaaatgagatgttaaactaataacacataacaaattataatgtattatacaactatagatttgtatagacaaacggtttggttctcaagttcctttaatcaaagtgatgcaaaaataagcccatcactgcagtaacagtgatgttatgagcatgccttcattcaccaaaccaaacgagaatagcatgtaaacatttaaaggtattacatgtatttgacatactcanagaaatcaacgtgtttgaattttgcttatagggatgggggggggggacatttcggaaagttactttggcaatgattttccttttaaacgaaacatcgctcattttgttggtctttattttatttatatcattattttaagtattggcgtttcaaattaaaaattccgaaaatgataagaagtgaccgtcatccattgcttgctgcatttgtggaaaatgctctgactcgaaaaacaaaatataagacacagagggcttcgtcagtttatggaaccctttaaaattgaaattttcaattaggtctttcaaaaaaaaatatggtggggaagtggggtagggtcaaggtgataaactgtaaaagccttacgtaggatgatgccttgtttgttagttcacactgttacagctgaactcattgcgaccacgtccatgaccgacatttacaacccaagatggtgtgaccaaaagtgaatgcatttcaagaatacactgagggtgggtccgtgtgtcttaactgtcagagaaaatatctcattagagggatttgggattattatcaacgcaaacggagatcatttatgtataaattgtgctatgttattttcactatgtttttttgtactggacatgctggaaggtattattgaagaattttgacaagaaaaaatatggcgatttagtgttcgtcttggtatccttattttcataatacgttcatagtccctttaagttttttcagatgcaattatataaataaatttcctattttgagtacttgaaaccgattccatatcacctttaaatgtactgttcaactcttgaaagaaaacatcttgaaaaaagcaccccaatggatgattgcgatgacagtgatatggaatatcaaacaaatttactttctgatttacggtgatgtctgtgctttaggaaattcgatcacccggttaaaattgaatgaaacactatgctttatggggaaaaacattaacttctcttaataaacgttggctagtactgttgaagactcggagatggttgtattaaatgacaggacaaaattgtttaacggtttttgctgccatgacaactattttagatttgggagtttcaatgatcacaatataattgataaactaattaatctatcatcgaattcaaacacttattttatctcagatcattttttaatgtttctcccctttgaggatagggtactttaagttcatccggaattacataaaaagcagatggcgccaaatgggaagttgttaaaagtagattaatcgtaataacgtcagttgtcacgcgtgggactacgatggccggtacgtgcatcccatgcacaagaaatgaagttagtgcctgaccgttggttttggtcacacataacaaattaaaattcaggcctgggccattcacgtctcttacagctgcgatgagcaaacagcagaacggcgaaaatgaaaaaataacgagggtcagtgaccaagcccaagacgatttccacgatgctgaaagaaaataacagtccttgtcagtgtatacaatcagagtctcggttcacaataaatgcaaacaaaaa

SEQ ID NO: 101691 - DNA, 519 bp, Oryza sativa
  unsure (1)..(519): unsure at all n locations
tcctgcctgactctttgcctgcatgcatgccgtcaaccttgggggctccagttccttatatcctcgtcgtttccatgtttgcatttttcattgcccaaatggcgtatcccccccccccccatctctctctctctctctctctccctcactcagtctgaatgcagactaatgcaaaacagttactagtagtaataattaaagcatgcaacatccataggtatacaattaccgctgtaagttccccgtgataggatagtaaatccaaagtatgagaagggtctgtttattgcatacctcatccactgaatatcgatgcatacatgcatatgtgtatgtaccggtttacaaatgtaatggcaatcaattgcaaatccccaaaatcaagcgtaagtcttgcgattaattgcaaatttgcaattgatcgcaacttaactttctggcaacgccccattantaagagagagagagagagagagagagagagagagagagagagagtgggggacaataaaagctaga

SEQ ID NO: 101692 - DNA, 598 bp, Oryza sativa
aaaaaccaaagaaaacaaggatttatcttaaaacagggacttatcaatataattatcatttaaacataaatttagaattaatcgattaaaaatggaccatacaaaatacgtgaagtatcttttccaaaaaaatgaattcgatgattttgcacaagcttgatttattttttaaccatttcaaatgagatttgtttggttggtccaaatggggcgtttatgagagtagaacacttgctctttgaaactggaacgccgtgacttttgttgtgtgttgttttttgaatatatctaaccgccataataaatgtatattagagcaaattgaggaactgcataaatttagttagtattacctgggtagcatgaattaggactatttagtcattcttattgtaatttcttaaagatactatgtcccttttgcagccaacctcaaatgctgtagaactttgcaggaattatgaatatgtcatgtatgtcctatctgtgaaatttaaacgttagcagtgtcctcatattcaaattatgcaaggaaacccgtttacttgctagacttcattgccagacactattgagtgactgactggctttttttctt

SEQ ID NO: 101693 - DNA, 608 bp, Oryza sativa
aggaaaatcgtaacgcaaagtgaatgcaatttcttttcactaccgtcacttcgtgaaaacagcgacgaattatgtacatcaatttcaaatcacttcactttcgacaatcacatctgtaatctcttgcctagatttttcttggacgttataacatgcatttgttaagacaattaggagttgattgaaatatcaaaataaagttattcagtataatacattcaccgtaaaaagtaaatacggtaggtcatatacaaccaatttttgtcgatccgatccggtcttttttataacttcattttaaacagtgtatgacatatttcagactattatcgatttatcagatccaatagcaacgatcgaattttgtgttacctgattatttactaagccatctatagtgtagacagaattttcaacattttgaaaccgattttattgaatcgttaattttccactggtcgcagatcattatttacataggcgaaatgaacttgagcaaaagtgaaacattctaaaaatagtacatacaattgaatcgggtaaatttattaatcatgataacatctgaaattctgttgtgaaacaataaggaattgtgaactccataa

SEQ ID NO: 101694 - DNA, 690 bp, Oryza sativa
ctagggttacataaatttatggcagcatattcaggattttattccaatagcgagtttgaagtttgtgcatcatgtttcgtgtctatgctaagttcacaccaatggtaagtttgaagtatggttcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaaatacttatccaatttgtgattcaattgcaccattgaatttgttgcaattaaatctttacaaagagatctcacatgattatattttggagaaataaaacatatgtaattatattactaattgaaacatttttattataagtgggacattgatttgtgacctctaaaacaatacaaaatatacattgaaatattgaaagaacaatacgtgcaagatcctaaatgatctagtgaaacatctgctgaaatgtccaaaaaataccacgtgtaaaatttcaaatgagctagtaaaatacccagt

SEQ ID NO: 101695 - DNA, 521 bp, Oryza sativa
aaaatttcttcatggtacatatggactataatgtctagtcccggcgtcccagaaaggaggacgttctgctcctaaccatttgtcccataattcttgacgctggcagcctggcagcctggcaggcactagcaaactcctagacaagcacacataaaaaaaagggtaaataaaaaaaagaagtggggccatctaaaacagtactagcgaactctttcttctccaaacgatttttgctctgaagcgctaccttatcctctcctctcgtattctcttcttccccatcgctcgtctctcgttttcttctccttccacgccgcgtcttccacaccagcaccccgcttctccctcccatcagcacaccgtaccaatccccatccatgccccctcccccacccccagacgagcaagccatattcggtgtgcgacaacatgctcaacggccgcggacacactgagagcgccatctcagcaatggcggaaaccctaggggttgcagcggcggcgaacctaggggctatggc

SEQ ID NO: 101696 - DNA, 588 bp, Oryza sativa
ttaggggtcctgtccttcattgcacttgctaagtgggggggggggggggtaaacgtcaaagaatatggcacagcatggtagagaggtatggaataagaaaaaatgaattgtaatgacaataaataagtgaattttattatggcccgcactttttaattcgaatttccaaaaccggaaaacaagcgagctgcgggtaaatataaacgttacctccaagaaataaagaaaaattgggcaattgggtcagagcatacaatgaaaacatgactcttctttcatttatctgggttatgcattgaaatccgttgtgcgactcttacaaagattgtcatcatctgatggaattcctaatatttactcacattgccattgttgtgaaggatcaaagacgagagaacgaacgccaaaactctttaccaaattagaaacggcaccgctgaaaaacagtgcaggcgcacttgactgcatcgtcaggcgtgacatattcaaaacacgtctcgtcttctttgacacattacaatatggggttcattgtattgggttggtcgttacacggtttgctctaaaaatacatgcatctataatttg

SEQ ID NO: 101697 - DNA, 660 bp, Oryza sativa
caataactttaaaaatatttaggtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaagg

SEQ ID NO: 101698 - DNA, 549 bp, Oryza sativa
tcctgcagcccgctactactactatattatccatttgcactgcatttcaaagttgggcatcgctttaccacaagcgctcagattgtatacatactaatatatgctactcttagaaaattaagggcttatttagttggtgaaatgaaaatttttgggtgtcacgtcggatgtttgaccagatgtcgaaaggggtcttcggacacgaatgaaaaaactaatttcataacttgtctggaaaccacgagacgaatcttttgagcctaattaaaccatcattagcacatgtaggttactgtagcacttatggctaatcatggactaattaggctcataatattcgtctcgcgatttacatgtaaactgtgcaattagttttttctttttatctatatttaatgctccatacatgtgtctaaagattcgatgtgatgtttttacgaaaagtttttggagaactaaacagggcttaagtaaaactagtcatgtagtctctccttttgcaggacttttgatctagtttaagaacttttgtatatgatttgttagtta

SEQ ID NO: 101699 - DNA, 667 bp, Oryza sativa
cagcagcagcagtagccttaaattaaaaatttcctttgcatttctttttctataattgttatgaatgcactgggaacagagtgggtcatttggtagaaacgaatgactgatttccataccccgtagggttgataagtaagttgtcggataagaaaaagcaatgaaaactgcgatacccattctttatgcaaaaaatcagttcaaatatgagagcgttggtgcaccagaagtctttccaaaaacgaatagattctaacattaggaatgtatgtatatctaaaagacgcaaataatggggtccgggggagaggcgagagtgtctaaatgagagtaccttagacttgtcagatcgcttttgttcaaatatgcattgttatacaaggcaaggagatgctgcactttttgcccggttcagtgcttactggagacaaatttagacaatttcaaggttcacaacatctccagtcggctgtgcatggagttgcgcttcaaatgtaacaggttatggtttcttctttctctctatcttttttcttttttggatatattttcagtccggttttgctatgccgaaattttttctttgactggttattcttataatgatatataatataaaacgacatttcatcacagatcaccgcttataaaaagaggacataacatt

SEQ ID NO: 101700 - DNA, 651 bp, Oryza sativa
ttaatatatagaaggaagttcgatttagtttttttggaaaacgtgcctgacaaatcaatcataaattagaagtaaggtgttttgtccttttttaatagaatgtttatttgcctttttttaaacaaattctaaagaactatattgttaataaatatgttttatttgtaccatcaagtagttctccttatagtaggtttaagttgatgcaagttgttacatacttatatataaattaattaagacatgtcatatacctcgcttccttgtgatctatactatcttttttaaaagaatatacctagttaacatgaatccaaaattttaaatttaatagtaacaaatataacttttcaaagaactatatactgtgaaccttagtgtggtttatatgtgtaataatatgtggagaaactcataatgctatgatataggatagatgtaaggccattaatgtctaagcattttaaaattgttacgaaaatggaacatgcaatggttggtccaattttagtgaaatgtaagaaccaatatttttatgaacttatcatgttttctctaaatagtttaatttagtccctattgacattttctattacctgctttattttatattttatacagttcaaaatatagtctttatggatctttaaa

SEQ ID NO: 101701 - DNA, 562 bp, Oryza sativa
atgtcaattaagcacataaaatatgaggctaaatcaggtaagataggctgaaaccccgatgctaccctaattggcaaccaaaagtaggctagagattgagattctaatcacgacttataagatcaaactcaactgatgcagctataagtatgaaaagaaggacaatatctagataatcaagccgttgattgtctcatagggtggtggatatcctatataatctaagtcaacgttgatatttaacttgatcggtcgccttctaacaacagatgttagccgattgaaggttaaataacaatattgcacaggattatatagaatacatgataactcgacgaattacataaacaggattagagtatcataaagatggaagcactaatcccgagaacgcaagccgccataacaagttttacctcttagttgaaaagatccaaaaccgatgcagctcgacccagaagtaagaactcgtcgaaacaaacgaaagtaaaacgggggcgatgcgccgagattgtattgaacgtgtgttagattgattacatggggctcggggtctatttat

SEQ ID NO: 101702 - DNA, 1314 bp, Oryza sativa
  unsure (1)..(1314): unsure at all n locations
caggagcgtgttgccccttacggtggcgacggcttccaggtccacgaggagtgccttcacaagccaactctcggcatcaccggtggccgtgaggttgggaagaaggtggtgattagtttggtggcaaggtctccgcctctggcgatgccatcgtgtgcgtcggtggtgggtttggcgatgacactggccatctagtttgtcttgtcacatagacaaaagcggcatacaattaagaatcctttttctcccattactagtaagtagaaacctaaaaatagtactccctccgtttcacaatgtaaatcattctagcatttctcacattcatattgatgttaatgaatctagacatatatatctatctagattcattaacatcaatataaatgtaggaaatgctagaatgacttacattgtgaaacgggggaagtatttggataattgccaaacgtaaaagtggtaaatagttaaatttcctacacacgccgctcaggaaagaggatggagaagagatgagatggatgcttgagctcggtgtcaccgtcgccgcagctcggaaggagacgatgtcacaaactcacaaattcctcggtgttattttttagcattttcatttggacttgcggggagctcttagggcaatagcaatgcaaggcatgcatagagtatctttagcccggctgaagctgtcaaatcggcccaaggccatcaactcaaacagtacttgttacctttttagtgtgtctctagtgtccattcctgctgtactgaagtgagacgcagcgtctccatgtgaaagatcgaggaactcagtaggggcgcgcaagcagtcgacacgtcggcgcgagtccgaggtaaggcaactcgccacgtaatgcattggggnaaagggcccctttngtgggcttgggattacagtcacgtgcggcccataggccttaactgactgacagcgattctcttgcggcccatgtaatatggcccgaacaggatcgcgactgattgcaggccagacagtccagcccagcccaggacactttacggctgttttccgtgacgacagctgcattttgtctccatccatggctactccatcctgcctagcttgaatgctggaccgatcaggtgaggggaggaaccagttgaaggccagtggcttggcgttggcgttggcattggcattggcattggcaactactgactgcatcaacactctaccaagaaacagctttgccatgggcatgtttggtgcacctatttgggttgacgcccatagggtgttcgacgaaatgcctctgcgacaggagcctttgc

SEQ ID NO: 101703 - DNA, 4901 bp, Oryza sativa
agagcttcatgcctgataacgtattacgcaaccttcctgctacacgaagtagtccaagaggatcccgtaattccacagaaagtggagacacaaactttaaggtgagactctcttttctattcaatcctccaatcaactatactaatgagtagccccccctcctctgtttatatagtgcattccaatatatggaaggttcggtgatgagcccaataagtgtatttgggccaggcccaatgcaagtccctgcatgcaagaacaagtgaaatatatggccattagtcaattatttgatagcaaggaaatgaggggagtacaatgcgtttatggagtacagagaaaggactagggattatagcatgtgctcaccttgctttgtcgtcgtcagagcttacggggggaggaggccgaagccatgtcggcagaggaatctgtggcggcagatggcatgctgactagcgacgggccgcgcaacgacgggcggaggaggcgggcggcccgacaacggtcaaaggcgccgtgcgagtgttgacggctaggggcgggaccgcgctcacgcgaggagaggcagcggcgctgtgcgtaggtggagattggagtctaaaaaaatttggagatggggagggttgactggttgactaggattagaaaatacgtggtcattgggcttcatttgggccaaaacgactataaagtctagaattggtccctagctgcactgcatgcatgccaccgcagggacggggatggggagtggtgcatcatctccgcccctaccatccctaatggtgatgagttttggaccattagatttcccatggatggtagatatcaaccatcctcatcccctaatatgtgaattcaccgcggggaattggtgatcgggtccccattgccatctctaattaggaaggactaacaatgtttattgagaatatgtatagtgttttagtctttcaaatggcatgaaaagaattgttttggtgattcaattcaattggaatgaaatgtacggcaaaagtgttttcgaaggtaatcctttttcattttttatccacagcaaaagccatactataaagagatatgccgctttgaaatctatggttgaaaaactgaaatctattcgcaaagtgtttcatttggaaaaactttcaagttgctggaattttcaatggatcggaatttcttatatggctttggaagaggggttgttcagattgatgccatttttaactatatcattttttggcaaagttgccaaaaaagtatctacatttagtttattgccaaactttggtacatacataaggaatcctgccaaattttggtaatattgccaacttgccaaaattttggcatcgctagaatttggtaaggttaattttggttacaatctgaataggccatctaatatggcgcaaaatgcttatgtatggagaaatataggaagggccagtttggattgctaccctaccaaaattttggtagacctctattaaaacactacttatgccactaatttagctctgcccatgaacttgtctcttattggcatattttggcttcaatccaaatgaacattttcaactctaccctaccaaaattttggtagtgccaaaatttgtccaagatttggcactactaaaattttggtagggcatcaatccaaacatgcccgaagttccgatatgcttattggaatatgcgatgtgttggtttttggctaggttggaggatgtaattcaaactggttggaatttctcatgatcgcatcggaatatccaatatgaataatctttgcctctaacggtagatttaggagtgggctataaatacccccctcctcttcttgagattcactttgagccttactttccaaaccttatcctctctcattctacacaatttgattttgtgcgaatgagttggttttggaagatcttgtacttggtgagttcttgattggtcttttgagcactagcttttcaacttcaaggagttattgttacatctattactattggagattgagaactcctagatgtttaggtgtcaccattgagccaccgatccgagtgtggtaggttgagagaagtttgtgaaagccaagatcttagcttgcttggcttagcttgctgccttgtgcagattataatttttgattttcatatcaaaatttctagttgtattagaatatctaacacttcggaatatccgacttttccttttagcttccgcttcgtactaagttttatattgcatattcaccctccctctacgcctaaagatgtccttctagttaacaaaatacttttggcatttcaagaaggagagatgtttatatatatatatatatatatatatatatatatatatatatatatatatatagagcggatttaaggggggtgggacatagagaatttacaagagaaaaaaaaagaagagaggagcagctaattgagggagctaatccatgattgccagagggggatatcaacaacttttgctctatgcatatgtagaacaaactctcctttgaagccacttttccaaggtagagaaggagatatgcatatgtagaaccagtggcagagccagaaattttcttgagcctaggcaagtctaacaagagataaaaactatatataaaaaattggaccgcttatcatagacaaaagtaaagttgattgttgccaagttacaatttatggttgtttattgttaatgagttagagtacggggctactatacatcaggaaagcaagattagcgatatgatgattttgcccttgctttgcttgtttgttggctagtcatctaactaaccttcattggaaccaggaagcaacataattatgtaaacaattaatgagtaaatgttgtttatgctgtggagcaatgtgtgtaagtgtgttgcgatggcatggagcccgggcagctgcccatgctagccgggccctgcctgagccactgtgtagaacaaactctcctttgaagccacttttccaaggtagagaaggagacagggatgttgttaaagatgaagtcattcctccttgtccaaatattccaacaggcaattccaataacttcaacaaagaaggggtgcacaaagtttcttcgagctgtgattatcatgtgtaagaattccatattaaggttctattaaattcccaagagatgccaacattgctgagaaaaatggcatgtaaagaatagatgcgaggcatcttcaaccattgcatgagtgcacatgacacagtttggcccactttagagatttacttgttttctttggagcatttctcgggtgtttagcctgttcatcggaaggagccagagaaaaactttaattttcattgtacacttactcttccagatcatgacgatggcaggagagggttgatactgtgagaaaaagaaagggtgcaatttcttggattgataaacttaggagttccagatataatgagaaggagagaagttaaaagaaaaacacatctcgctaagcaaaacgaacaacttgatgttaaaaaaaggttttgaattgtctatttcatatcgcaaaagcaataatgcttatcatccctccttttagcaaggttattctttattagaactacttttctatgcagcaaccatataaaaactttgattttagtgtcacttatgactccttttcattctcttcgaaatgctcgtactggagtccattataatcgtgtacataaaatataccaaaaaagtacatttctatgtaatggcccacaaagtaattttttaaaaaacttaaaagagttacctggatcaaccggtggattaaatcatttcactcaatcaaattgagaacaataattgctcgccttacttattacttctaccaacgaggcaacggcgtattaatgactactccatcggttcctaaatatggattatataagcatttttagttttgtttagcaaatattaagaatatggggaacattccttttcagtcatcttacttgtaatattttgaattgtttgaatttttcctcctaagcacctggttgggtagagaaatgcttagatttctttgaatttgaatcatgtactagaaatatttatattgcgtaaaatttcggatattagagacggtttgttaccggcaacagtaatcttcaaaacagaaaaagaaaaaagaaaaaaagagaacactcgagaacattcgaagcatcgacaatcaaaggaagaaaggagagagagagagaggaggggactcatcatcactcatgagagcgaggggtcggtagatcgtgataaggatcagctgcgcacccgcacgtacgtcctgcgctgcatttcactgcagctggacccgcccgaattcacccaattctttaatccctcccacccagcggacgcgagacgcctctgctctgctctcttgcttggagtttggagagatcgagagaaaggagaaggatacagcttttggaggaaaaacaacggatcgaaatccctcccattaggggctttgggattaaaatagcggtaacacacacacaaaaggttcgttaattcgtttccctgtcgataagtttatcttcttcttctctcatcgtcatcctgtgcacatatacctgccccgtgcgtgcgtattttatctacagctttcttgattcgcttggcttcttttattattattattattattattattattattattattattattattattattattattattattattattattctctagctttgttggcttgtggcgagtcttcgagaaggggcaaatgctaaccgcaggtgggttcttcagttcttgtgagttggggcttgggtttgttcttggttggattgttggtcactcggtcagtccggtgctgctgctgcaagag

SEQ ID NO: 101704 - DNA, 704 bp, Oryza sativa
  unsure (1)..(704): unsure at all n locations
gactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaatacggactccttcccatatataaggggggtccgggtgcctctaggggcatgtgttgattttctccaaatcatacaatcaataagatactcggcggattcatccccggacaggagtagggtattacttcttgaatgagaaggcctgaacctgtataaatcctttgtctccaaaacccattcacttttcttcgaggcccttgatagccacccccttttattattgccgaaatctagtttcgacaattagttcaatttatgagttttaccagaagaaaaatattaatataaaaaatagttgcaatccgnaagagggaccccncgaaaaaaaagtcctcatacatatggctcataaaatcaacagaacgaattctcttccaaaccgtatctatcgcacaaacaaccaaacaatatctggtacaagccangctagactgatgcaaacaaccaaacgactgcgtgtgtatccacttaaca

SEQ ID NO: 101705 - DNA, 2193 bp, Oryza sativa
tcacgtaccatttttttataaggactatattaacccaaataattaatttagaggacatgtctggacgatttgaaacctgactaaactgagcctgaagcgaaacttcagtgaccatattagctattcaccctttttaattccaattttctattatttcctaattgtgtttctatatggactctatactctacttctaatattccttatttttaattccgaatttcagttatttcctaattgtatttatatatgtactatgtactctacttctattattccttatttttaattccgaatttaagttatttcctaattgtatttctatatggactctagtctcctcttctaatattccttattttttaattccgaatttcagctatttcctaattgtatttctatatggactctagtcacctcttctaatattccttattttttaattccgaatttcagctatttcctaattgtatttctatatggactctagtctcctcttctaatattccttatttttaattccgaatttcagctatttcctaattatatttctatatggactcttctttttctttttctccgattaatgtgagaattttctaggccatgagagcgaacgtggaggcttctttttctattccaaattttagtttgttttaaattcctatatggactatatactatgcttctaatatttcttattttttaattcggaagttctatttttttcttaattgtatttctatatggactctatactctacttctaatattccttatttttaattccgaatttctattatttcctaattgtattattttatctcatataatagcatatatgttttctcattatattattcaaatatattaaaatgacaacataattctaaattttgcaataactttacaaaaatactaatgtgtaatattcatattgtattttatatacgtgttagttattaattatttttaatatcaaattttagttaattttctgtaaattgtatttctatataaactctatgctcttgtttcaatattatatatttttatttctgaatttttattatttctaattgtatttctatgtggactctaaacttatctttcaatattctttaatttttaaatttgtatttttttattaattgtatttctatatggactctacttctaatattccttatttttaattctgaattttaaatatttctaaattgtatttttatatagagtctagtctcctcttctaatgctccttatattttaattccgaatttcagctatttctaaattgtatttctatatggactctgcttttttttttctctaattaatgtgataatttctagatcatgagagcgaacgtggaggctcctttttattccgaattttagttagttttaaattcctatatggactctacactctacttctaatattccctatttttaattccgaatttctattatttcctaattgtatttctatatggactctatactctatttctaatattccttatttttaatttcgaatttctattatttaaaaataaaaagattagtttaaaaagattattattattattattattatttataataaaaagattagtttaaaaggttgtttataaaattagtttattattaactaattaatagttttctattttatttatttagtttattttgtagtatatttataaaaacaaactagttcacctgaacatcgtttggaaattctgaaaactatttcagtttgacagccgccggctctcgtgagcgtcggacgtggtcacgcatccaaatgttcaatggaacgcgtttcctctcccacttgtgaagatataggttgggcagaaacctactccattcgagtgggtgaccaagtgaccaggtgaaaaggatcggaagcgacagaagagggatcggctgtcgcggtgggcgcaggcaccaggcgcacgatgcgcctccgtccgcggattgccgccagatactacgaacttttacacgcatgaaatgcaactctgcccgaaaggatagtagtactagatgtctagatggcaattagcccatgtgcaccggccagccacatcagtcgaggccgcgtatgcatggccggaccgcaactaaccgtggcggcacccgtggtacgttactcgcgcgtggccggtcggcgccatttttg

SEQ ID NO: 101706 - DNA, 568 bp, Oryza sativa
cttttaaatcaacaaagaaacatatccataaaattgctataaatcattttaatttcttttcacttggttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtg

SEQ ID NO: 101707 - DNA, 588 bp, Oryza sativa
atttaaactcggtccaaaatagagtaaagcaaacgattggaaccacatttggttctagctccactcctaaccatgctcatgtgggcaggagttagctagctctcaagggcccttcgccgatgcgtgcggtggcgcggtgacggacgggccggatggtcggagacggccaggatgcggcggcgctccggcgaggtacagtacggaagcacggcgtgtgttctttgctaccagcgggggttcaaagttttaaactccgaacctcctgggacactactagccgttggatcaggtgcgtgcggttcagattgagtggatctccttcgcgaaacgacctcggtttcagaaacaaatgaggcccagcccatttaggggttgccttaatagagcccaccacggcccaagcagccttctctgtttctcctctcgaacgaatcggaccaccctcttcaccgccgtcgagcacggcaccgccgttttgccggcggcggcggcggcgaacatgaatgttcaagcaggaaggatgcaatgtaaacgtttgctactgaccggcgttggcaggtgagtagagtagtagtagccccacgagct

SEQ ID NO: 101708 - DNA, 615 bp, Oryza sativa
aaaaaagctcggattcgtgagctcagctcgggcttggctcgagcttggatggcttggctcggctcgtaagccaaacgagctaagcccaagtatccttttcagctcgttgctgaaatgagccgagcccaagctggctcacgagccgtttgttttggctcgctagcctaggccattatgtgtttatatcgattatttaactttttatagagttattatttgacaacttgaaatttatcattaagatttttaagaattgaatataaaaacttatttaaattttacatgttgatgatttgttcttactttttttaataattacaaattatatatgaagaggtgtttcaacaggaaggcttgcaagctggctcgagctaggaaatgagccgagccgagctcaagttttagcttgtttctctaactgagccgagccgagccaagccaagcctagtttgttacaagccactgcaagccgaactggctcggctcgtttccacccctactaacaaatcactactaggtcaaaagaggaaagaaaattttgaatgggccctccagcattatgaatgttttttttagaaccgatgccaggatttgctggtgttatattaaatagga

SEQ ID NO: 101709 - DNA, 740 bp, Oryza sativa
attgatgccacaaagggtcaaaaaagtgagcagcttacaatcaatctcactgagagtagtctccctttagtacaatagaagattgtcttccatacatgcacacgtcactaagcatgcatcccattatgacacatacaaatccaaacaaaaaaaatggtggtcaaaattgtggcttgaggggcccatttgggagaggatgagtgagaacattataaagcaattaagctctagctcaatcgttcctagcttactcttccatgagggggatggacaagccgttttctttacacgagagggaatagatgctttcttctttgacaattaagcaaagattcctagatagcttccaatgaaacacccattttggttttgatttctagtgcttattaatataaaatttataggttagtgctgcataaacaaccataaaatcaacagattaaacaaaaggacagtttgtagtacttactcattttcataatatatattaaaaaagtcatttaagtcttaagttatgttattgtaaataactcttaacttgtgttcagtcagactcgaatattatatatgcacgttaaacttaaaaaaactaatcattttgcaccatgaacttttcaatctagagtaatattaattagcatagttgatgagacttcagaataacctagtcatttccgatatatagcaccaaactctagattcacaatgcacagaaagacgtacaattaatgaataaagaa

SEQ ID NO: 101710 - DNA, 694 bp, Oryza sativa
gatgtggtacggatctcttcgggaaatgaagatgttttgcaaggcttttgggcaatcgaatccatgggtctcctgcacaagtatatttaccgaagtaaatatctcatttttgaatggtcggacagtccacagtatcagagtcaaaagcataccactttgtatggtgtattctctgacgtccacattcacaggctagttgttctattaaaaatgtacaaatagatgtgctagactattattaactgtgtcaccattgatccggttgcagtagtacaaaaaaacagcgtattaaaaaacagtgtgttatatcataagaaacttatgggcttaaaaaattgcaaatcttccacggaaagaaagtaactgaatttattaaaaagacaggggcttaaaaaattctaagcaaacggtaaaattcggaagcatcattaatcataaaaatagaagaaattcctacttttaataaagaaagtactatattattacttctgtgtccgtccgagcacacatgtgcagctcacagctcaagaacaacatggtcgatccgtttagcggagggtcgtgctggcacgacctggctagccaggctgtgcttcagttgctacccgggttgtcatgccaacacaacaagtgcatgtgtgagccagcacgacatgacccaggaatagcgcatagcttggcccgtgcgacacga

SEQ ID NO: 101711 - DNA, 763 bp, Oryza sativa
acaattaagcactgttcccgaatcacgatgcaatggcttaatttaaagtagctagctcaaatatatccacagttaattagcttggattaattttgctccaattatatcagtgactgagccctgtatagcatgatgcatgcagccttttcttgctgagagtggaagcttcgtttgttctgcgtcgcctcctttctgcaatgctgcatatgtatgtacagtctaatgtctatacacagtgcccctggaattgctgaacttcacactgcttgtgctagtgtacaattcagaattcagatcatatcatatggtcagggacacaagcaactgttctatttttttttcagcagctgttaagattaattattcgaggtataaatgaatgaagtattataaagttaggaaatagatttaaattaaatagtatttactataagaaattcatatatgtacaaatttttcaaaaatcacgtattgttaagagtttgagaaacgtgtatgttaattcatgttggggaatcccaacaagaatcgtgttcgacctttaaaatcccaataataataaatagaagaggcaacatgatagggtggggcagttgacgcgatattaaaaaaatataaaacagaaccaaaataacgattatgtttgatttttaaaagcccaataacaataaagaggaggggcggtgagcaggttgtacaatagtaaagataacggcgggtatgaatcagcccatttcatgcaccccaattatattggctgtat

SEQ ID NO: 101712 - DNA, 749 bp, Oryza sativa
aatagagtattccagttattgagtgaactaaccaaacagtgtagcatattagtctttgaaatcagaatacaaaggtaggaagctctgaaccggacaccatcttgattaacagtgattcatggaacagtattacggatattcagtgaaaaattcccatctcataactttgccttctacatatgcagatcccatacttgaacataagtagtgctagaatgatgcgaaatatttcagactagatccagattggtcaattgactcgaggctttctacagaagaacaggattggttcaatcactagcacttgagttttaagcattgtagtttactaagggcacgtttggatttctggaatattttgcctagccaagcaatgccaaagtagtcaggttaggctatatagcctatggcaacaagagagttcatttggtttcatggctgctcaagcaaaactaccaacgatcattgcttgccgctggagcagagctgatttggctctccctggtgggcaaggattttgaggcagttattgcataacttgccctcaaaatctagcattttttgtttgtaccaaatgcctctcctaacttagcaaggatagaacttcccttgctcaagattaaaacacaccctaaaaagcataagccaaacctaaactttgaaaggacaggggtcaaaaatactactctgcagttaacacatgggaggtaatgcaattatacatgacgaacaatcttcaactatgaaca

SEQ ID NO: 101713 - DNA, 686 bp, Oryza sativa
attgacgccattgatggctttacagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggattgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagaccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaagg

SEQ ID NO: 101714 - DNA, 906 bp, Oryza sativa
ttcctgcagcccgggccaggtaggccaacaactatcagagaacaacagcgggagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatatgaatagcaagggtgagtaccaaccgtactcaacaagccaccacaacaacaatgcatatgatagagggtatttcaaggaatggcttcaggttcttttgcataaagctaattttacaattcttttcacaagcctaaaacctagcatagactgatcaaattttagtacagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccatcccccacaagttaagaatttagagtctagccaagtgtaatacatgtcctggtgctcaataaccgcgagcacggctattcgaatagatttggtttactcacactgcagtggatgtacactttatccgcactccgcgactgcccaacacatgagcctcgtcccaacacatgagacgcgtcacggcaaagcttttcgataacctcgcattggcagtatccgctccatgaacttaaatcctcatgcactctaggcgtccatgtttctagcagtgagaggagttctggcactcctgggaaagagaagtctcacacacatattaaattatggttcaagttaagttctctctctcacacactcatggcattcctaccaatggtgacaccg

SEQ ID NO: 101715 - DNA, 682 bp, Oryza sativa
actcttgaagtcggaggaggtcggccaaggattgagggattaagacgacttgcaatcggtaggcgccgagctactggtgggaatccatcttgtctcacaacaccagagtaaagaggccgggaagatgcacgatctttgggggcggggggggggggggggaagaaatctgcttgaagatctgcttggggattttctggactggatgcagatttgaaatcgactccgggagagagccagtctccttacctcgagctgtgcccaaagaaagggctggtggttggatgtcagatccatggaggatctcttctctatcttcagaggggataggatctaagcagctttcttcaatgagctctccctcctctaacggacaggaggagctttgaatggttgggaaaagacctggcgaggagtggctggtggggaagcattcaagaactggggaagagatatggagtggaggatctactgggtgggaggagcgcggcgccgggcgccgccgcgggtgggtgtcggggctgggggagaaggccatcagtcgaggaagcgattcaatcagttgaaatatattatagggaaattattttatatggtacctaggtttgatatctaggtgtatgcatgaagtttaaacagttatataaaaattcataagatttgttaagatatattataacaatat

SEQ ID NO: 101716 - DNA, 728 bp, Oryza sativa
gatctgctacagcgtcggtgatgaagacctccatggccggcagcaggggtgcgccgagcacatcgtcgtccgcagccggctgaggaggctggggaggcatggtacaaggtaggcaccagatctgttgcctcctcttcctcctccgccgccccgctgctcgacctcctcgaccccgcgactcctcctcctcctcctctctcttagggtatcacgctgatacccaggtaccaaggtctgatacctaggtaccagctcaatacccagggtaccaggtatcagtcgataccagggtaccaggacctccggaccccgcgactcctcctcctctctcttggggtatcacactgatacccaggtaccaaggtctgatacctaggtaccagctcgatacccagggtaccaagtatcagtcgataccaaggtaccaggggtaccaggtaccagccgataccagtgtaccaggtaccacctcggtaccttacccaaggtaccaggaggatttggcggtgaggtagctgctactctgggtgcttaggggcgacgacgctggcgaggcatcgcgcgtgaggtagctgctactctgggtgctcaggggcgacgacgccggcgaggtatcacccgagcgcgcaataccgaggagaatttttggcggtgaggtagctgctacttcggcaatgacaccggcgaggtaaggtagccactgctccggcgacgataccgagcaggca

SEQ ID NO: 101717 - DNA, 1317 bp, Oryza sativa
tgctggcgcagacaccgccaaggcccacccacgggctagcccaggtacgatgccgcaaggcccacccacgggctagcccaggtacgatgccgcaaggcccacgcacacgcagacgcactaagccccgatagttttttccttttttcgccttttttcggttttcgcttttttttcttgaatcgcttccttattttcttcacgtggtggcgcgatttttttttctgctatattttataaattgaatttttcaccttcaatttcagttgaaagtttttaaaatttaagttgaatgctttgaaatttgagatgaaagttttcaaatcttgatttgattttttttaaatttgagttgaaagtttcaaattttcaactgaaaattttcaaatccgagttgaaagtttttaagtctgagttgaaagttcgttttcaaatcttgatttgaaagtttttcaaatctaagttgaaaaattaaaaaaatcttgagttgaaagtttttaagtctgagttgaaagtttccaaatcttgacttgaaagttttcaagttcgagttaaaaattttcaaatctaagttgaaaaattaaaaaaatcttaagttgaaagtttttaagtccgagttgaaagttttcaaatcttgacttgaaagttttcaagttcgagttaaaagttttcaaatcttgatttgaaagtttttcaaatctaatttgaaaaattaaaaaaatttcttgaggtgaaagtttttaagtctgagttgaaagttttcaaatcttgacttgaaagttttcaagcccgagttaaaagttttcaaatcttgatttgaaagtttacaaatctaagttgaaaaattttaaaaattcttgagttgaaagttttaaatctttatgcgtgcggtagtcaaatgcgaaaaaaaaaagtgacagcgtcgtgtagtccacggcaaaaaaaaaaaataaaaaaagaaacgtcacagcgccaaaaaatgaaaaaaaaaagaaaaagaaacgtcgcgctgcgtgtacctccgcgggacatcacgtgggcctcgtgggcctgccctgcagcagcgcgcgacttcgctacctcgcgcgtacgcgccaactagtgtttctggcatttgctaccggtgtataggttaggtatagattctcattgttgattttttactctcctaagggaaaagtgaaaagtggtcagtggtaaaatgcatcacgccgatcgacattcacggtaccgagacgtgccagaaatgatatgcctatgcaagagagcatcgatctcttcttcttttttatgtatctcattaacaagctagagaatcga

SEQ ID NO: 101718 - DNA, 1128 bp, Oryza sativa
tcctggagttggtatgtcagtccgggtcagattcattccaggctgaagcgcaagcacggcaaggaagtcgctggccattaaatgaaggttgaaatgggcgtccacggaaaaagcgggcgagcggagcaggaggcgcgtgctctgcttgtcagaagtcacttccggctgtagactagccctcattgtaaaaagcatgtttcctttcttaggcagctagaggcccatgtggtgacccctgatcagataaaaaggaggcccaggcctaagagagaagggggagaaaaaaaaggaggaggggggctagagctggaactctctctcgctctcgagctctctgtattcctttacacacagatccaccagaacacaggagtagggtattacgcttctcagcggcccgaacctgtctacgtcgcccgtgtgttgtgcgattcttctcgctgacgttcctcagattgagggcgaagaacctcacttagctcccccggccgaaccggcaaaggggggcctgcgcggtctcccggtgaggagcctcactctccgtcaattagcaagcgcgaataatatgagcaactgtaagttcgacctcaacaaatatattttgtttgtgcatatttgattgttgcttgaatattggtttttcttgcgtattctagactgtgtatcggttagtcgtgaggcaacgtatgcagcttccaggaggtgaaggttgatcaagattatattaagaataagaactactctgagcaggcaagtcatcactattccttgaacatgttgatcccaattgcgaaattgttttgtttacaaataaaattgcatgcaatgatgaacatcccacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggtggacggaggatttg

SEQ ID NO: 101719 - DNA, 662 bp, Oryza sativa
ttttattaaagaactccctccgctttacaatgcacatttatatttatgacagaatggcctgctttgtaaaacgggtgaaatattttttaaaagtaatctgttaccttccttccgtacatacatatttttaactcaaatatattttagtcgttattaatagtgaaagtttacaaatagaccttgtccacaacgtatattatcaaccggaagggagcaagtaggctagataattaatgtggatggatgatggtagtagtcgtccttgctgagattcttccttgcagcatgagtgcatatatgtggctggcatggcagctcgctagtacttgctcaggctccgggcttgctcgacggcatacacacaaagtcaggttaagctatatatgcaagatactactactatggattgcgtagtacttcctcggtcctaaaaaatgaaagccaacctattattagacatgacacatctcgatacaatgaatatggacatactaatctatgtccagattcattgtcacatcctaatactagatttgtttttttagacagagagagtacatgctatatccatttcagaatacttgtttttctagattatttagcatgaattagggtgcaaagaaaagaactatagtactcttaataaataatgtatagttaga

SEQ ID NO: 101720 - DNA, 650 bp, Oryza sativa
ggttatgaaaactggcaaaagatcaagcacattccaaacaagcctttataagcatccatacatgttcaatgtaaagtccatgtgtgctcctccatttcttttttttttatttgaaaagttatgctctacggtgattatactgttactcatgttgattctgttttgttgatcaggaagtaattaagcctgtcaaatatactaaatgctgggggcggatcatggtgtgcacatgcacgccaatgcacggcatttggaacacagccagagaagaggacgttaagcatggtggctgagatcagtaagccaaaataaaactggcatggccagattgtgaatttgtgatctttggattatttcttgctaatttcagtataataccgtacattctgtgtttattcattcatttacctgtttcatgtttctcttattattccttgtgttggtcaagcgcatggccgggcttgtcggtgcagcgccctttgtgtttgtggtgttcctcatgcgtgggatgcatggcccgcgtcgcggaggatcatgttgcatttccacagatttcctgttcttgcttgctgttaaataagagaagaaaaactaagaaaagctgcacagttctggtagcacaaaacattttgttcaagtgtttgtctaag

SEQ ID NO: 101721 - DNA, 699 bp, Oryza sativa
aacccaatcccagaaattctttgatctaaattcatctaattccaaactctttattttgataccaaattacctattttaaacattttatttaaatttctttatttatttaaataccttttatttatttacattctgaatttaaaattgttttaaataaccttgttaaattattatattttattcaaatacctttttaatttattttatttatcttaaatacctttaaatttaaatctcttgttttatttaaaaaccccttttaaattaaattttcctataatttatttaaatacattttcgtcatttaaatatctttatgatttaaaataccatttcaaaattctttattaccctttttgaatattcaaatttctttaattaaaaacctttttgaattcaaattcctttgatttatttaaataccctttttatttctaaaccatacctataccatcccatagccactaaacagccgccgtgagaactttacgctttccatggagacattcacgtggtctcaaaccccgatgtcaaaccgttggtcgtaaaacccggcataagctaatcccaaggtcaaagtattgctcctcgcaccccacgccttaacgcgtacagtggttggagcctcactactccatcaacctccatagcacgccgcacactagctttcgggctctgtgcgaacctagcagctgtgct

SEQ ID NO: 101722 - DNA, 734 bp, Oryza sativa
aaccaaccatgtgggaagcaaagctcaaatgcagggtatcagaggcacactactaactactttggtggaatatttggctagaaagaaacagaagaatttttccaaattcttggcttttagtaaatgaagtagcctaccttatcaaacaagatatggatttgtgcaaaatagcttttaagccccccctgattttattttcttcttaagctgtatttcctctttgttatagtccatgtaaactctgtaaactctttgctgggtttcggccttttccctaatttaaattccggcagatctcctaccgtcgttctcctaaaaaaattctaaaagaatttacattattcactagccactatgtggtaatagaacattcatttcactcacagatactctaacaatccaggggctagtgacaaactggaccacctattagcaacttgccccatccaatgaagagcttgattgtctatatgagtggtgggagatgctctctacttgtcaatgcgtaaccaaggagaaaggacttcgcacatgcacttagggacgaatcctgaataagattagagggacactcatctcctttctccttcaaccattcattatcttcctcctctacctcttctccccctttccctctccttctatcaatagagatctagcggggtaggggggattcaatcgtaagtctccctagcatccacgctggattcgcctgtacatgccattgtccttct

SEQ ID NO: 101723 - DNA, 615 bp, Oryza sativa
tttttaattagggtaattttactattcttgaaaataatatttagaggtaccacattttctaatataaaatttggtacctcaaggtaccaaaattttttttcaagtcctataaaattcctcttagttatcccgtccagatggttgcccgtcttgtagtatttatcgatataaccaaacaaaaatattcgaattcacgagcagttcaaatggccggtataaagtttgcatctttaaccgtaccggagcattaatttcttgtatggatgcatatgcttaaatttagatagggtaattatggaccttggtgatttcctttttgctgtgatcgatttattgatccgaaattaaaaaataatattttttatgggactatctatacaacattcgactaaaaattagtctaaaaatctgtcaaatgtaactgtaacataattacaatgtaattttcataattaaactatatttatactataattacgtatgtaattttcataattacactatatttgcactataattacatatataacttgcatgtaactcgcatgtaattatagtataagtaagatataagttcaaactggatcataaaaatatagtagcccaatggggcag

SEQ ID NO: 101724 - DNA, 705 bp, Oryza sativa
aatgaagataaaaaaggaaaggatggatggatgtggactttttaaactttgaacaaagaatttaggtataattttgaagggaatgaaaatgaaaagtatttgtttggagactttttgaactttgacaacgaatttgaataggatttctaggaaatagaaactaagggagaagtttgaggacttttagaattttgaaaaaatttaaatatagaaatttttagaatacaaaaggagtttgaaatctttttaaaataaaactaaagatatttattttaaggtataaatttgaaaggataaaataaagatgctccaagtttatagaattcaataagaaccaaatataaaacttgtcacaaaagattttctctaatattttataatttaaaattgaaatagttcacaaatgatttaatttctgactttggatgaatttttgggatggtggcaaaaataaaaggaagggaataaattggactttagcccaagattatgtggtacggatttctgagtgaaacatttgtgggctaaaggaaattggactttctaaggaagcgattggaaatagtgttcttaacacaagagcaatcatttaatatttgtattaatattattcttctgccgaggagaatcaaaccttgggaatcaaattggcggtttgatttatataagaatttggatagtggaacatctagaggagtttgtgga

SEQ ID NO: 101725 - DNA, 543 bp, Oryza sativa
ttcatctttttggcaatcttcttagcttcctaaaaccgttgttcatgcactccaactttctgggccagatgagccaagctttcgaagtcctgagccgaaaattttctctgatcggatgcaataaaccctggaaagccagatcggctaattgagaatctgaaaaggacaaactatagcatctgttcctcatatctctgaatctctgaatatagtcttgaatagattcatcatgcttctacttgactggaatcagatctgtcagcttcatctcatgaacgccactgtaaaagtagctatggaattgcttttccaaatcggctcaattactgatagaattgtatggaagattagagaaccaagtaaaggccgatctagacaaagacaaagggaacatcctaaatctaaaagcatcattagccgatgcctctcccagctgagctagaaatcggctgatatgttcataagtagaaaatttggaaaaatctagcaccttgtatcagtgtggtaatggaatcctatcaaactactcaagatatggtttcc

SEQ ID NO: 101726 - DNA, 629 bp, Oryza sativa
tacgatgctcatggaggaggacaactcttttttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgatgggcattgatagatgacaagggtctatagaaggagaaacaagagagcgggagtgtaaaatgataaaggatcggaagcattctcccctctactttcttttactctagtatttttttatatcagaaatttaaactatcatagatctgatttaaaattcatctatagtgtatattcattt

SEQ ID NO: 101727 - DNA, 897 bp, Oryza sativa
aaattacatatgtattttagtgtattaaaaatgtaagtcctaaaattacatatgtaaatcatatggaagtgatgggtaagttagacaaaatgagttagttgctcgcatggtaagcgtcttggtttgtaatgctcagggcatgagtataattctgctcgtctcttggatctctgattctttttgttttatgtattgcacgaatcttaacatataccgtatggattatgaatcgacatattctttccacaaaatatggagccatttttttagcagctccgttttttttatcattgtgcatatcctctaatacggtttttttttaagaactagggcacaaagcccccctttccattaatggaacggcataattgtcttacagattctaaactagaaacagaaagcccagaaagagggttcccacaaaaagaccagcaaaacaactggttgagggagaatatcctctaatacggttagaataatatatatgatcaagctaatattcggaattgtcttttttcctcttcttaatcccatcggccataagtggttagatctatattcttcttccctcatcttgctctccaactctattcttaacccatacccagtaatataggccggtatagtccttccctcatctttattttcaatcctattcttatcaacccatacccaattatataggcaagtatagtccatcctaatcatatagacccgttgcaattaatgtgtgggcatgttactggtgtatagaaagataaagatatactgtagaaatgaaaattgttttaattaaggtcttctgacctatagggtggtaagagcaaacaattgaattttcatttgtttcaccaataaaaaatcggaattgctaaatatttgttgacagatttttga

SEQ ID NO: 101728 - DNA, 1030 bp, Oryza sativa
tttgttccatttacatattattgttgtagtttaagatagattaaacatcccaaatctttacacattttattgttttttccatttacatattattgttgtagttttagatatatgttccaacattaaatgacataacttccttaagaaacattaaatgactttatatcttgtataatttattgctgtcatatcgttctatacatatatttgtatacgacaataatatttttggtggatgtgctaaatctgcaaaacatttgtatatgtacaaatacatgcttgttgccctcaaggttccataaaactgacaaaaaccattcggttttcacgaaatattgaggtttcaaaccagcttgagtaacaaaccgcttggttttcacaaatttttgagatttcgagcctacttgggttgacaaaccgctcaataaacagccaaattgaaaaaaattaaatcaaactagattccacttttttaaaaaaaaatctataactctggttttcacttttttcgcgaacatgtaaaagattgcacgtcaatatatttgaagaaaaacaatgtttttgttacacaacgcaatgcaaccgcccaggcggccagcccgagggcaaggaaacaagagaattgaaaaaaacaaagactgctagtgtaaaaagagcgttgctcctgtatagaggagaagttttacggtatttgcattccagaaatagtaaaaatccaacgctccataataaaaggtatcatacaaaaagtatttaagtattaatataggtacttaggtagaaagggtaaaatgataatttgctagaagatgaaaaatggtagaattgtctatagtattagttgtaggtacataggtaccgcatcagtagttcatcaccaaatatgcggtaagtcatctccatcgcctctaattttccattatattatttgcattgtatttttttatatttgcatattgtcgtgcccttttcccgtggctgtctctaccagtttaattttttttcttagtagcgacaaaataatgaaaat

SEQ ID NO: 101729 - DNA, 1196 bp, Oryza sativa
gaatattttaataaaagtataagtcttaccaaagaaagtaaagctaccggatcctacccgattcctatgaagacttctcggactagactcctattctattcctactccactaacttggagaaaactactaaactagagagaacggttgattctttttgctggaggtgtgtgaaaaaatggagggagtgaggggttatataggctggtaatgacggtgggaaaggtcggtattgccctccaaccatcattggggatcaatcccagccgtccagccaaaccctacatccatcggtgttacggctggttcggccgaaccctgggctggctcagttcttggcaggtggcctccccgtttgctcctttccgcagacttgtgaattttgggcctggtggatcttgtgaatttggtgttctcagcccatttatccattagtttgttttttggcagggtttgaaagaatgatcggaaggtttgctgtcacttttccctcaattaaggtcaatctttgccaaaaggtaagaacctaggggtagggggaaattttagttgacataaatatgcattgcaagcataataagttctctttattttaataatattgacgggcgaaattgatcgctaacgaccgtcaacaaaaccccccaagctggacccttggctcgtcccgagtaaaggactcacaaaaaaaaacttggtagctgatcaggagttgctcctatgcttatatctcaaaagtataggtgcaagaagatatgtgtactctctctcaatcaaataaatttggcacgggggcttacccttacccctgattcccacgagacactgtccttccttgtcttgagcggttgagagacagaacacaaacaacaacttgaatatcttgtggtacctcctcaacctgcctacgcaactctttcaaaataaccatagctctttcatatgcgaccttcgacttgcatgctgccctcatcactccaaatgcttcaatcatcatcatgtttgttatgtaattttcatgcaccccatccggtcctgcagtctcacgatcacacttgtcactgtttgctttcatggtatacctctttaggaatagacaacagggatcttctccagttggatgtgtacgaacgccctaatcaggtgtgtgcaaaacattcctacaacacaataagaaaaaaacaaaacaatttttgtt

SEQ ID NO: 101730 - DNA, 815 bp, Oryza sativa
gagctacggctccaacggctagaggaggaagacgaccgacaggtgagagccccacctgtcggcgccccaaggagagagggagggagggaggacttcggggaggggagaagcgggccggcgcgggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaatcctgttaatgtagtagagcatgtagaatctaagaaaaatttcacatgccgattccgattattaaatgcatttattaatttagggtttctctcttgcctttaaacaaataatttcttgcaacaatttattaattgaatttttgctaaggagaagaacttctgggcgtgacatacgtatacaatgaataaagggaaaattaacatttcttatacgtatatcaataataaataatgtagttgtactagactaagagaattaacatgaatgcggagattatacaccaaagtgaatgagaaatgaagctggcatgcaaagaaacacaccaccagcgaatcacgtgtgagcacacggattgatgggacccaaattaggccaaatgttgatggttctttaaatcataatatttgaccgtcaatacctgcatataatgaaataaaataatgaaataaaatatggtattcaacttagtggtagggattattactacccaattccactagtgttgcttaaatatgtgtatgcgggtattttaatgagaaaa

SEQ ID NO: 101731 - DNA, 1422 bp, Oryza sativa
atcacatgttaatacatcttcttaatttttttcaatttttttcataatcatttgaatgacatgcaaataatgagggttacattctgtcgagggatcaaaatagtttcccaccacaacaagcctatatataattaatgttggtatattagcacttctgaaatcaatcagttgcaaataaagagagattaatgcatgactcccaagtttaaatgcccatgaaaattacgcagcaaaactctgaaaaactatgcaggttattagcctgataactagcttcagcctgttgtagcataataggcagttttttgagcttcatttccttttcatatcttgaaatcacaggtcaagagggtgacaaattatgcaaaaaggcagcagagacaaaagaaaacaaggacatgtacatgcctcttactgagaggaaaggacgccattcctgaagaagttgcatgaactacatgctatgcataatagtcaattttaccttttgcttgaagatgagatgagcacattctgtatttttcccctctttttgtaagaaagttacatttgcaaattgttagtatattttccctggacggtagctccagaaatacatccttatccactggtgaaaaaagtttgccaaaacttgcttgtcacccaaaggccaaatgaaagaggccatggctttttgttgcgtgaggcttctcatctgaacaaaaggcctaataatgtagagcaccttgcacagaaagcacatatatatctcctttcaccatgagtattatttttttcttgttcttgccttttgattgttgatggcatcgcgagattcatccgatcttgaccctcttcttgtccttttgttatttcaggggagctttctctcagttttccatcaaaaaatgccaaggttgaacaatacagcatctgatgattttcagtaaaaaaaaatgccaaggttaaagctgaaaatttgcactttaacaaactaaaagacatatttttcttctcaatcaaattaaaagacatatagtttctcagaggcattcccaaaacaagtaaatataataatttaaaattatctatactattgcagcagttttttttcggggaaatattattgcaggagaaaacggacaatatgccactctatacgtggggtttcgatgaaatgccactcaatagaatgcaccaaataaaatgctactcagtacgttgcctaacggatgaaataccactttgaggagttttaaccatttttatgcccgaaatatactttgttgtggctgcgaagagatagggagaggggagcactgggggaggaccggatgggcggcgctgaaggcctcgctgcgggagacggcggtggcggcgaccaaagtggcagctgggacgacggggcggatggaggaagaggtgatgacaaggacaagttca

SEQ ID NO: 101732 - DNA, 519 bp, Oryza sativa
actatagggcgaattcgagctcggtaccctatattacaggtaggattcttgtgtcttgtttgtacctttcaaaactagaaaagctattacaaagaagttatcccttcaacttttttcctgattctgatgggtttatatcataggtatggttgtcatatgtcttgtttgccactttgcactctaactgtgatgattttgcattcttctagtttctcttatgcaacattggaactactgccatgttgccttgtacaatcaactagatatttagtgatgtttatgccctctgttcttaaatctagtgtgttgatcctgccacaaatgcgtgttttggaaactgacagtccacaaaacataacttataccatgtttctatttaaaaatggaggttgtatattatttttgcagttgcgattggagctggcatgaagagagagacagtgcgacacaagcgcgtcgacccgtgttgtgttggtcacatgtaccaccaacgggcaacagcctttgcacatgcacaaa

SEQ ID NO: 101733 - DNA, 1989 bp, Oryza sativa
  unsure (1)..(1989): unsure at all n locations
atcttcaactagaggtaaacttgtcatgacggcttgcgttctcgggattagtgcttccatctttatgacactctaatcctatttatgtaaatcgtcgagttatcatatatcctatataatctctggcaatattggtatttaatccttaattagctaacatatattactggaaggcagccgattaggttaaatattaaccgttgacctagattatatagggtatccaccaccctatgaaacgtccaaccggttgattgtctagatattgtccttcttttctgtcacgcccggaatttctatccaaaattccaaacgcttacatgtgtgtaaaccctcgtccatgaatcagccgaggcacacaataacaaattgataataaagtacaattattactctaattaataagcgaataaaatatcattacagaggtagatagttcctctcaatcaattaaagttctaagcagcggaaaataaaagaaacagcgcaggcgacttctcttcacagtagcttgaccaggactaggcctaatcctcaacaccatcagcatcactatagaactcctcctctgatgaatgattgcaagtaagtatatgacatacctagcaagccacgcagcaaatatacaagtgcacaggataacaaaagatggcatagtatagtctcatttgcataaatagcatttaacaaatatttcagaatttaataaaacagttaaataataattaaacaatattaatccaacgctatacaacataccctgttgcataggcccaaccattctgaacaaccaatcccggctgcacagttctatctccaaaccaggaattaaccattctaaaccaggagctaaacacttattaaacagcatcattaatatggtgagaaatgtgagactaatcagaaagaacattgtagaacccgccattaaccgcgggcacggctattcaaatagtttaaactctacccaaaggtgtacaactgtaccaacaaaacacaacctcaacatcatgtcaaccaagcgtcgcaatactaaacaggtccccgaatagaaatggggacaataccctctatataatacaattaaaagcatgcaccggtcttggatcataatcacccccttataaacaaggtatggactccccaacgacccccgtttgcttatctccgccacttcacagtctggtgctctactatgaaccatactatacagaaagtaaagccgttgctcacgccggcttgtggttggacggtaaatgtttcacaaccgaaaatcgtgaaccggtccttaattgtcatgagcacaaccatcaaaaccatatgctcacaacccaccattatcaatttttagttggcacattaattaattaaccaatcatgattaaccatcatgagctaccattaagccatcattaaataatagtgaagcataagttatcccagtagtgtgctaatgtttctaagcataagttatctaatatccagctgaacccatatatataaagctcaactagtcaagttataataacccaagtatcanagaatagggtaatcaagaaataacaaagcaataggttatttccacccaatgacattcaaaaataaatgcaattgttgaataaaaacaatagctttaaacgagatcaacatgctcaaaggattgtttgggatctgtgtgacttgccttgctggccttggaactcttcaaagtcttctcctgcaaattcggactctccgggaacgtcggaatctaaagagaaaagaacaaaatcaccaaaacagcacataaacaagcatgaacagtacatgtggatatttttaacatgtagatctcaattttaaaaaaatttaaagacttgaaccaactaaatccgagctaagatgaattagttatgaattttcaaagattaaatcggattaaaacatttatatagattttaattgaattatgacacaataatgaattatttttgaaaaggaaaaagggga

SEQ ID NO: 101734 - DNA, 657 bp, Oryza sativa
aaggtggggaagggagaaagggagaggacttcggcccaaataaatgttttctgaattttagaagggctttagaaaatttggtttggatagaatttgaatttggaggaaattcacaaaagaaagattttccaaaagacatattatctagtttatttgagtgcaatattttgagagaaagaatacattggactaaatattaaagcactcaaataggaggggaaataaataatatgattactcacaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttggtggtatttcttaatgatattactagaaatataattc

SEQ ID NO: 101735 - DNA, 992 bp, Oryza sativa
ttttcaacttatttttttttttgtaatttggtactgaactgagttgtatgttttttcaacttctatgtgataatttaaaagctgagtttggtactgaactgaactatatgttttttcaacttctttgtaatggtctaaaagctgagttcatatgtttgtgtttatcagctccgtaattgaaaactgacctaagatgttagttttttttttcaattgtctactctgaaactaagctgagcagccaatttttgagtgctaggtgtgttatttggatttggagttcttatgtagtttgatttggaactgaagtgagcaaccaaaatttgagtgcgaggtgtgtaatttggatttggagtttctatgtaatgtgatttgaaactgaaccgagcaacaaaaacttgagtgcgaggcctataatttggattggagtcttgcctctgtccttttccgttgaacatttcaattgatccactctttaatttccttgacagtataaaatcatatacccctcaaaaaggttgcaaattttgaatacaaaaacaatataatcagatatacaactaacacagacaaggagacttctcagacaagcacagagatcactgggcgtggagctcacaagaacgcggcgagatcagccgcgtcggcggcgagctgtgtcgcgccgcccttgcgccgcgccagagcgagcgccaacgcggcggccgccgcggcgaggacgacgagaagcagcacggcgaggccagcggacaaccacaggcgccgccgccgcgcggcgacgcgcagccgatgggcctccctcagctccccctcggcggcgcccacgtcgcccgcggccgcggccacgtgccgctcgatgtcgtcgacgcgcgcgccctgggactccaccagcgccgccatgtcgaggaacagctgctgcagctcgaggaggccgccctccacctcctccgcctccgaggaggacttcatggccgcccgcaccgccgcctcgg

SEQ ID NO: 101736 - DNA, 598 bp, Oryza sativa
tttggacatcagattcgtgaagccatcagaattattgtgcggctcatccctactttggaagttccatgagaaggtattaataaactaccactcttaccttaaaatttggacatcagatttgtgaagccgtcagaaatattgtgcggctcatccctacttctattgttagtggaagttccgtgagaaaacaaactaccactcaaatattgtgcggctcatccctacttctattcttagtggaaggtccgtgagaaggtattaacaaactaccagtgttaccttatttacttttttaatgcttatgaaattatttctccatttctaaaatgcatgctataataaattcgtgagatttgagttaaaatttattagcaccattttccctcaaaatttttgttactaacagcccaatttatattgctgtaatttcagttgtaattttccttcgaaattttctgaagctgtaatttcagttgtctcgtattcacatttaataagcctttaatttatgtagtctatgtaatctatttggtatattatgtcagatttagttatttgtattgatcctcaatttatatttcaatctttaaaagtcttt

SEQ ID NO: 101737 - DNA, 686 bp, Oryza sativa
tgtttcaattttattggtaaattagatcatgtttcaactgttgcttttcatcataaagaaacttatatggttgttggagaatgaaacctcctcatttagatagtgctagttccatttctcttttcaaatctacattttgatgtaggtttttagaactttgtgataatctaacaatatttgttatgatttatttatttagctgatcgtttgcttatatatttctgttggagttagctaactcggcgctctatagacaattgggcttggctacttcctcatttattgtgagcacgtttttcgaattattcgtaaaaaaacatttatatagaaatttcttttaaaaataattaaatctatttttaagtttataatagttaatacttaactaatcctatgctaatcaccttgttcgatttccgtttgaagaactaattaagccaaattgtagtatcgaagaaagcctaagactgcatagccacttgcaaaataagaacatgtgactaattgaatatagtattttaagaaaataaatatgtactttaactaagggattagataaaaaactgtcgagtgttttttgggaggaaaactttcaaatctaactacagtatataatttcactagaactatatactataataataataacttggttatatgtattaaaataatatatgcaactttat

SEQ ID NO: 101738 - DNA, 643 bp, Oryza sativa
taatgctacttttaacaataagcttgaacatgctatgagttgttatttttataagtggatttaatcttttatgaattccaaattcagttctcttatgaccgatttgacatctacttctgttgcaagtactagtcaacctcctgttcaccacatatttagtaaaaatgatggggcaaccatgcaacatgctgggagtgaaaaccctagcgctgctgtatgttcaagtgacttaatttggttttggtgattaatgacaaatctaactatatgagactaatgtttttatgagtctttctttgactagtctcatttggatatgaaagtaaaaatgatgagaggtatgtattaaacttcacatattctaatttggtctctcttgtggatccaaaatatagtgtgagcttcctctttgatctttattgattatgtgcatatgcgttccttcatatccatatgtatgcacatcttgagggagagcttattctatattttatttattataagatctctacctggatttggaatcatctttcatctcatctctctatattggttatatcggggtattatctatcacacaagagagaaaagattgaaagatcttggattaaacaatttgggtaattggtgctctggtgataga

SEQ ID NO: 101739 - DNA, 584 bp, Oryza sativa
ttgttgatgggtgatgatgagcaacagctgaaggtggcttctattgtgggattgttggaattaatgaatgggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgcctcgcctggcagggcaggcggcgcgcgtgcacgacgtagctcctcacccttgcgcagatgcagcctccttttgcagttttgttttgctgcaaattcacacggcgtggagtccggataagttacgcgcgacttatccggttcggttacgcgcagtagagatcgtgcgggcgccctgatcaagtgacccttctctatataaaccgacccgctgtcttcacgcaatatatgcgaaaatcaatctagggtttgcctcctactctgtactgcgccgtcgctcgtagactactccatcccgctcgccggggggcaccaacgattggga

SEQ ID NO: 101740 - DNA, 709 bp, Oryza sativa
tcgactctagaggatcccctcaaaatcaaagcatctcataacctgaaacggagggaggaacaatgtaccgaacggttttgctaaaaaactggcaacagttttatgtggtttcccgcaaaaaaaaaagttttatgtggttgaaacttttgaattttcaaccgttcgatggacttgaagattcgtgctgagttaagagaaaaattagcaaactgctcacaagagatggggatccaacccagaacttttggttcacaccacgcacagggtaccaactgagctatgaaaaattttctattagctacaaacaaagcatatataagctatacgtagttacagtatatttacactgtattataagttacaatgtagtcaaattatagttacatttgaaagttttttaccccagaaaacttgttacagatttttagataaacccttctagcgaatcgtgattattcggatggcatttgagccaaactcgttttcaatgattgcacagtgtcaattttcttgtggactcactgctttagtccataagaagatgacacgtgtcctcagcatttgaaaaaaagtgtggtctctgtgcagggagaccagacggaggagtgccctctccctccctcccctcccttgccaagaacggcaaataaagtcatgtctcccagagtctccctttctaaaagcagcaaacatagtcacgagcggagga

SEQ ID NO: 101741 - DNA, 503 bp, Oryza sativa
aggtaacaatgtacactgtataagttataatcccatcgcatgaaaattatatcccaaaatcctaattcaacattcatgtcttgaattttagaaacatttgcaaaatcagcaatatttcttggtaagaaaataaaaacacatattcgaaactttgagcagttcaaagaaaggttcacatcttgcaaccttggaatctgtacattctgaaatttaaaaatgtaatctgccatttgtaaatataaaatccgctagttgtttgcagttgacagtgttccgaagtccaaacaccaccaaattcattaagacagaaatgatcacacagctattctgaagacttttccagacagataaacacgctgcaatcagggttcttctgaagtgatcttgctagtctaaaatgcatgccatccaaggtttcaaaaaccagcaggtactgcccataaccgctctaccagcaggctgtcaagtccaactcaaaattcgcattttaaatatagaatttt

SEQ ID NO: 101742 - DNA, 608 bp, Oryza sativa
gtaatttggttctgaactgagttgtatgttttttcaacttcttttaattttttaaatttggtactgaactgatttttctataattttttttttaatttggtactgaactgagttgtatgttttttcaacttatttttttttttgtaatttggtactgaactgagttgtatgttttttcaacttctatgtgataatttaaaagctgagtttggtactgaactgaactatatgttttttcaacttctttgtaatggtctaaaagctgagttcatatgtttgtgtttatcagctccgtaattgaaaactgacctaagatgttagttttttttttcaattgtctactctgaaactaagctgagcagccaatttttgagtgctaggtgtgttatttggatttggagttcttatgtagtttgatttggaactgaagtgagcaaccaaaatttgagtgcgaggtgtgtaatttggatttggagtttctatgtaatgtgatttgaaactgaaccgagcaacaaaaacttgagtgcgaggcctataatttggattggagtcttgcctctgtccttttccgttgaacatttcaattgatccactctttaatttccttg

SEQ ID NO: 101743 - DNA, 599 bp, Oryza sativa
gccggatatcgacttcagggataggcatggtattcccctacggtgtctccggataccgtcaggagagacgaaagcgctatctctgatctcaccggacacggattcgaggagcaagactaccttgttgtcgactacgagtcagaccttcagaccgacatgtcgacaacagttagataggttacccacatattgtactggtgttattatggtgaataaaagcaactccggctccggccaacaggatgtagggttattacctgacaactcagggtcccgaacctgtataaaaatccttgtctccatctcttttacctcagtctcgcatatatcctagtaccgacgatccccatactatgcaaataccataattgcgacatcaaacgtcgacagtggcgcgccaggtaggggtattttggtgctctaagaatccgacgagatgggttcaaaagatggattcttcgacaacaagctactcgacgacttcggctggggagatctaacccgatcggagcatgccttccgacgagatccgaaccatcatcgtcattgacaacttggtctatcgagatcaccccaaccctcaagatacgtggcatacc

SEQ ID NO: 101744 - DNA, 535 bp, Oryza sativa
tatacattctgttagtaaacatgaaaatatggatgcatatcatatacaggaaaacatctattgcatggcatattaatatttaaatccatgcgtgttgattagatcagcacgtcaggcatgtttcctgggaaccgtgatttcctagcttaagtcttcctgtgcacggggtaggcatggcgagagcacatatgcatattaaatcacaggcatgcctgccagcttcagcatgtcgcatggttcccatgaagacgcggccggcttacgacttgtcttgcatggcagcgctgcagcggcttgtcaggttgttggcacccatcggagcaactcagccgccggtagtatatatgcggacaagcaaaataggaaccaaaaagacaatatcaatctctgattagaaattaatctaacagaaattagattagaccgatgaaccggatcgtgcagcgtggcttgcatcgtgagcgattaaaaaaatagccactagatattggtctctctgtttgcatgccgcatgcatgtgcacacccctggatgg

SEQ ID NO: 101745 - DNA, 527 bp, Oryza sativa
aaaaaaaattcagccggcagtggtgtagcaaccccccctcccaaaaaaaagggggaaggtttagcccaaaggaatttgtcaacagagaaatagccgtctgtttataaattatgagagtagctacatgatagtggggacaccttaagatccactgcacttaggtggccctgtttagatcccatcccaaaactttacaccctgtcacatcgaacgtttacctgcaggctaaaagataactaattacatagattgtggctaatttgctacacgaatcttttaagcctaattgctccatgatttgacaatgtggtgctaccgtaaacatttgacaatgacggattaattaggcttaataaattcatcttgcggtttactgacggattctgtaattagtttttttattagtgcctgaacaccccatacgacaccctatataatacccgatatgacacgcgaaaactttacacccctgaatctaaagggtgttgctagttggcgcgtgcgcaccagcagctcccggcgcaaaa

SEQ ID NO: 101746 - DNA, 887 bp, Oryza sativa
caaaatgacacgagagagaaaagggcatttttatcatggcagcaagttgcaagtatgacaggtgccttcttttttgcaaatgaagctaattagttaacggaatttatcatggcagcaagttgcaagtatttgacaggtgccttctttcttgcaaatgaagctaattagttaacggaattgctagtttactgtcgacagtaaacggggggaaaactgtcgaatttttgaccgtcggattcgccttaagattagtgctagcgcgttggtggaaaaaatctgcgcgataactgtaatttgtgttctgcgtgggggtggggtttgaacccaggacctcattcccaccagctatatgtggtagccacttcatctcttgcaagtttttgaaaagtttgcaaccctagttatattgtagttacatcgtagttacattgtagttacattgtaactatagtgtaactatactataactatattattatctctatatttattagatataaagttgcatatattattttaatacatataaacaagttattattattatagtatatagttctagtgaaattatatactgtagttagatttgaaagttttcctcccaaaaaacactcgacagttttttatctaatcccttagttaaagtacatatttattttcttaaaatactatattcaattagtcacatgttcttattttgcaagtggctatgcagtcttaggctttcttcgatactacaatttggcttaattagttcttcaaacggaaatcgaacaaggtgattagcataggattagttaagtattaactattataaacttaaaaatagatttaattatttttaaaagaaatttctatataaatgtttttttacgaataattcgaaa

SEQ ID NO: 101747 - DNA, 808 bp, Oryza sativa
atagtataatgaggagcggttgtatatggccctatcgtctagtggttcaggacatcgggggggggggtggcaagtgctgctatggctatgggcctgcccttttgggccaggccttcgattttcctttttcctgaatggaataagttcaccatagatcccttaggttgatccacgtaccaaaatacttaatataacgcgcctttcaactcctgaaactgttgcaaacttaatcctaagacggtttggatgatggtttcaactgacatggtatctacgtatctagtttgactggatcctcatcccacatgagacttgcaatcataaaaaaaaggggctttgtttctgtttcacccattcgtatctattagtcttgtcaaacttagaaacttttgttttggacgaagagttgaaggacaaattcacaatcatctataagaatttagttttccaacgtcgaaatctataaatggtattgtaaatacaaagagtgtgttctcagggatgtggggattattaatgaaacaccaatgaacataggagattgtttgaggagaagaggtgtactaaatacagggttatggatgtcttttgtgctagtttttgttggctagtgtccttaacttgcatgtggtttccaaaggaatctcaacatgaagagatgaagagacctacagcaagaggaataaccaagcagaaagactaatggaactgaagccggtggtgtaaatgatctacctgatgctatatagttatagtggtcgatacaaaagcaaaaagactacaatgcccctgctttatcaaatctcaa

SEQ ID NO: 101748 - DNA, 519 bp, Oryza sativa
gggctcggacatggcgaagaaatgtagggcgttggcgatggtggtgcgtcggctggtggtgagggcgtgttggagtgggaagaggaacgcctggaagcgttgtcaagcgcgttaccgttgaggatagccggaccacagctacggagttcgtagccaggatcaggtgcggcggcagggttcttccatgcacgctcaatggtggaaagaggaggattagggaaggagggagattaggaaatttggtttcatattgcttgcttgcaaatgttgctgattacatgccttataggcacttggtctctaatacaaggaaatgacatttattttctcctaattaatactttccttgcatgattctttctaatttgcacccttgactcatgctgcttgctgcatttgcgcctccggcttgctcctgtggtggtagtggtgtccccacatgacataatcgttttctaatgtcaaagccaatttgacctccatagtaattccaatagttttgagcctcatctacagtgc

SEQ ID NO: 101749 - DNA, 557 bp, Oryza sativa
tagtgttttaattcttaaaacctgcttaacaactaaaatgtggaatggttggcctgggttggcttgggacgagctgggacgcagggtcgggttgccagttcggtctgaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgagtacggtggttgtactcagtcttgctcaatttttcccaaacctagaagaggagccctggaagatgaaggctttggtgtctagctcgcgcctgccgtcaagcgcctgtggtcgtcaccctagtcttccgctgtttcccgtttgtctttgtgtgtgctgggtcttcgccgcccatgtaataaattaactatttacgcttccgcttgttaaactctgaactatatcaacttttggtgtaccttgc

SEQ ID NO: 101750 - DNA, 679 bp, Oryza sativa
atatatgtgcacgttctatttttcttttcaaatatattacgtgatgaatatgcgaacggaaagtggagcgtgtacatattttctttcttggagataagatgtaatggtgaaaattagtataatttaatggtttataaaatattaggtccacctaccacgtggcgatataggagcgtttgtaggagcgctacgtggcggtttaaaagcgtttgtaggaagtttaatatataattaatttttataatgtatggttgttagaggtagaaattaggagagagaagagacggaagggaagagggtcagacagggagggagggagagtacgtacatatatgtgcacgttctatttttcttttcaaatatattacgtgatgaatatgcgaacagaaagtggagcgtgtacatattttctttcttggagataagatgtaatggtgaaaattagtataatttaatggtttataaaatattaggtccacctaccacgtggcgatataggagcgtttgtaggagcgctacgtggcggtttaaaagcgtttgtaggaagtttaatgtataattaatttttataatgtatggttgttagaggtagaaattaggagaagagacggaagggaagagggtcagacagggagggagggagagtatgtacatatatgtgcacgttctgttttctttt

SEQ ID NO: 101751 - DNA, 678 bp, Oryza sativa
cccatctgagttaacatcctgtgttcgcatacatctcttccttctaatgcatggaattataagcatacatcctgttttcaattctttgaaccatatagtttggtgatggtggatatcttgaatatggtatagtttggcataaaaaaaaacacagtaaggtacctacatatgtttttccaagcgattgacaatattgtggctgcgagtggcagatgtagatccaactatcagaatgaacaatgcaaccacaaccttataatagggaaatactgaaacagacatcatgacatgtttcttatgccttgcatgaatttttttttggttagcttatatgtgatgtagtagatcagccaccaggaagaaatttatcatagtaatttactataatttcattattgtgaatttatatgtttgtcatggtttgctttgtagaatgtgaattcggctaatatgattggtgtaattttagtaagtcacgtatgagttaatattcattggtattagctggtatggtttgtgcaccattagtgtgttcttgcttgttctgattcatggacctcacatggaggaaagcttcgcaagccctgcaactgtaccccctaatgcctttggcccttcttagttaagttaatttttggatggcatctcttattgaaagaaggaaaattggaaatatac

SEQ ID NO: 101752 - DNA, 567 bp, Oryza sativa
ttgtgtttagactaacacatttttttctatgttgtaggaaagacgtcgtcgtcgtcccttaagccaaagtggtagctagccctagtaggaatttgcgcaggcaagtgatgtaattatatatgagtattagagtattaatatatgattattagaattttaatacaagagtattagagttttaatatatgattatttagacttagcatatatgactattagagttttaatatatgaaacttagacttagcatatatgattattagagttttaatatatgattattagagtattaatatatgattattaccaattttaatatatgattattagagtattaatatatgattattagagtattaatatatgattattagagttagcatatatgattattagagtattaatatatgattatttagacttagcatatatgattattagagttttaatattaaaaacttagacttagcatataccgttattacactcagcatatatgattattattagtttcaatataagaatattagagttttaatatatgattaattattagacttagcatat

SEQ ID NO: 101753 - DNA, 533 bp, Oryza sativa
tatagggcgaatccgagctcggtacccatagtcatctgtggtctgaaagaaaaatgttaaaataggtaacaagcttagcaaacttccagaataaaagaaattattgtgtgctaactaagggcacaaactagccgtaaaaccaacatataagtttgaaaagtgagctatactgacattaaaaggtacactcaacaaggaaattggcacatacagtttcagtctaatgccaacatcccgaatgaatgaacagtacaactgccgaatttctgactccattatctcagtaataccatctttcctagatggggaaaatttctccagttcttccctggtgaagtaccaagagtacatgtgctcacatgataatttactcgtctgggattccccatccatcagtatgtttgaaaaaacctgcttaaggaccctccaaaatcttcagtgtagtttcagacagaacttccgaattgcttgtgctgaacagcctgcagaaccatgaaatttatgtatataataaaaatatctacaatatgaat

SEQ ID NO: 101754 - DNA, 503 bp, Oryza sativa
atgcctagaataattaaaatccgtgtgaaagcctccaacaattaaaatgtgcaaagttaaaagtcaaataatacttagaggatttttgtatatttcctaaaagcctaaaatacgtaaataaattttagtggaattttcagagctcaaataataagtgttaagaaataaacaaagttaaaaaggttttataaaaaacaaaaaaccctaaaaagtcccccttccctctcttgggccggcccggcccatctctccccccctctctctctctcctctccccgcggcccatccggcctctccccgcgcgcgcgccgctgacgggcgggcccgcccgccaccatcgctgacgggtggggcccacccgtcatccccttcctcccgccgctcccgccgcctcccccgcgccctagcgccgccgccgccgcgaatcccgccgcctcccgccgtccccgcgtgcaataaagtggggggaattactccccgtgatcccctctccctttcccccc

SEQ ID NO: 101755 - DNA, 556 bp, Oryza sativa
ttcggaaaagagagggaaaaagaaaaagaaaaagaaagaaaaaaaaagagaaaggattttccctggaattaaaatatttcttgctcaattttaattggttaaaattatttctagggctctgaaaattccactaaaaatcctgttagtgaatttcgacatgtagaactcaagaaaattccacatgccaattccgattattatttgcattgatttaaaagggtttactcttgctttgcaccggtattttcttagggtctcttataaattaaattttagacttgggaggagaacttcggggtgtgacaccggccggcgccgtgggtcccacgcgtcagccgcacctaagggcgcgggcggctgacggccgggccccacgcggcagccactctgcgcgcccgagggcggccaagccggcacagccggcgggaggcggcgcccgcgcccctatggtcgccggcggtggccataggcacagcagagcggcggctgagagagggaaagggaagggggaaaagaagaggcggtccacggctcaccctacgtcgacggcgacgac

SEQ ID NO: 101756 - DNA, 676 bp, Oryza sativa
cctgcagcccatagatattgttggtcaaagtagtatctcggagaccatgtcagggtctaaaaaaagcttatattttgagatggatggagtactttatatcagctttgatcctgctagggaaagatacattatttccggttgacaacccattttaagcccatttgtataatcgagacgtataatctcgaactaaaaatagtatttttagtctaggttaaaataaccgggactaaaaatcatctttgagtactggtactaaagatttctttttcactgcatttttttatgaccactctttttttaaagaaaagtttatgtgtaattaaaaaaagagtaaattgtaatttgcaccaggacatataatttacgctaggttgaacatgtactttcacttttcattttgcaccaggacatattgaaataggtttcgctttataccaagttacttcataattaattaaaatcgaagggagatcttataaaatatgattagaattctataaatattcttgaaactagctacacagttattaaaaaaataaaattaaatggaggaaaattacaattggatgagaaatgtagatagcccgtaacattgaatggtgtagagttacaattgattagaaagagatcgttagtgaataagttaattatattttaaaataaattttaaaaa

SEQ ID NO: 101757 - DNA, 632 bp, Oryza sativa
cggaggatgatccactatataggcgaattcgagctcggtacccaaaagaaaggaaggggaggaggagggagatgctcaccgagatgacgatgaccggcacagggaaggacgacgacgaccacggcgatggcggcgccggcccggcaagtgagggggcggccggggagcgtcgtggcccgaggaaggagagagagaggggttaggccgcgcgcggcgaccgaagacagcaaggaaaggccgccagaggcgatagaggtggtggtggctcgggttggcagcggaaccggggctccggtgatggtttggggatctggagtggcggctagtgtgcggggcaacgcggcgaagccgagggtggcggcggatttgcgtggcgatggctgacgcggcgaggagcggtggctcgaggcgacacaggcggtggtggagctcgggtcgacggtggaaacagtcctcatgcgatggaatggacgggtggagtggcggccggggcgtggcacgacgtggcgaacccgaaggtggcatcggcgcggtgcggcagtggctagagtggcggtggcgggcagcttgaggcggttgaaggggcagtggctcggttttatggtggagatggagttccgacgatggaatgg

SEQ ID NO: 101758 - DNA, 733 bp, Oryza sativa
agtaactgatgcttacattttatcattaaataaagaacatacaatgccggagcaacacaattattactaatgtccataggaagaaccaggatcaaacaaggaattggaaagaaaatcatgtagtggtggaagagaagagcatgcacgtaccaccaagaggaggagcctggatgtgggaaggggaggaggtggtcaggtgggtgtgggggtgggggcagaaatggaggggcaaacagaaaaatagactcatcaatggcgcctattgccggttcccaaaaagggaagggtctataggctgcatattgtggccgggaaatggagttttttgttttaaaattatacaaggtccggttttcttccaattttagataattaaaccaccaaaaccttattagatgtgccctccgtgtataaaacggttggattttatataaaaaaaaaagacataaatttttagacacagtatagttgtttttggcaccacatttatatgtgaacggaaaattttgttatgacttatgcacccatacccttacatgaacgagtttaatttacacatgtatctcaaattataggttggttcaaaaaaaacacacccgcgcctgttattttgtgggatagcccatattttaatttcaatttttatataaaaaataaaaaaacctttttggagtgtgtgtactccaatacgaaagggggaatgggttacgcgcttaaaatcctttttattttt

SEQ ID NO: 101759 - DNA, 687 bp, Oryza sativa
ctctttttggtgccttgatgccaaagggggagaaaattgcaatcgaagggggtcaaaattttgtttttgctgcttgctgcctgctctgtctgtttatcggaagttccggatcctcttatccggaagttccgaacatggcagctccctcgctttattgtcatgtcagcttgtccggaagttccgggtatcttatccggaagttccggacctggcaatcctttggcctctactcttaagatcttatggacatgtaataattctctatttgtgtggatgtaatgacagttagatgctcttagctgctctttatttatattgctcttcatttatgctatgagtgtcttatttgttgtttgtgatgtgatgttgattttatccttttgagtgctcaccatgtcgtatcttttgcatatcatatttattcttactgctttttgcatcccacgaatgagtagggatgaaggaaactctcctcggttgctccgttatatatatgcatatgagcttcactcatattttccatatgcatacactaagggggagtttcattcacctctaaccattcaaaacaaaattattatcaatcttttgtaagctttaaccatgttgtcatcaatcaccaaaaagggggagattgaaagtgcattaatccccctagtgggttttggtgattaatgacaaatgtgg

SEQ ID NO: 101760 - DNA, 605 bp, Oryza sativa
caatatgggtcaaatttgatccctacttacaaaaactacaaagaattgaaacagattgtgacacgcgctgtacgcacaccaccctcttctggtcttctcccctgctctgctccaccaccatggagagcggcggcgccggcggcgaaggcgagacggcggggtggcggttcggcgcggcgaacccggcgctggcggtggcggggtcgcagagcatccgcgcggccgtgacacggatttaccgctgcctcgacgggagcggcgacgcgcggcccgtggcgccactcgcccacggcgacccctccgcgttcgcgtgcttccgcgccgcgcccgccgccacggacgccgtcgccgccgctgccgcctccggcaagtacaactactactcccccgccgtaggaatcgccccggcgtgcaggtacgtcgtcgcgtgcaaaagtggatgacagatcatacgtttttcttggatgaaatatcgtgtgaaaaatgtgaatacgcgtggtgaattttggccaaatattcaaatttatatatataaattagcacacactttagcatagggtacattgtacatatatttttacagaatttcaaggccgaactcaatt

SEQ ID NO: 101761 - DNA, 586 bp, Oryza sativa
ttgcatcatcagtgcagcaggggggctcaaccagccggttaggctcataggtatgagggttttgctatttcctgagacctctcattattatcacattttctctagcataaatggacgaatgaaaaaataacgtataatctctggtattgtggtatgtatatcaagggaaaatacatgcatggtggcatgtatatataggaaatggcagtgctgtagttagacctaaagcttcgatatttatatctatacttatactaatcgaacactttctatgagctcccacgttaatccgaaagatctggctagaagaacaacataaccttaatttctcgcttcctcttctactcgatcagacaaatttccagtattggaaatagaccatctaagaaagttcaccaggagatgggaggcatcagaatcaaaagtacagcattacagaaatggggcacaattcttctaactacagtaatgagacacaaaagtattcacattactagtagctttgtggagcgttgcacatcccctttgttatgctgtcaacagtatggcagtgttgcagaacacgctattcggcgggatgtatcat

SEQ ID NO: 101762 - DNA, 558 bp, Oryza sativa
taaagaataaaaagaaattattgtgatgcctctcattaattgagaggtgattgcagtgtgggagggtggttagatataaaattgagtgaaaattaaatgagtagtgattgttgggagaagtagcattttagaagttattatgtttttgtcaaatttcaaatgctataatgtaacaccccaaactgtctgtcgcctatagtagtgggttggtgcaagtacctataagttgcagcagatgtgatttattactatcataaaagttaggtgagtgatagccaggttaacccttttatatgaaacaatgatcataaaaatgtaatatggaatactacgtctatataggctaattcaatgtgtggaaagaactgatgcaaattttaaaggaacggaatgagatgtgtatgtgaatggaattgtgaaatatgtgaataatagatgtgtgaaatatgtgaataatggatgtgtgaattatgcgaatggggatgctggggatgtcgatgtgctgggaatgctggggaatatatatgtttctgtcattttacagcgggtatgactagc

SEQ ID NO: 101763 - DNA, 1184 bp, Oryza sativa
  unsure (1)..(1184): unsure at all n locations
catcacattggatctttgaacatgtgcatggagcattaaatatagactaaaaaacctaattacacagttatgggagaaatcacgagacgaatcttttaatcctaattagtacatatgattagccataagtgctacagtaacctatatgttctaatgacagattaattaggctcaaaagattcgtctcgcggttntcaggcgagttatgaaattagtttttttattcgtatccgaaattccggttaaacatccgatatgacgcttaaaaattttcttttcgcgaactaaacaagcaccaacagacaaggctgattcacgaaaagatatgttttgaccttcactttcttgatttcagcattaaacaaaatattatcatgttaggagggaagcatcaatcgcactctattttgtctcattaatcaaaccgaattcgtactatcaaattttgactcgaagtcaatattggcgacgtgcagaagtcgctgaaggacgggttctgctctggccagttaatttagctcgtaaatttgcattcaaaattcgttaggtacatcgtacaaatatgcaaaattaacacaagctacgactcatgagcagcatcccaagcacaatataatggtacggttcgtcctatcggtatcataatcttttgtcatgtacaatcgcaacacaaagtctctcgataatcccgtacgatgtccgatttggaatatgcccgttccgttgcatcatatgattgatgaccagcagtttaaattttgttttgaatactactatgtgaagtgcctgtttgtagagtcactgtaaaaaaaaaaaaaatcttcggttgctgatactgtgcacacgtgtaaagctcacctttctcaccttgagctccacgccaaatgatctctcttgtaacgcctcctttaatggatatgcttgttcaccttatacaagagaaaaaaattaactctccaataaattattttatagcatattatttaaaatgctttgggtttcacaattcctctcatattttctttagaagcttagctcttgaagaagagatagtgcattctctctccttatcttctctctcttccactcaacaaaagctgatatggagatttattagctagctgactcacctttattggaggaggcataagcagcacaaaattgacataatttagcttatcatg

SEQ ID NO: 101764 - DNA, 634 bp, Oryza sativa
gtcagtaaaagatcactataggcaatgtatctaaagtgacattcttactaatgcaatcctttgtgggtgtgctcatagtgaactaagtgttaaaatggtgccataggctggtctttagggtcacggctacgtcgatgtggaaccaatgtttcagggcattatataagaaagctttggtagatacagtcgatgatgtggaaataagtgatgaacatcgagttaagtagtgtagattattttttagtgtattaataatatataatttattttagtggtactaatacagtttcatttattaaaaatgcacatagcttttaaaacaataacaatagaggagtttatatatgaccacgacaaaatgatttttatttaaatatgagatgtattcttattcttatcatatttagtagtatattaaaatataccatctattttacggtaaatatatttcttttttattgtaagaaaatttacattcccttacagtatatatatatatatatatatatatattgatgtatgatttattttaccattctttttcttgaacaacaaataagatgtcagtgtatctctgcgggctttattttcagtttatattttgaaaatgttttctgatttatattccatcctt

SEQ ID NO: 101765 - DNA, 551 bp, Oryza sativa
tgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatt

SEQ ID NO: 101766 - DNA, 552 bp, Oryza sativa
  unsure (1)..(552): unsure at all n locations
aatgtaccccaatactctacttatccggtctacgagtatcactcgtcgacagatttaaatttagaattaaaacaaaattaaattcaaaattagactagaaaaaatgcccatgcgttggaacgggtaaacaaaaattatgatgcgcaaggaatgatagacagatgagtgtgatggctggcattnaaggggtttaggtttttcatgnnatatgagcncctttaagaaaatatattctgaaataaagaaagaaagttctaaaaaaagaaaagaaaaatcgaaaggaaaaaaaaggccttgtcggacccccgccggcttgctagggtattcacgcacatagcccatgaagcgcgcgcggcccagcaatgctgcggtccaagggattttggactatttgccactttcccggatggcgtgttctcaaatgccactcttccaaagaactttgctttttttaccattggagagagatgatttctttctcattggccatttttgagctggtgaggcgctacgtcaccagatatgagggcaaaatgaccattttgcctttct

SEQ ID NO: 101767 - DNA, 579 bp, Oryza sativa
acaacttatcatcttaatgactttcttagatttaatgcatgactcttcattcttccacaccagattggttgcatgagcatcgagaaatgtaaatattaatgaatcgcttgtttacgaggaattactagtagcatatttaaatggatgataagtagaatcacttatccttggtctgtgtgtcaagatgaagtatgactatcaaaagtagatggagggagtatttagtataatttgctttgccatgcttagacactttagtgtcatttatgtgggaataattaatgcttccctcatgattaatgatgattaattagtgatatctcgtgacgattggtagtgctgattggtagtgcttggtttattaacttgacaaataaaattttactaatggtgagttgtgagcacatagtgtgttggacgtcctcatgacaactaaggactagtttacgagctagtgttgtgaagcattaaccatattaaccacgagcaagaataggcaacgacttagatctgtagtataatatgaccaacgacagatgccacggtatgttgtgtttttatcgtggcagacaactaagt

SEQ ID NO: 101768 - DNA, 532 bp, Oryza sativa
ccccggccggtcctggacggggaatttaatgcacattctgcttggaattctattcgggaatttctgggcgcgataagttggtatcagagccgaccttgaccgtaggacaagccaaatggaaaaacctaagagctctctgaatccttttcattgcatatgttctttgcaattggatttgttccgggaaaattgggatctgttcttgtggttcaaggggaaaaatcttggtcgctcgtttaagtgagatttgtcaaaacaagtcagtctagggtttgatgggtgaaatgcattaggccctagcttaggaacatgggttgcaaggtatttatgctcttattgttattattagtatgtatctaatttccccaatattttaccggtatgtgagtctgtcttatttattcgctctcatgcaaaatgatctatgcataaaatttcgctcttatttcgattctcttatctgagtcttttattgctttatttaaatttggatttgagcatgcattgatcctactcctttgtcttctctaga

SEQ ID NO: 101769 - DNA, 598 bp, Oryza sativa
ctagcctagagtgcattttgtatagcgaggtttcagtgagatatgaatactgataagaagctcttttctacaatatggttcaatataggcattacctgtgcatgagaagaagtcattacctgtgcattgcaattataaaagaggtggaaaaacataagagatatacatattatcttcaaatatctatacaatttctagatcttttccatttggaactggaaaaactcacctaatgctttccttccagccttccaggagttttgccatagataactttacaagtaaatataagcgggacaaggtgatttagccccgtttataaggtactaatatagtccgaagtttgattgtgagcagaaaggtgtaacctgtattttcagtttagagattaatttaatttgctctcttattgtagaatggaacagtttgtagcaaataataattgtgaactcactgacaatttaagtatttccagggcaaattgccgaatggatctgaaattgcaaccaaaggctttcagcatgctctggacaagaactactggaatgcaatagcgaaatataacttttagtaaatattcagctgcatcgaaggagga

SEQ ID NO: 101770 - DNA, 549 bp, Oryza sativa
cggcacgggcaggtcgaccccgccggcagcgtcgaggaagccgcaccgcggctgtcacactgcctgtacgacctgatcgtgctcgacattgcgctgcccggacgcaacggcctggaatggctgcacgaactgcgcagcgaaggctacggcggcgacgtgatcctgatcaccgcctacgccaatctcgataccgcgatcgacgcgctgcgcggcggcgcctcggatttcctgctcaagcccttctcggtggcgcagatgctcaacgcggtcgaacgctgtttcgaacgctcgcggctgcgccgcgaaaatttcgtgctgcgccgcgaggtcgaggaacagtccaccgccgtcgagggcgtgatctgccagcggaagcgatgcagggcgtctgcgaccgcctgaagcgggtcgccccctcctcggcgacggtcttgctgaccggtgaatccggcaccggcaaggaagtcgccgcccgcgccctgcacaagatgagccggcgagccgaaggacctttcgtgccgctcaactgcgcggcgatctcgtccgaac

SEQ ID NO: 101771 - DNA, 554 bp, Oryza sativa
aaatgatttcaaatggaaatatggtcaacagcaaagttgatcctctcatcaagatctacaacttttattttggttacttcttcatccgacaaagtgatagttatattattcacaaaaatcacatttctctcatctggtttataaatattaacacagatatgtcaattttgtaaacattggtactatcactttgtcggatgaagaagtgactaaaataaaagttgtagatcttgattagctgtacaagttagctatttatggctttcccatttaaagtcatgtaatatttacaaatgctgtttagatttgtcatattgtcaaaatcaatttcaagctgttggaaacaaagttatatagacaaatgaccaaaataaaagttgtacatcttgataacctctacaattttgttgttgaccatatttcgatttgaaatcatttactatccgaaaatatgttatgactaataaaatgaattattatacaacagctatatattctgtactcaaaaatataaggacttatctgggaaatagaaaaatagtcatggctgcaga

SEQ ID NO: 101772 - DNA, 2504 bp, Oryza sativa
aagcattggcacctgcaaattcctttaaatttcctttaatgaaatgggctactctgttattcggtaggatttttatggatgaaaataacaagtgatcccatatcctatgttttcattgatgtaccttgaatttataattacttcaaatatgccatccaagtttaatccaaaacattgtgtgtttctaagttctattgtggtttaatggacaatgacattcagtttctgtatttatctatttcctgtacattttttgaagttagaatcatgtgttacaacaaagacctttgtactgatccggtaaatatctggaagagaagctaacaaaaaaaattaactcgacacaacaaaacgtccagctcatcaaatctccattaatgatttcagattctattgaacatcctcaacaacctgcaatcaatatagtaagacagaaattcataaatttgcacgtgggatttttttttcttcagtcaactcgaacagttcaactgtattatctcggtcgaatatattgctgtataaaataatatgcaactacctacaattaattaggaaccacgcatatttttctctatgcacgcaattttgcacatataggcacgttttttgcacggattttttcctttttcagaccaagttttataccaggtctaatcgaatgatactgtcactgttctcttcttgaaaagggacatgacattttttgtcttgctcaaatgtaatgctgtttcgtttgactagtcatttccttacacaaaacctagccacgtgcgtgggaaattcggtacaaatttatagtcccctttctcaatagcaattcatagacttaaaaatatgtattacgaaagtatatacgactaaatgagtgaagattgtaattgactgagtagagaaataagtgaagaaattaaatgggagatggttattttcttagagaaggatatttttttacccaatctttacattcaatcggatgtatatagcttttttaaattaggaacttagcccctcaaataactcaatctaaaattcgctcttatgaaaatggttgttattggttgaggcataagaataggtaaaaaaaaagctgctatattctagacagagtttgaataattgttgtagttgaaaggccaagggaattttattatagtgttcacttccaaagaaggcacaagtgagtgaaacagccaacaaatcatgagataagcatggaagattttgaagcgcctgaaaatgagatatgaccgtatttctctgcctttgagtacgcgtcagctgatcgtgtatcccactaataagttagtcacctacctaattgcatccctgcatgcttgatcatgatgggctgattacagctagcgataagtttatcttttgatccttttagattatttctgtgggactatgctctctgattaagctatccagatagctgcgatgccgcagggatatgataattatctaaatacagttgagatgtttgcagaaaataaagtggcacgtccatgaaaactcaacgaccaccatttatttcctaagcacactgggcatgcatcagtgacagcgagtcactcccacggtcccaccgccggccatcaccattgccttggtgacgttttctaatgattcatatgtttatttttcttctttggggaaactaaaataaagttattactaaagagttagttcgcttaattctataaattacaagatatctttttagtatttgattgtcatgtcgcacggcacgtttgccaacatgtctactccatccgtttcatattataagactttctagcattgtccacattcatatagatgttagtgaatcgagatacatatatatatatatatatttagattcattaccatatatataaatgtagacaatgctagaaagtcttataatatgaaacagaggaagtattttttcctttcaatgtcccctttagaaatgcttttttgggggtatttttttaaggaaagtacctagatctattaaacaaattgattttgtttggaactagtgttttatattgatcgatttggcgtcgtagcaatgatatagttttcaaaataaaattgtctaacctaatacatgttatgttaatgccttccagctagagcgattcctaatacttgatgttttcataggaggagcaagatactatgtgtagtgaggctattttttgaattgatagtaagaggttttctaatttctctttgaatagaagctatgtgttttctactgggtatttcagttgaatattattaggagggagatggggatttatccaaagtccttttattcatcatttgaattctctggttatgtgactgttggaagaggatggagatgtgcaaaatttgtattattataaaaataaaaattataaatataagttacaatctagacaacctaacgagatcataaaatgtaatgtataagtgaactcatgcatgtcactggtggagaaaccatctttcgtcggtcggcc

SEQ ID NO: 101773 - DNA, 618 bp, Oryza sativa
atctgtgacgggccctacggcaaagcccgatgagatagataatctctatcggccgtaaactaaagcccgtcaccaatgactcattttccatctttcatttgttgtgggtgcaaaatatatagcagctgtgtaataattcattttattagtcactaatacattttcggatagtaaaagatttcaaatggaaatatggtcaacaacaaagttgtagagcctttcaagatctactatttttattttggtcattattctatataatttttttcccaatagcttgaaattgatttcgacaatatgacaaatctaattacagcatttgtaaatactaaatgattgtcaaattgaaatatggtcaacaacaaagttgatcatctcatcaagatctacaactttcattttggtcatttgtaataaaacaaacaaaaccatattaatgactacatatatcaagtctttgcaataaaacaaaatactccattcattacaatagataagtataaatgcatcagtcataaggttatgccttcggtatgatctgaacgagcatatgccacagactcttggggatcatagtcaaggtcaatgtgaggtcttacatgaagattagggttgttt

SEQ ID NO: 101774 - DNA, 651 bp, Oryza sativa
ttctcagccaattaagccacactatggtagcagtatacatatagttagttgaaaatttatatttataactattaaatttaaatttttgaaactcatgttaactatattttacttttagaaaagatactataggtcaaccatattacaaggaagcgatggtctacgatatgtatttgttaatttatatgtaagtatgtaacaacttgtgtgaatctaaaccaactaaaaagaggactaacttgatggtacaaataaaacatgtttactaacaataatagtgctttaggatttgttaaaaaaagccactaaacattcaattaaacaagacaaaatattttacttttaatttacgtttaatttgttagatatgttttttccaaacaaactaaatagatactttgaaacatgacaaatgtttatacggatcatagataattgtttatacgaatgaattaaatattatatattttaaaagctaacaaatagtttggaaaaattatctaagcaatgccgatgaagtaaaattatggagaaatagtacttatgaaacatggcaatgtcattgagttgatattcgatctatgtaagtttttcgaacacaataaaatacatgcccgcgcaatgcatgggctaccttcctagttcatatta

SEQ ID NO: 101775 - DNA, 510 bp, Oryza sativa
ttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacatgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccga

SEQ ID NO: 101776 - DNA, 590 bp, Oryza sativa
taaatagcctgcatagggccatataaaataagttccaagcaaacacaaagagcactgacactgatcacagttcgacagtactgaaaaacaaaaagatcatgttttgagcaaagaaacattattcattcctaatcatccatgtttggctgggaaagcttcttcctttttttctccccataaactttattcagccacatcctcaggattcaggccacataggtccacccccatcttttgcaacaaagataaagaacaatcagaacgggaagaatctgagtttatatcatcttccagagcattgaaatcagattcagtaattttgctgccagggataaggattttttatataccttgccaacttcttcagcctttaagccgattttcccctttgtttgccaattcccattccgatgatcaaatttgagctcttggttggcattaagaagcctagagctctaccttctagtaggattgtataggatagtcttccatctttttttttcacaggagccataggaatctgaagcactactagggtgacttctggacttgatggctgggcttgcaaaggtgcaacatctaaaatctcc

SEQ ID NO: 101777 - DNA, 841 bp, Oryza sativa
  unsure (1)..(841): unsure at all n locations
tcctcgtctgcatgcgatatctttgattggctcatanccntttctcntgttcgctcatatagattgactccattactccgtttaaaagttctctcccatcccccccnccccgggggcngtgagtaaacaatatcaataannnnnnnnnnnnnnnnnnnnnnntgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaaaattaagcttgattcaacatcatacgtgttgacgttctacctaaaggatagagttctgaatgcatggagtgctgagatcctcgggtggaggtaccttcaacacctagtcgatactaggggtgataaaaggatctatgtgccaaacttggatttgttgaaggctggtaagggtagaagacagacatgacgcttaagaaatgatatggatgcattcgaagcgggaaggcctgtgaagcgatgtgaggactgtcttcagtacgggcaccgcactaaagattggaagaataacatggagggtacatcttaaacatgggacctaagcaacaacgtgccaggagg

SEQ ID NO: 101778 - DNA, 683 bp, Oryza sativa
tgtaattagctgatcgctctcgcgcgcggggagagccatatcgctcgcggtctcgctctttcaaagagcgagaccgaaggcgtcgctgtcgcactgccgtctcccaggattagcagatgaattaggggacgtgggccacgccgcaacggtatcgcggttggaaagagcgatatcgctggcgctctcattgacacgtaccgcgagactgactcgctctcgctatcgcgtagcgcgagaccgctcctgtcattcctcgggccccacatgtgtcagtcagcacacgccgctacggtctcgcgcagcccgactgtgataccgcacgcgctatcgcgcccttgaagagcgagaccgcttcgtgccccacgtacgtcaggcggcgtcggacggaccacggtatcgctttacaaaagcgcgagatcgcctcgctctcgtgctttcggagcgcgataccgatgcattagtgctccctcactccaaattagtgatagcgccaccgttttcgcgcacgcattacgcgatgccggtatatttccacaaatccgcccctaatcagcttattcttgcaattccattcaagaaaacgattactttcaaaaaattttctgggtgggaagttgtcagctagggactaatgtcagctcatgcccagagtttttccatttaggcccttgtttatatccact

SEQ ID NO: 101779 - DNA, 745 bp, Oryza sativa
  unsure (1)..(745): unsure at all n locations
atggcnaggtgagatcccactactatannnnnnnnnnnnnnnnnnnnnnntgaaaaccccttccgggccatttgcaaaaatcttttttagtagtgggcgagctcgccttttgctcggctgcatgctatggggagaaagcgaaggggtatgaaaatgaggatatggttactattgcacacaaatcctaaattaaatctagttgtccaaaatttgcttgatattaggtgggattttctgtcataaattggatagccactccctaaaaagtgcatagcttaaggtctaaggagtggcaaatagcaacggcactagttttctgcaccatcaaatggaggcagtggaagagaaagccatgcatgcatggcatcggtgaaaagaactaaaaattccttatgtgcacataagttcttgcgccccctacacgcccttgaatttttaatttattttgatctccactgttaatcactcccctctcgtatataagatctatcttttcatacaaacataataatgaagaacgaaggtgaaattttctgttataaaaaattgaaaaggacaaatgtgtttgatagaacaacatttaaaattttcaaataaattgcaatgacatttcaaaagggggaattgcaactatattttattcttcttctccttagaaacaaatttaaatatgtttttaatacacatcaaacaaaattcaagatattttcatggaaagagagaaaggtgaaattgcctctaaaat

SEQ ID NO: 101780 - DNA, 863 bp, Oryza sativa
  unsure (1)..(863): unsure at all n locations
cccccgtggattcattgacgtattgctgtgtctgttctacgtttgatctctcgaatctttcatgttttgntgatctttanattcttctggaccaatgtntctttcatncnnatcccccccnccccaagtggcnnngatgagatacatttctaaggccaannncagctgggacccaaaaattatggggtctcatacagaaaaatcatttgtgtagtagtgagatcattgagctcactcgcgacatcgaggcatcgacccagctattcatctgggccatcaaggaggccaagccaccaccgccgccgccggtgtcaagggagagtggctcgatggcaagggatatgaggagcacatcacggataggggtctcctggtgcgtggtgggcgccataggtgagcatccttgtgacatcctggaacaattaggatgaggtctgtgtggcccataaaaactgtgtgcatgtttaatatcatcttgctagttttgcaagagtggaaccaacttataaggacttctactccaaacatatcactcccaggttaacacttttacatgaagcgagcacgaaagtttaagtggagtggtgtgtgtaagtgggccggtccgtccaacggcctggctacacggttttggaacgtgggttgttagcggttgcgcgtacgggtcagtatgcgggcatatggcgcatggcgcatgtgggtctatgcgaggcacattttttgttcttggacatttgcctatatgattgtgtcgctatgtgggtgagttggaccgatgaggacatcgggtcctttcagggaggtgtatgtgacatcctggcccaattaggatgagggatggtgtgggccattacagtttgtcg

SEQ ID NO: 101781 - DNA, 1263 bp, Oryza sativa
atgtcatatcaattaactcatgtgtaatgtgttgcgatttaaaaaagccacttctgcatggttgtagcttttgtgatcttatatgcaaagagaaaggtaaaatgaaaatatcaaccttgctcacattattcatgtttgtgttgattctttttctaagtgtattttaatttgatctttgtttcaggctataggaaacaccgtacctcttatgaacagttatgctacagaagtcctttttgggaatttgggttcaatcacacttggaattaatatagaaatttattttgctataaaatatgaacattgcggccacaaagagtgttaattttcttccagttgattaaaggaaattctccatgaacccaagtttaaccactttgttcctttgctatagggtacagttctttaatttatcaggtgaaaccccgcgcattgttgcgggaattagtatgataacaataaaaaaataacgtgtaagatagctaaataacatcagattaagtaaattaatatgatttatgataatttaaatttaaatagtatgcagaatggtgattcaaacgtaaaaagtaaggtgatatgactttatggaagaagaaaagtagggagatagtttggaccgtagattaatcatctaaattctaaaaacaattgatgtgatatgacttaattagaggaaaaactaaaaaatataattcgaaccatagattaatcatttaagcaattactaagtgaggatgagctatataagtatatatgatatcataaaacataatgaagatatacattggaacattatgtgaattatgttagatgataatttaacatgtttgtatttgaaaagctcttaaattataaaaactataaagatatagcatgtttgcttgatgtttaaatgtgatgaagatatagcatgtttgcttgatgtttaaatgtgatgattgttagtggatgatgatgtgccatcttgttagtggatgatgatgtgacatctttgcatgttaagcttaaggagttagtgggggataactttatagtaagataggattagtgtatagtgaatgatactgtgtaaatgtttcatctttacatgagctaatttgtgtgtgtttttaaatgcatgcagcgtcttgtctcttcttgtacaatggtgaccacaaggttatatctatactaatataaaaaggaagagttgtacctctccaatcctactggtgaaatcacccggatcaatctctaccgtccatccgccatctgatctaa

SEQ ID NO: 101782 - DNA, 660 bp, Oryza sativa
  unsure (1)..(660): unsure at all n locations
atttctacacgaaagttgttaaaaaaacatattaatctatttttttaaaaaaatagcaaataattaattaatcatacaataataggtgctttgttttgcgtgccggggaggaggaagnacttcttcttcttcccaacacagcctaagagtttttattgtatcaactcttgtaaaaactataattgctaaatgctagagtaagaatgtacctttggccatgtattaagggtgtcggtggccaaaacgtctatttgaaaaaaggtgaaagtctcagggagcctaaagatccttaggatcccaaacgagcaccttacgcccgttcttgtagccgaatccgtcgtcacatgcaataatggccgcattagaacttttgcgtatcggcacaactacctgccttttgctggctaacttccttatataacaaaatgggaatttcaatgaaaattaaaaccacttggccccgcttcttacgctgggagttcatttcgttcattcccacagctggtaaacgtgcgtgacgctttccgtgcccgatgtgcgctttttaatctaatttttgcacccttcaaatcgaaaaccaattgcgcacaatttccgcgaaggttagtgcgaacttaactcaatcaattgccgcgattaaattgagtaccttaattaacg

SEQ ID NO: 101783 - DNA, 739 bp, Oryza sativa
  unsure (1)..(739): unsure at all n locations
tgctgggctttttgatcacgattcatataggccgaattcgagctcggtacccccaccgacgccgccgcggccatcgccgtcgccgaccgcatggtcgcgctcggcacgcacaacggcaccctccacatcctcgacttccagggtaatcaggtatcgtacccacctctttcccttcacgcatagctcgtagggcggtcgcttgctttgtgggattgggatttctggtaggataccgtggaattggatcgtctcgtctctgcgacctgtagcattggtctactgaattcgatttggttgtagaaaactgttaacctattgtttgtggaagagacgtcacaaaggtgaaattctgtttggggacacctgaaatatagattttgcagagaatatatattttaaggattgtgctagactgaggaatatggttcagtgtaaaatgttttcacgttgttggaggggattacctctggtgacctaaaaaatctaggaggactaggattgtctgctaaatatcggatataaccaagctgaggtggctgtgcatttaacaacattgacacagaaatttcaataaatggagattgcccatagcttccttcggcctgaaatcatgtgatggagcactatcagtaatgaccatggcctgcttagaaaataacattgtcatccattaattcaatacttttgcaggtaaaggaaattgctgctcacacagcaactatcaacgacatcangtttg

SEQ ID NO: 101784 - DNA, 689 bp, Oryza sativa
agtgttggccggtcagaccgccgagtgagggccagtcagaccggcggtgtgtggccggtcagacaggcagaatctgagtccgggtctgttttcgtcggatctcgggtttccttgctcgggaaggcatatttcaagtttcctttggattctatcctgagttggacatggaggagggcctgtagaggacaagaccaacccctatataagggacatgaccggttcaattgtaactatccaatctacaatcaatcaatcgaatcgtttttcatattgattttagttttctcttagtttatccatctttgtcgatttgcgccgtaaatcgtccgccgccgttgcgagagtgcgacacctcttcgtatgtttgtcctgaaaacctttcgttttgcccacgagacgggtagttatctagaatcggctccactagccggtttagttatcaaaacccatcttggtttagcttttgctagattgaggtggttggcgactctaggatcatgcaaggcattaggtgctacgatcgtgcttatcaacttgtcaaaaaagttgccaacaatgtctaattaaatgggccaatgaggaagaggtacgatagattgggggaaaaacagctatacacatatgacatataccagatcagggatgcgttatccaccagcaaatataaaactcggctacgtgtcaatggg

SEQ ID NO: 101785 - DNA, 689 bp, Oryza sativa
attttgaagcattattctgcatatccgcgtgattttgaagcattattctgcatatccgcctgatatgtttgaaagtccacgtgctacgtctacatgttgaaccttactatagtctatattggcaataaagtactccattggtttttttttttctaaaaaagacaattaagtaccaaagggcatacagatatctcttttgaatttcatccagaaatagtgtttgggcacacaattatctcttttgaatgtaggaatagaaaactttggattaggataaacatagtaacgcacatgattaaaaaatacaggaaaaatacgacatgtcttcctaagcaagcatacagccttatcttttcgcttatacttatcaagaaaaaaaaataaattttcaatcttaaatttggagttgattttgaagtttttttcgtcgaagtttatttttcagcttttacttttaaatcactaaaaacaagtatgaaaaatttttactcacaaattatttttcgattgcaaacatgccatttggcttatttccttaataggtgtttaaacgatcatttagagccacatgcatcgatttacattggacttttctcaaatagaaaaaaaaagttttgctaaaaaagagagagagagaaatgaaatgaaaagaggtccttaactatgctctgggatactattgaccttca

SEQ ID NO: 101786 - DNA, 540 bp, Oryza sativa
atatctctcattaaatgatatgtggtgaataaaaatattgttgggagtaagaccggacagaagttctaatgattgtagctaacatataaatttataaaaaatgttggtcaaagctaaaaagttaataagtataactaaaacgacgatgaatttaaaaggagaaagtacacaattaatataactacacatacagatggataagtcaccccaaattaacgtggtctttgaataaacgactgtcgcctattctttttcacgaattagctcaaaccattccctggatcaacttaattattggacatgctattaatcaaccactatctatgactcggctaattggtgcatttcggcattcatggtacatctaatttaaaaatgcatgttttttatgggagaaatttttactgcactttaggaaatttgtagtacaccgaattttacatttaaaaaaatatctccactacctaaagtattaaattttatcataaaaaaatatggtacctttgaatatattctcaagatagtaaaattactcttttt

SEQ ID NO: 101787 - DNA, 652 bp, Oryza sativa
cggtgagcatcctgaaggctagaaaacctcatgcatgcatcgttcggaatcgatttccatgcacaaatgagctttcaccccaaaaccacccgctgttaacactggccatgggagttactctgatgtcttctgaccaaaaaacctataggaatggaatcgcaagaacatgctcttcattttatcttttaaccccaactccaaccgagccaccaatcgccgccggtgaacccgggatcgagctcagccatggctgctctgcctctgtgcgtgtgaaaaaggagtcagggacttcagtttgagaatttaaataactataaggttcattacgtaatgttcccaatcaatgacatatggacctaggactgcgggttgatttcctgaaaatcctaggggcctttttgcatattggcctgatactgacaggtggaccccatgagtttaaaatctgaaaatgtaaaaagataatactaaaagctttatattttcaacaggaaaacatgtaaacttataaaatccataaaaaattgaaaacaactcattttagagtaaatcaaatttctgtgaactcaccaaatcaagaactttagagttattgcataaaactagacattcactgtacaaactttgtctctaaaattggtctaagataaat

SEQ ID NO: 101788 - DNA, 602 bp, Oryza sativa
gtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtcaggttcttcgttccataaagcctacgagattgggtcgaaggttctttgtttgtccaaatattcttgacgacaatttcatggtaagaatattttgattatcatgattccttattttctcacaacatttactaactttgttcgcttcacatctattctttcccccccggaaccaccaaggagatgtcaatagagagaacggatagacacccagagggttctaactccacctagccgtgctgtgcagcttggactaccagagcaatacagggatactaaagcgtg

SEQ ID NO: 101789 - DNA, 607 bp, Oryza sativa
aattgctgtagcttctctgacaactccagctgtggagttgtttctgggcattgctaatatatgttttagtctgaaggaaaattctatgagcatcctgctgatgtttctggacgatgtaacattcctgaaaggagctgttcctgttattcgtgtgcttgtcattgctttaatcaagtaccataaattgccattgctttaattcgtgtgttctttcagttcataggtcatgatatacataacagaattggaactttaaaattattttgaatgattagtttatcaaataccattgtttgcaacaagtgttttcagataactaattttaactttaaaaactattttgaacgactggtctatcaaaccgaaagttaaaatatggagtaccacatgttgctagtgtttacagagactatagtggtcactcaagggtaacaaaacaattacagatgtcatagtttctattggtttgtttcggatcaagctttcaggctataatattcaagaggttgctcctttgaattcttacaaaattcatcagcactgtctttcaacatcaagggaatggaatggtgtaaaattgctaagcacgattccttcaacaatgatg

SEQ ID NO: 101790 - DNA, 2114 bp, Oryza sativa
gttcaaagttcaagagaacatagatttatcagccgggaaaggaaataaagagcaaaaataggcttgttattaattagttgcttccaaaaataccattttattatggaccatgcatgcccattatgtacttcatgcatcgcaaaatctatttcgagaggcatctcgatttagacttaacgagcgacacggacagttacgtgggaagtactagtagcgttacagacatgcatgcaagtagtttttgctattaggttgtgcatatttttttcttcttatgaaattttctcttaaattacttatccgatctataatccgattacaccgttgtggtcgtaaccattaaatctttacaacaagatctcacatgattatattttgatgaaaaatcacaaattacttttatgatatatctaaattacttttagatttcactaagttactttttagacatacaaaagtaaattcagtaaagcctaaaagtaatttacatatattatagaagtaacttagaacaaaatgaatgtaactttggcatgtcatttgaagtaaatccgttgtagagataaaaacatgactctatctagaaattaaattaatcagcacaaattatggaattaactaaaaacaataataaaactaatcacctaaattaatcagcacaaattatggaattaactaaaaacaataataaaactaatcacctcatagcattatgaatgtataggaagtattttaatcaaatcaaaaagtaacttatatatatgataattatatatatgataacttgttcaatgaaaaaaggtattaattaaagttactttctttttttataagttacttctatagtatatgtaaattacttttaagctttactgaatttacttttgtatatctaagaagtaacttagtaaaatctaaaagtaatttagacatatcataaaagtaatttgtgatttttcatcaaaatataatcatgtgagatcttgttgtaaagatttaattattacgaacacaacgatataatcggatcgtagattagataagtagtttaagagaaaattgtatttgaaacataggtggatggtgtctcttatagatggagtggaaaccagctaccactagctgtgtagtctcgtccttcatgcatgtttgcacaatcctgtgacttgcacaacaatataatgtctcacgtaaattaggaacaaatatattaccattgtgtaataatatttccatgtttacaaattacaagatcatagtcgtggccaagttttaagtcagcaacatatgcatacatgcatacggtcacccccaatgtcacatacgtctccatcttgtactcatagtacatacgtagacgcaggctgtggtgggcagggtcgccggcgtggcttcccgcgccgccgtgcgagcggcggccggcgacgagctctcgtgaccgtcaccggtgggatcacggtgacggacttgctggtggcgatgacggaggaggtggccgtggcgcccctcccgccggcggaggcgccggccatcagccacacggcggcggcgttgagcggcaaggccgtcttcgtcggcgccgtcgtggtcggatgccacatcgctcacgcggtcgagcggcgccgctactggcgtcgccatcgtgacagcgacggtgtgtacgcggcggcgcggtcgctcgccgccggcgacgtggcggcgtggcttcgcgcgtgggaggcggacaggattaacccacgcgactaacagagattattacaagtaatggtttatacttacatcagtacctatgttactaagcattgaagtaagatagaaggcgatgtccttttcttttcccaaatttcaaattagagtatagttgttttcattcattttcctctcagagaaaaagggacaaaacatcacagttatttcatctgaacaggcaacattaacatgataaatgtacatgtttgtacatacgagtaagctccaacaaggactttgtcaggtacacagattgttctgatctatgtgtggctttcatcaatttataaatgtagtaagggtgtactttgcagctgcttgtattatgtcctaagcatatcttggggaaacagactgcaggaatt

SEQ ID NO: 101791 - DNA, 589 bp, Oryza sativa
cgctaatcggcaactaggaagcaggctagagattgatattctaagcacgacttaatagatcaaactcaactgatgcagcattaagtatgaaaagaagaacaatatctagacaatcaagctgctagatgtttcatagagtggtagatactttatacaatccaagctaatattgctatttaacctaatcggccgccttctaccaacagatgttagccgattgtaggttagatgacgatattaccaaagattatacaagatatatgataacttggcgagttacataaacaagattagagtgtcataaagatggaagcactaatcccgagaatacaagccgccataacaagttttacctcttgttgaagatcgaaactgacgcaactcaactcgaaagcaagaacccatcgaaacaaaacaaaagtaaaagggtggcgatacgccgaaattgtatcgaacgtgtgttattttattacatggggctcggggtctatttatacccgagaattacaagatatgtctataccggacacgactattatctctaacaaactccaagatacgataagtctttgtggcagacttttgccca

SEQ ID NO: 101792 - DNA, 834 bp, Oryza sativa
cggtcgcaccaggttggaatttttatttgtttttttcctcctcatcatcggcccctttttttttttttttttctttctcacccttcacttcttctcccctcctgtgggctccaattggattattagttttaaacagatggatcaagtactactactaccactttttaggtgaattcttattttaaatacatatatcagaagaagggaggggaaactgaagaatctcactctgctcttctttctttctttctctaattaaggtatctccaattaattcttgcttgaaatatggatggatggatggatctagtggcacggctatttattacagatggttcaagtaagactgggattatgggtggaaagggatcataggatatggttcaacttgaattgttttttctttttaaggatggtttaattactgccattttaattcttcggatttctagatggcaccaatggcttgaaccgtgcatttggaatggcacgttatcaatcacatggtagtaagttttaaaatgagtacatagtttatccaaatactctcaacttagcaaacggtttattgccgacaaaatacatttgcttgtatcctagttaggaggataattcgtgcaagaaatattcaattgtttctcgtagcagtttaatacgtgtgaacttttcgttattgtgcagatttgaacacggtaacaaaaaaagggggagaaaaagcatgcacgatcatcttaagttacggaactacctttggattgttatgaaacatttgtgtgaagttttgacacaagggcattagaaaacaacaagcattatttagtccactaaatccta

SEQ ID NO: 101793 - DNA, 529 bp, Oryza sativa
agtgaataccatatatttaaataaccaaacaagtgatactacacatatttgataaaaacgtattttatctataacatattataatatattttcttttacccatagcaaaacatggtcattttgctagtattttagaactttgactatgtgtcatctatggctctaaaaatcatcttgaattacaacttatataaatataaagaaaaaggagaaatattgttaggtagtactccctccattccaaatttatctacatatttcataggtacaccaagaccaagaaaagctaataactctctcatactatatttactctagcaacaaactcaatgcatgcaccatccccaatattttctagccaatagcaaatcaagatattgcatgtgggttataaatacttgtgtgcatagatgcatgcatcaatgtccatttactccaatgcacaaataacgaatagactctatgagcaattacaatcaagaacataagcttaattagggatgttgttcttacttttgcatgtacataa

SEQ ID NO: 101794 - DNA, 729 bp, Oryza sativa
  unsure (1)..(729): unsure at all n locations
tgggcccttgaattccatcatatannnnnnnnnnnnnnnnnnnnnnnaatgggaatgatctgtttgagattgatggtacacttggcatctacttctgtaatgatgatgcgacgatcgtagatatttgggtactgcaggattacaagacagaattctggtctctcaagcaccggattgaattgccagtcccagatataaaggggaagcttgatgatggtgatgattggagtgcgatggtattgtctgaggacggggatgtgcttgtgctggtttactacagacaatggctgctttacattggtactgatggcaagctgttggcgagttttcaacatgatgttgggtgccactacaatactcctctgaagcttaagcaaagccttgttccacatgcattctttccattgttaaagggttatgtcgtgaatgctcgacctttcatctgatgctggagcggctttgctagttgttggactcgtcttgagatggtttcttttcatcctggtgggtagcaacttttggtgctgtcttttagaggttgtggacactgttatcttgtgggatgtcaccttgctaaaatgtactcaaaccctgctgaactatgtaatatgcagtagctggtttgccaatctttttcacaaaaagagaaaaaattctgatgtctgttggataaggtggagcttcctgttaacatttgtttccgattccctgagtgcttttctattttat

SEQ ID NO: 101795 - DNA, 739 bp, Oryza sativa
  unsure (1)..(739): unsure at all n locations
ctgcggcagttgagatccgatnactatannnnnnnnnnnnnnnnnnnnnnnttaagcttgaggacatttcaacctgataggctcatgtcaaaccaaccgttgaaacaaatccgaaattaagtgattaccagctagagtgacagctaaaagcaagctcaacattgcaatggggaaattgcgattagggaaatcttgcccgtgattgcaatttcggaacaaaattttcaaaattttgccccctctccaccggcaagcatatatctcacccgaaatttctccttttttcatgtttttgtgaatttggtcaaagcttattctaaatcattcaaaattcatcaatttttcaaataaattcagtgattttggttctttcgccccctccccccacggaaaaaaccccaatttctagaatgcaaaccctgaatattgcagtaaaactgcagtgaaatacttggtgcacaaatgtcattacgggtggcaccgcttcaggttttttttttcttttgcaaaaaatttgagagcattacatcacctgtggcagttgtagattgatgcatccttccgctgcttgtactcatggttctgttgaaccttagcttgctactgcttacaattgagcaaagcgtacctcatccgagcttgctatcttctttaactcgagagcacttaaattagtggtattccctacggtgtttgccagtaaattagaattagttaactcaaacagtacatgatatat

SEQ ID NO: 101796 - DNA, 737 bp, Oryza sativa
  unsure (1)..(737): unsure at all n locations
gtggcncggtgagtatcccactcacttannnnnnnnnnnnnnnnnnnnnnnatattacaactttcactttccaccatactcattgtgcatttatttaaaactccagatcgatatgattgcgatatgaacctgggacctgttccctcaatcaattcgtatgtggatttctggttgaaggtttcagcattttcatgaaaattgtaagaaaccgagtagcaaaaaatgctcttgtctggttacatttgaagaagcagtggttaggacctctttttgttggataatcacattccaatgtgcctttgcatgaatttggtgaaagtttttaaagtacttcacttgcggcgctttggtccaagtctaatgttgtatttcagcttttgctgtagtgcctatgaagtgggatgcatgtcaatttacttcattgacagttacctatataatcaaacccacaatctgcccttctatgtctagagtacctacacacatgcatcccctgttctttgaatttctttagaaccaaagggaagagcctgagtttcaagttttcttatcgaaaaccagaagccacagctgcttatcaacaggttatctcaaatgcaaagttccaaggctgacagctcatttagaacaaactgaaaacccaagtagcaaattccttaccaatgtctctacttacaatagaagcccagtcgtcctccttcccatccctcactcattgcacacagcgcaacatccct

SEQ ID NO: 101797 - DNA, 1082 bp, Oryza sativa
  unsure (1)..(1082): unsure at all n locations
gtgggaggtggttcccctactatannnnnnnnnnnnnnnnnnnnnnnnaagggccaatattttggggaatggtccaagggagcattcgttctggtgacatagggtgagaaaggacatcgtattccgcgcgcacgcttcccaaactaaacagtacgttttttgcaaaaaaatttctataggaaagttgttttaaaaaatcatattaatctatttttaaaatttaaaatagttaatacgtaattaattatatgctaatggctcacctcgttttgcttatcttactaatcttcttattctcctcctcctcaaactcaccctaaggtcaaactcaccctaaggatgctatgtgtgggttggatacaccctgctctgctgtagccttgaagtggtgtgttgcaaataaatgtaagcagcgagcaaacatttatactccactctctatagggctattgtctccatatattcctagatagtacgcatgttgccacagaatgttagcgtgtaacgtgcagtataaaattacatgagaaacaactattcttgtaggtagagaaactatggtaatctgaactgttaaaatgccatcatgtcaaaaataataagttatgatgtaatttctagtgatggattctaaagtaatagttcaaatgcgttgttctttttagattacttcagattatatgttttctaaaaagttttttttcaactatattgcttattataccactacttttaatctatttaaagttttttcaaagaatatttagtttatccttacaatcaattgggaagatagtatgtgacaataattattacctgattatatttctatacgatttggaaaacatatctttaagctattttaagttattttaaaaaatatttaatttatccctataatcaagtagataatctgagccaacaattgaaattatcgattgggattatacaaaagataaagtctaggtgcacctaaactcttaccaacaccacatattatattgtgagtacatgtagatttttatatatttaaattaaacggttgagattattgttcggaagagttttataaagaaaaactt

SEQ ID NO: 101798 - DNA, 1729 bp, Oryza sativa
aaaatgtaaaaatgctgccaccgtggacggccacgtaagcaggttagtccggtcaaaggtgttttggatctaaatgattcacttatacaagatcgtggatcctaataatgattttcctagatcatggacctaaatgacaccccgttccaactttaagtactgacggtgtactttactcttttcctttttctccattgaaatatatgcatggctaaacgtaccatactcccctcccccccccccgggtctctctcccccctttggagcagcggtagatatgtaagtacacgttatttcttctttttttttaacataaaactttacaagtctcgtgcaatatatatacaaatattttatctattttcaaatggttgtcatcatatatacgtgtcttgtacgcttgaaactttgataactctattttaaaatatagttatacttaaaattcaattttatctcaaactatttacggctgtaaaagattaattttcttttctgttactttcctatcctacccctatcaacctatatcacaccctccgtttgaaaccgtttaagatgaaaatgtttaacttgattttcattagcacgtttttcaaactttaaacggtttattttgtgcaaaaattttctatatagaagtttctttaaaatatcaaataaatctattttaagtttaaaataattaaaactcaatcttacgtgcatgtacttaattttgatattcatcaatttcaatcaatctcacaatatttatataaaaattataaaaatattctatcataaaatatgttgcaccacaagtactacaaattaaatgcagtcaacttttttttgttgtaatctaaccattttaaagctattgatggttaaaattgaaaacataataggctgcctaattaataagccaaagccaaaaccaaaatttaaattttcaaacttaattttgaagttaattttaacatattttcaacacaattttttatattaacttttaagttgctaagtgttgaatagtcccacattggttgtggaagggcaagggacctacttcttcattcccaaattgatcatcatgtaatagaatccaaaatttctcaaattgatcgtcatataactgcatagacaccgaattcattggaatacaattaatactgtatgggagaatgtgtgcatgctagggtgtaattggtattgggttttaatcgatgcatgcattgtgggagaatgtgtgcatggtgtcttggttgatgtgatttaaattatccttggtcttggtgcataaacttatgatgatcaatttgggagtgaggaagtaatagtatataagtgagggagcccctcacctcattggctaacttttagggtgggaaatgctctttatgatcctacactaagaatatactccctccatactggtaaaaaatgacgtttaggacaaaatttagcataccaaaaagtgattaattatgggtattttttcctgtctgcccctattaaatacggttgcgcgtagaattcgatacgagaaacacactttactcaagtggctagtgcgccgaggctggattccgcaggacccaggtacgaatcctggtgggggcaagctggttgcttggttttgcatggcactgttttgggcggggttagatacttggttggctgcatggcgctcgtgcaggggcgtttaggcgcgttttttgtttcgcttttttagtttgggttcact

SEQ ID NO: 101799 - DNA, 592 bp, Oryza sativa
gatagtaaaaagggagaacactgcatgcatgtcatgcggtatgcacatgccaagatagcagagacattgggcggagatagcccccattcgatctagaagcaaagcaagtatgctcgaaagaaatcaacatagatatacattattttataggatgagactaccgatcgggcgccccatccaagcgtgaaaaaatcggacgctaacgtcagcataacgtcagagccatgcatgcgtgcaaaaccactttaacttcttttttttcttaaattattatccaaatcatgatcggattacaccattaaattcgtggcaattaaatattcaaaccaagaccacacatggatatattcggacgaaatttttttagttaatattcaaatcgggggttatttcccttaatataaaaccaatattttagcaaaaagggaagaatgtttcagttccctgtaccattagatttatacaatagtgaaccattgtgagtacacttggtggaacattttttgtggaccaaaaaaccaaattcccttaatagagaattttcaaaatatgtgggtgatttgttgcaaaagaagttttgtttactgcaaca

SEQ ID NO: 101800 - DNA, 979 bp, Oryza sativa
aatctggttgggatcctcgtatggcattttcaggttccacccagtctccccattagggttaaaaaaaggatatgccaaaggatcataacaaccatggtatgctttgatataattgggcttatcacctttggcacgtaccaagacatgtctatctaaggttctcactggatcatccccctctaacctgatagtagcaacctgcgaggccgtgggggcattatatcttcgttggtcaggtgttacattggtgttgagctcaatcatgtagtcatctaaattaggcatggatccgactcttttgaaggtttgtacgtatgggttcttggccaaaatacctagaatgactcggacaaggttgatatcaaggtcaggagacctccaaaccctatgagccagtgcatcagcatcttctgtatcataaaagtaaagctgcatatggcgaggaccttgagatcctggaaccaaattttccaggcgatggtacaacgcaccgtgtacatgaaatgtatacacaccagtacccgctgcagtgctgactcgttggtcaagggtctctccaaggctcgtgaatgagaaatgagagttgaagtactgtatgtgctttctgaaatactttgcatcattatgcacctgactggtaaacaaccatattaactcgtcaggcactacaggaatcttaacatttatctttccctccctacaacagaacccaggagactcaaattgaaaccttatcgcatggctgtgtttgcaatcaggcactttttttaagagatggtgtgtcttcgacagtttatggtacacacgatcgtgtggatcatcagtaccaatcccgttaacgccactaacaccaacacgatatgactcgtatccatcgtcctccaaaacttgactggcttcatcaaaatcattgtccgcaccttgttcgtcctcaacacgacctgtggaatgatggttcattatgcatatgctcaaaatt

SEQ ID NO: 101801 - DNA, 843 bp, Oryza sativa
tgatgggaatggaaaaaaaagaggggatatgggttgttatatttcttgtttgtttggtggcatgtgaaacagtaggatcttgatagcggaatgtttagtctgaatgtgtgatccctctgaatctctttgttgagggcaccttggtgctaaggggaactatgaatcatacaagttccattccacacagaaaagagattggaactaaagtgaaacttctgtgcacaatcccaccatccaattcatacatatataatttcttgcttgacctgttgcaaaacatctttatgagcgatcaccatttgctaagtgaacaatgagggttggcaagtattgatggcttgcccttattattgttggctatttttctggtccactttgtgcaatttggccatgcaagaccatagcaactggttagttactgcaactagtgattcttctaatcctactcaagaagagggaaatgccccaataccctgccctagctttgactgtgagttcattcaaactattttgtacggtggttttgcctgcatggcatgttgaccaccagaccactaactaaataaaaaaagtaaagcaggactagagaggctgcaacgggaatgaccaatcaataagcaaagatgaagcataggcctgtccatctgtgtgcctgctgtaattttcttatttggttggtggtcgattttattgcacggtcatgtgtacaggaagaacctaattgggtctcagtccttttgactggtttgattttcttactataccaagtagagcttcagataaacaaatccatcatattttttgtttgtttgatgcagtgtgttaatattcttttttttttat

SEQ ID NO: 101802 - DNA, 612 bp, Oryza sativa
agttaatatcgaggtcgagtacggacatcgggttgagctgcctcgcacattcctcctcctcgtcgtcgtcgacgtcgcagccagcagcaatgtcgccggcgccggcgtggcgcagccggcggaagctctggcgggcgccgcaggagaagcagccggcgaggagagccctcctgacggcggcgccacagaagacggcggcgcccaagccccccaatgcgcggctcttgttgctgacggcggcgcggcggtggcagaaggcgagcaggcggcgcctgcatgcgtcggcgagggaagctccgccggcgaggaggaagggctcctgctgctcctggagcaggtccgagagcctcctgacgtagcagctctcgcccatgaattctctctctctcactctctcaatctgaagaagaagcagaattatatattctgtgtgaagaagaatcaggaatcaggatgaaaatggtggggtgtggatggcgacgggtgcgtatataaagctaagctcgacatggagacctctcttcgtcttcttgactgtctcgttggaagcaaaaggaggcagcagcagctccaaacaactgcattaggctgggcctcacaagtgttatgtgg

SEQ ID NO: 101803 - DNA, 566 bp, Oryza sativa
cgggactaaagatcaacataagctttactcccggttggagttaccaaccgggactaaagatgtatttttagtcccggttggtaataccaaccgggagtaaagattcccatgctatccccgcctttaagtccccttttttttctctcctctttaagtctctcggtatccgcctccagcgcctcctcgatatcctcttcctcccctggcccttccccttcctccttcccctctctgctccccctttctatccccgcctcctcctcctccttcccctctctactgcggccgggcggcggcgacggaacgaggtggcggcgacggagcgaggcgactgcgcggcggcggctggtggggccgcggctgtgcggcggcggtggagcgaggcggccgcgcggcggcggcggagcgaagcggccgcgcggcaggcggccgtgcgacggcggccgatggggccgcggccggcggccggcaacagcggcagtcaacattgtttttttatttgtgattcactgtgatgtacttttgtatggacaatattgtgattcattgtacatttgtatggatct

SEQ ID NO: 101804 - DNA, 636 bp, Oryza sativa
aagcttgatggtcctgggaaagtgtcaactgaattatccctagtcaatctagaagctaaaaatttgcatcctaaacctgagtgcaaccaacctattgtgagtccccatttatcagtaacaatgtactctaaatttttaccatttgaaatttccatatgctcttaaattttcatgcatttcccaatctctttcctactgccgatcctatatatggtggttcagaaaaggaaaccaaactctaatatagttttatattatattgcttgataaatgtctcgcatattcgattggcacaaacaatttatatcacactgatttcttcccctaacaccttaggtccagttccggttgtgaacttgcacaaaacatctagtgtctactgcattcacatcgattttgaataatatttaattggcaccaacaattttatctcacatattgcttttccccttgacacctcaggtcaagagttcgggttgtgcacttgcacaaaaaacttctagcaagtgttttattaaaaaactttatatatataaattttctatgagatcttttaaaaaaagtaaaattatctatcagagaacttttacaatttcactagagaatataaattttcatatccgcctggagaattaa

SEQ ID NO: 101805 - DNA, 502 bp, Oryza sativa
caatgtactctaaatttttaccatttgaaatttccatatgctcttaaattttcatgcatttcccaatctctttcctactgccgatcctatatatgtggttcagaaaaggaaaccaaactctaatatagttttatattatattgcttgataaatgtctcgcatattcgattgcacaaccaatttatatcacactgatttcttcccctaacaccttaggtccagttccggttgtgaacttgcacaaaacatctagtgtctactgcattcacatcgattttgaataatatttaattggcaccaccaattttatctcacatattgcttttccccttgacacctcaggtcaagagttcgggttgtgcacttgcacaaaaaacttctagcaagtgtttcattaaaaaactttatatatataaattttctatgagatcttttaaaaaaagtaaaattatctatcagagaacttttaccatttcactagagaatataaattttcatatcc

SEQ ID NO: 101806 - DNA, 1043 bp, Oryza sativa
gggctttgggcgttgctgtcactgacgaaggacattctctctggcgtgctgaaggagtgttggactctgatactaatcttcggctgggctgggtatacgacatattgtcgacaccaccgatgaattataggtcccgatcgatagagatgaaaataacaagattggcaagctgcatttggtgacttctgcatcactactatatattgctcttcttcaaatgcatgtctctcaatagtatgtcaattgtttgggttgttgtacatgtgctatatatgtaaccgtgtgcttacgtttcttgtaaacagtatatgtagtcgttaatattttaccaataataggcaaagtatgtgattgtgttcgtcgacaaacatatactcgacgagccttagcgctgggttggacacgtgcccttcactctgcccatgacgatcaggacatttaattatttccactcttaagatgtgccaattaatgatttgccactcgctgtctacgacatgtgggcccttatgtgtctatgacacgtgggtccagtggcaaatcctttagaaccactagtaagagtggcaaatagttaattattccgtgacgatcgagcagggacatgggcggaaaggaagtgaaaaagggaatttgagaggatctgcttgctttggacaaaaaggtattttaccatctcttgagagttatcaggtaagaggtaccaaatttagaccgttgatatgtcataatcggacaactgagaaagagttggtacctgttggtagcgcactaccgcctctcaatctgcgtggtacctgccgccccccccaattgctaaaattgtattttcggtctcagtggttctggagtccatcctctcggagggccatatgtggtctttagctggtgttgccgcttctggggatttcttgggagtgtagcgtggctctgccccttcccgctttttggagttgtgtttagctggcggaatagttttttactagtttcaatttttgtttgctttttctcccttcccctggcataagccgatctggctgact

SEQ ID NO: 101807 - DNA, 565 bp, Oryza sativa
acataacaaattaaactgaaaatagttagtgtacattgtcagttatacttgttatttttgttacagctcgtagaaatcggatttgaggttacatgtttatagggtgatatattccatattaatctattttgctaattgttttttcagtttatagtatcatgcaagaaacgagagataacttttagattaggttcaataatatttatttgagtggattgcacattaggctacatatatttacctaagttttaatgggccatcctctaacgtgtaggaaaatttccagctaattaggggttaatataatataattcaaatttaaattgttaagtcaaaccgggttttggaagttggaataaccttggtagcaccaggatcttgcatgttgagaacaatccctgctcccgtagttcacggtgtagtgatgtcatactcgctagtcgctactacttgcgaaacaagatatcagggaaaattattaatttcatgagttgttttcacaatcaagtcaatattagagaagtttaaaattcataggttaaggtcaattttgccctacaacttt

SEQ ID NO: 101808 - DNA, 649 bp, Oryza sativa
aactcatgaataacaactcttagtttttataaaatagaacttggctgcatgagaataaaatataaaataatagtaataaaaaactttttaattaatgattagagtatttattatttcaaaaatttaagggaatagtctctaaataaaatgtgtattgtctaattaatattctgtatcaggctttacctttagacaagacatattatagagatgcatttgatactgcagtagcaaggggtgttgttttcaatcttaaagtctcgtgttcaatccacaatatattcacaatttcttcttaatttttttgtgagacgtctctccctccaaatctttttttacttgcaattatagctgtatcattaattcctcatgaatggttaaaatacgtgaaatttaagacacaatatactttggatggggtcatatcgttttaattcttcgtaacattttcaaaataaaacaagagatcaaagtttgacaatgagaacgaatagtttcgctatcgattatttttttaagggggcagggagatatgggatatctgtcaatcagaagcgaagatattctggcatacgtcattagtgttcgactaacccaacatgacagcagtacaacacttatcaactggcccgaccgcaatgacttggcg

SEQ ID NO: 101809 - DNA, 578 bp, Oryza sativa
tatggtacagcacggagcttaaaacgcaatttattcaccatagtacatggcctacaataatttcgacttatataaaaatgtcattatatatctaaatatcattcaacgaaaggtcattatctaaaaaagatctttcaacgaaaaatggagtaaaaaaatttagacggaatatggagtaaaaaaagtacactaggaaagttaattacaaaaccatattggtgttaattagaatataatctctctctgtcccaaaataagtgtagttttacattattcatgtgtaatatttgaccattaatcttatttaaaattttttattagtattatttttggtggtggtagatgataaaacatgaatggtactttatgtgattaattttttttatttttttaataagacggacgatcaaatgttggacatggatacccacgcctacatttttttaaggatgaatgtagtaactattatataattaccatataagtacattgtacctttaatataaggcaagaataacaatcaacacgtcttggtgctcagttgtaagccttctcttggaacacactttacttttttt

SEQ ID NO: 101810 - DNA, 1162 bp, Oryza sativa
acggacacacatttgaagtattaaacatatactaataactaaacaaattacaaattccacctgtaaactgtgagatgaatctattaagtctaattaatccgtcattagcaaatatttactgtagcaccatattatcaaatcatgacgtaattaggctcaaaagattcgtctcgcgatttacatgcaaactgtgcaattgatttttttcgtccatatttaatgctccatgcatatgtccgaacatttgatgtgacagaaaagtaataagtttgaagaaaaaagtttgaatataaacacggcctatattttaggttggagggagtataaaagattttgattggatgtgatacatcctactacacgaacaaacaaattcccttatatttagagacggagggagtaagatgtcttagcacagttttcgaaactaatttatgatttgtagtttcctaaagtttgtaacaacaaaattataatcatataaaagtaaattaaaatatcaattcaatgatattattttcagcaaataaaatttagtttatactgtacaaattgttagttagtagtaaatgttttaggagttaaatcttaaaatacgtgcacacctgtattataggatggagagtatcaatcaacgttgcctactctacttatacgtcgatcattattcagttaatcactttaaatggttaatgcaatggcagtggaagctgcaatctttttaactttgcagatactatactttccttacggataatgcagctattaatgacactataaaggagaaaaaactttgaggaaaaaccaggccaacctttgattagtcgaatgcaagcaaatattcctcagaccatgatgcaggttacgtggatcataggagaagttaatcgattagccgataaactagtaaaagatgctagaatgcagcaactaagttctccagtttataactgtcaaaaaaaatcctagcaattgttgttacgctagagctttgaaagaccattttagtgcaaccaactgtacggtaaataatgtagtagttctatgtttctgaaacggaaataaagtttttgagttatcaaaaatactcctaagggcctgtttggcacagttctaaccaaacagtttcaactccactaaaactgggagtggagctgggtgg

SEQ ID NO: 101811 - DNA, 503 bp, Oryza sativa
aaatgtgttttatattttgtaacgaatatttggatatgtaaaacatcttaaatgaaaaagttgttaactacaaagttgcagatctcctggagatctacaattttgatataaagttttatttcatctaactttatataatataattttaaattgtaaaatcatagagctaacaagttgtgctggaaaatttgcatttaggtcccttgctgccctctggaagggcgatctcccaaagggcggcaggcgattagatttgtaaatttttgaaacaaaaaaatatttttgtaaatattttaataaaaaaatgtataaattaaaaaattcgtaagatgagcgcaatacaattgggccctaacaggcttttaactcacgtgcggcccataagtagttgggcccgaatgggtgcgcgattcatgcgaggcccggttactcaacttacctttccgaactggggaagtttgttccgaggatgtgctcaacaaccggcggatccgacgtgtata

SEQ ID NO: 101812 - DNA, 516 bp, Oryza sativa
atgttagactgttagagctgaatcgattgcaacatgagcaaaatactactccctccattgttttttttccctgaagtttgtttttttagggtggacggccgaatacatagctacgaggttgggttcttttacgacggaggtagtagatctatcaaaatttaaaaccgggtgtatacgaaaattactcatatatgtttacatgtaataagattttattaaggctaagttgccgctgttatccgttattttaattatgtgtttagaagcatatgtatgtgtagtgatatgtgtacgtttgcttctttcatgtaatcgaaaaacagttgtatgtagcatttgggacgattgtatcctaattttctacctttttcaaggaaaataatatatactcccttcgtttcatattataagttgcctgattttttttctagtcaaactttgttaagtttgacctaatttatagaaaaatttaatggcatctaaaatactaaattagtttcattaaatctaacgttt

SEQ ID NO: 101813 - DNA, 606 bp, Oryza sativa
atatggagagcttgccatcgttttcgcagtactggctgtgatctaatttacaattattgctcaagctacaattggtgtttgctctttgctttcgttaacctgctgccccatttgcaagttgtttgttgtatattttctgtaaaaccaatcatgtgcgtcatcagcatataattaacaacgcacataatatgaatagatcgattcgtctacgtattgctgcatctttgtgtactttgaaaaagaatctagctagctgagatgtacgtacgtatggaaaaggattccgttgttatattaattccacgctttcgttttctcaactgtaaagcttgtcaatgcatgtcagcgtcagttgtttttcccttagactactgtaggatcgaacacaaaaaaccaaacttaccagaggggggtgaaaggggggtgaatggtaggaaaaaccaaaaacccaaaaacttttagcggaaataaaagttaccctcaaattgaaaatctcgatgtagtcctgtcgccgccgccggtcggacagctcacacgccgccggaacccaaagaaacacaaatcgaagaactctcaaagtagatgacaactttattgcttctctct

SEQ ID NO: 101814 - DNA, 500 bp, Oryza sativa
cgtagaattgaggcacatcacaggaggcccatagaccccaaaaaaccgcgtggactccgtagaggatgaaaatccatcatttgctttgacctggcagctgaggcaaatattctaactatttgactattgtccggtgagaaacggtaagtggagggtgcccctgatcaatcttcctctgtccatttttttgcttttgcgttaaattgttgatgatccaaccacttacgatatatatttgctagcttcaaaggcagtgcttgtcgaacttaattgtcaattacgtacgttgccaatcaatttgtttgtacctttcaagaataaaaaaattgttgactgaccttgccggccgcttgaggatatataagtcgtccaatcaccatgggacgtgtagataaaatactttttcgaaagtcaaacagctaaaaacccaacatactaatcatagaactcgtcctagtttttgaaaggtcaaactgtactatttttccaaataaaaaaac

SEQ ID NO: 101815 - DNA, 586 bp, Oryza sativa
gtacattacggtttataatcagatcttacctgatcaagatcatcatgcttaatatcgttataaaactaaatgcaaaaccgggtgctgagttgcctgcggcttaccacgttgcgacgacatgaatgaaaagagaaaaacatgaggctacaattaatggatttcggacgtcagaggaatctcccacaagttagcatagcaagccagctgataggactaaatatatagttaattcgttaaatttatagtcgtctcaaataaaaaaaaaggttgatcttatgttgacctttcaaagtcaacaattatataagcactaaatttttatcattcatgtattatgtagtatatgttttaagaatatttcactaaaaatatacatttttaagtgtatacttaccgattttttaaggaggtaccataattttcttgttaattttatatatatattaccttgtgatacaataataccacgtaggtagtgaaaggtattaaaatttacgctaaggctatgtttggttaatccccaagagggagggattggaggacatttattccacacctattgtggtgtggaattattccccctcaa

SEQ ID NO: 101816 - DNA, 680 bp, Oryza sativa
attcttgttttgatgatggcttgaatgatggtaatcttaacagatagagaatggctcacttaatgatcaaaataactaaaaactataggacttatgtgattaaaactgagaaactaaaagatgagaatgaaggaatggcgctagaaattgataggcttcgctccatgatttttcatgtgatttatatctttctgaaatcaacctccttaaggataatttaaattcatattatatatgagttgggaatccctctagtgctatcactgcatgctctttttgctatgaatggaagatggaaggataagtttgagttcatcaatagtaattatgaacatgataggatatatagttgtgaaaactgtcctatactcatcagtgaaaatggtgaattaagacaacaaattggcatggtcaaaatcatgaataacttgctagaatcttctgcttctaaggaaccaattcaatgctcatgttcaaattgtgccattctgaaaacagaactaaaagatgctaaaattgccaccgactcttttaaagcttttgattcatgtgcatcttgcatttctcttaggattgatctcgattatgctaaaagagagtttgccaagtgtgaggaatcccttgtgaacctaaaatgagagaactcctatctacaacagtccttagagaggcttgcttaa

SEQ ID NO: 101817 - DNA, 590 bp, Oryza sativa
tctgtgcaccagaaatcatctactatacaccatgttttaaaaacgtcaaataagaaaaaaaaggcaacatttgtcaggcctgagcactcatcagtgagcactcatagcacacacgagcacatacgtccatttctacagttgatcctctaccccatgccaagtgctaacaccggagccatctctctgaatctcacctgcttacatgtctaaccctatataaaccacccatactctctacccggctactcaagcaccaaccaaaaccaaagcagagaagacgcaagaacaactagctgcatggcaatggcggtagagagcataggaggaggaaggcagcggcagacgcaacagcaaggtgcttggacctgctcgtagagcctctgctgatggaggggtcacatgacaaagacgaggatgtggtaatggtgctacaatccccccttcccctcattgaattttagaactcacagaatagccgcgaaacatccatttaatctctctcttaaaaatatcgaaggagccaagactaccaaagtccagattcatcatatgggtggcaattggccccattggccatgatctactactac

SEQ ID NO: 101818 - DNA, 1405 bp, Oryza sativa
gtcaagagagtcaaattgcaccggttttaagagttcaggggtcgagatatccggttttttggtttagggttacggattagattttgatcacttttgagggtcacaaagtgaacttattcctccaatatacgttttaacctcccactccaaaccaaaagtctattttgtctccttcgaccgaattcctatttgtaccaaagcgtaagaaagtctagccgacctccctcaacaccctctcagcccaaggaatattctttactaaatataaattcttttcccaatatccagaaaatacttctatcttcaaaaagtcatatattcaaaaccgtagctccgattgaccctgtttcagtctccaattcttccttaaattgatatctacaaaatggatctattatttattaatagtatctcctttttagggttttgtgtggttctctctcttttgcgatttgtacttgtcgccagaaattgttttgatcttggaccttcaaggatctgaagacgaagacttgagggaagtcaccctttgatcgtattgctctcagatctgaaactgttttggttgcaaaatcgcataactgagcgtgcacgatagtttgaccggcctcagttcacgcggacaaatcgatagaactacccaatagttgcattatactcatatattgttgttaaccctcatcctttgccgcttcatcctcgtggtacctcggtaaccgtgctctctgagtatggattccgatggtcggcaaaactttcccccccccaattgaacaacgtgttcgtcgatatggtaaaaaagggtttgcgaaaccttttaaaacccaacacgtacttttggtgtgtttgcgaaataaaagtttgcaaaaacccgcgatgcaaaatgatcacatgtgtggtggtgctttgtattcgcaaataaggaccgattcgttgaagaattgcactgatcataaatcataatatagtgcgaccacatgggtgttacggaacacccctagccaagtaattagtggatctaggttcgttttggttgctaataggagaggagtcgttatggcgcgaagtgagcgatatacccacgaccatggttgcacgaaatgttccggctcccggctttgaagactggaaacctcatgtgttttcctgtaccaatcccaggattaatagttggtacacacatttattgccagtacaaaacatatatcaatatgaatttaggataaaggagtttaatacctttacaaggaccaataaggtcttatcctatcaaataaacaatagcggaaaccaacatagtagtaggcacaagtaacttatccacaagcagttgactagggttgcacttgctacttagttctcgatcagccctccgatcatctgctaagtatgccagcatatgctg

SEQ ID NO: 101819 - DNA, 692 bp, Oryza sativa
ggttggaattaggaaagaagaaggtgatatcgatgatataaaaacaagccatttaattaatttggatggtagatctggaaggaatgtgtgcctcttgatcgttagaggagatggtcatgtatttatttatcgaggtgagtgtgtgtatgtatatatgagtatgtgtgttatattggattttccaaataagagagaattgcaaggacaattttgaaggggtaaaacctagattatctctaatttcttcatatcactgtgtattatgtcttttcaaatgaattttataggattttgaaagccctaatattttgtaggatttgaatcctacaaaatttcttcatgaatctctttccttttgagaaaaacaatgcctaacggccggtgaaaccagagactaagttgccctttggtgttgaaaaagtacagagggaatagctaaagaataaaagaagctgcaagtgatgtacggcatacaaagcgcatgggctctttcattgcatcacatcgtaggctaactagacaggtaacgcaaacggttcaataaaaagttgaaaagagaggatacttaacttgctccagtgcaacaaacgaagcggcataatcttgattgaaacaatcttttgatcccataatcttgcccggagagaacgaacacaagaccataggccaatgcaaattaaatacacgaaagg

SEQ ID NO: 101820 - DNA, 739 bp, Oryza sativa
tgatgctacttggagatctttgcctgcttgccctctgcctcttcagtttggtccattttgcgcttagtaccactcaaagtcatagtctcctcagcggaaccaacctctactaccatgtcatcatcgccacctgtattcgagtaaagcccattttgcagcacaggattagagctggatattgattgaggaagctgccacatttgcatcatttcagatggtgtgtgtacaattggaacattccgttgcatctgttcaggtggaagatatgccatctgtgcaacaggattatgccattgcatctgttcatggggaggaaatgttggcattggtgcagcgggatggcgccattgcatctgttcacggggaagaaacggcattggtgcaggggattggcggcattgcatctgttcatggggatgaaatggcatatgtactggggtaggatggcgccactgtatctgttcatgaggaaaaaccggcaccatctgtggagtaccaggatggcgccactgcatctgttcaagaggagcaaatggcgcatgcagcatatagtgatggtggggagcacaagggatgttattactagcaggtggggtgaaaattactgcaggatgggcacttgtctgctggcttgactgctctccttgtattgttgttcctgttggtttgtttgacctaatactctccaacatgtggttgcttctagtaactgcaataatatctactgttgagtttgtga

SEQ ID NO: 101821 - DNA, 709 bp, Oryza sativa
agggtgacatagacaaatctcagacattcatttttggattcacggtagtttctaggtttgcaccacatattttcatgtattattatatatgtacctaaaagttggaatattcattatatatgctttatttgcttgattacagacatgacagaaaggctgttgagatggaagaacgatctttctgaagaaagggataaatacgggagtacacctcttcactttgctgcatcagtggaatcgtcactacacaatcgattcagttccaaagcaattgtctccaaagttcttgaagcttgtccttcttcagcatttcaaccagacaatgaagagtccctaccaatccatgtcgctgcatctgcaggtgtccggagcgccatagcaatcttgatagaaaaatggccaggttgtgcctcatttcgtgactctgatggaagaacattccttcacattgctgtcgagaagcagaggaatgatattgttaggtttgcttgcaaaaaagtagttctttcatctgtgttgaacatgcaggacaaagaaggcaacactgcactgcacctagctgtccagcttgggaacctgagtttagtctgctctttgctaggtaacaagcgggtactcttaaatctgacaaataaggttgggcaaactccactgaatgtagcaagaagaaaaattcctacagggatttggggatcctctagagtcgacc

SEQ ID NO: 101822 - DNA, 578 bp, Oryza sativa
aaacagctaatccggctagcaaacccgatttagagatcaaaatcagcttctagcccgaattagatcgatatgagggataactacccgtctcgtgggcaaaacggaaggttttcaggacaaacttacaaagaggtgtcgcactctcgcaccggcggtggatgggttacggcgcaaaccgacaaagatggactaacttaaggtaaaatagaaaacatagtaaaagaacgattcaaatatattgtatttggaggttttacaatgaaccggtcttgtcccttaatagaggtgggtcttgccctctacaggtccttctccatgtccaactcgggatagaaactaaaggaaacacgaaacatgccttcccgagcaagaaaacccgagacccgacgaaaacagactcgaactcggaccctaccggtctgaccgcccacacacctgcggtcagaccggtcctactagccggtcagaccgcccacgtacctgtggtttgaccggccctatgaaggaagcccggcactttccaaactttagcaatttttccctatttcgtccataggtgccaaatttgggtgtaaaca

SEQ ID NO: 101823 - DNA, 948 bp, Oryza sativa
tataaatttatttttgtgaatttaaatatatacagattaatgtgttaatttaataatatatgaaatatttttagagacatggacaagcaatggatgtatcatacgccaagatatatgccgtcatatatgaatgaagtatctaaataatattgacaagacgcacgctttccaataagaatataacaaagatacattgtccataggatgactacaagaatgaaaagtatgggcacatacaacgagaatcatgggacactagtgaaatttatgaatacctattattgcgagcaaggtacaccacaaaaaactgaacaacaagtggatcttgatgacaataaagaaaatcgaagggatgttgatcatatggacgctaatgatggtaatagttgtggtgataatatttttggttttccaaaaatgctacgccatatagaacctgaggtgctaattgggtccgctaggggtttagataattttgaagccttataaaaggcaaggcagcgaaggaatttttgtacgctgagtcaaaggggtgtgatagagagttctaaacattacgttcaatgcttgaacttacgagattaaaggtcaggtatggttggtctcacagttatttgttagcttactagagcttttgaaaaggcaaaatttactacatgacactcaaaaaatatgtaattggctgagagatattgtaaaaatgtgacacggctgatggatactacacaaattatgtaattagctataggacaccagagacaatattttataatttatggatcaaaagaggtgagaaatttttcaaaatggcgaaattgcccctggcaccatcttcctctcacggctcgcccatccacgacaggttcccaacagcacctccgccggcggagagtcgttgtcctcatcatcgcggcgctggcgcctgcgcgacctcgtcggcgtcggcgt

SEQ ID NO: 101824 - DNA, 912 bp, Oryza sativa
tgggacggcatggcaaagcttattcaaaaataaaatttattttttttggggattatactcatctgtgacaggaattaacttaggcccgattgagatgactcatctgtgacgggctatagttaatgcccatctttgacgggctatagtttaggcccgattgagatagcaaaaataaaatttattttttttgggattatactcatatgtgacgggcattaacttatgcccgattgagatgactcatctgtgatgggcattaacttaggcccgattgaaatgactcatccgtgacgggctatagttaatgcccgttacagataagggtcatctgtgacgggctatagtttatgcctgattgagatagcaaaaataaaatttatttttttttcggattatactcatctgtgacgggcattaacttaggcccgattgagatgacttatctgtgacgggcattaacttacgcccgattgagatgactcactgtgacgggctatagttaatgcccatcacaaataagagtcatctgtgacgggctatagtttaggcccgattgagatatgtcatccgtgacgggctatagtttgacatgtcgtctgggcaaaactattggtgacgggctttaattagggcccgattgagataggtttattcgtgacggccatttgcccgattgagataatttttcacatcagtgacttctagcctgtgacagacgctgtgcccgattgaaatgggggtttgccgcccgattgagatgatggtatccgtgttctagtggctttgagctctcaagctacagatcttggtggcacgtctttttgagctcccatccgtacactagattgaactgtcctacgtgatagtgaaatgagattaattaggtggtttatcctatgataatgattgcaa

SEQ ID NO: 101825 - DNA, 2861 bp, Oryza sativa
agctcggattggcctgtgaaggtgcggctcagtggtggattgggggtgggaaacgacggacggggtgcggcgtggagcggcagcgctgtgggaggcagcagcacggccagaggtggcctgtctcgccggcggggagcagctggagacggaggaaagagcccgtggctcggcctcacggtgggaatggctttgcgggggtcgaaggggaggatggagtggatgccgaggtggagcttggcatggcggtggcagcgcagcgcgacggcggccctagcggagggaagtagcgactggagaactccggcgacggcggagggagtgagcgatgcgggggaatggtttctaggcgcggggagctcgaggaaaggggaaaagggacgaggtgaggtgcggtgatcattttaaagcactcgaggagggaaaccgtggccgggagtggcggaatcgggtggcaatggccgacgaggtgggttccggcgatgtgggtgagtggggctcaaaacggcgccgaaaattggggaaaagattggggagaggtggacaaggtggacggaaaccgatcccacgtggtttgggcgcgagggcgcgagcaggaggggtcggaatcagggtgacgtggggcggcaatggcggcttggcgcagttggggtaggtggaggaaggggatggacctaatgggtgggatcgtgggtcccacctatcggccaaaggagagaggagtggcccgtggagggaagcagagaggacttgcgggagagggaggggagcgagctgggccgtgcggctgaaagaggagaggggaggaggcggccgggccgggaaggggaaggggaggcttgggccgagcacaagagggaggggaggggattttaatttgttttctttttatttaaattgattaaatgaactttgtattattataattactttttgagctccgaaaattcacgggaaaatttcaaagaatctttagggcacaaagaatattacaaaatattctcggccatgatttttacgggaaaacttttaattccctctataatttcacttgattaaattgctttaaattttaatataatttctggaaatgcattattaattgttttttaatcccgaacaaaaattggggcgttacagcctgccaccgtcgctgctctagatcccgccctgaagtggagaggaagagaaacaacgagagatggaagacagggaggaggaagaaggatagagaggggatgacatgtgggcccacatgtcagtgggttccacaattctttttgtgtaaatgacgaatggggcccacataaatgtttataatacgacacatatatgttatatatgtttataacactacaaaccaggtcaacactgccacgtagatgccacgttagtgaaactgccctccaaaactgctaagggagcaaaattgcaccggtttaaatagttggtgattgatatatccgatattgcagttcaaggataccaatcagatttggtcgctagttaagggagtcaatgtgaacttattcccgcctggatggctcctacttgtcgatggccctattgagtagtttggattgttgctttatccaatgtagtggtttggttgaaagttttatggtagggtgtttgctacctgtaattttacccacatcatcaactaaataattaatgttgcgttcggaggcctcccgacatagaaaacaaagcacacaattatagtgagattaattaaatattatcctaaaaaacttgaaaaatggattaatatgattttttaaaacaactttcatatagaaaacgtttgtaaaaaatacaacgtttagcagtttgaaaattgtgcgcgtggaaaaccagggaagtgagttgggaaggaggggaaaagaacacagcctaagtggtggtacatgcaatatattatctctaatacactagttccaccagggggcgaagccatgagaccgaataactaatattaatagcaaaggaggtcaaatagtcactgtcaataacaatcaatgggtaaactagtccttatttgtgagattattcaatagtttacattgaaagaatttagcaatcaaaactagtttcatactttcaatgatattattaaagagctaaaacttttgacatatttttttcctcaaaacattcaaatctttactgtcggatgttctttaagatctgtgctagattcgatccgtggacttaagctcatgcatccagtgcgctagccacttacagcgttgcatgtttctgagagaaaagagcaacttacatattagttacataccagttacatattagttacaatatatataattacagtatagttacatttgaaagtttttttctcaaaaaaaaaactgtcgcatgtaggtactcccttctttttattcacttacatcacttttttctttttcctcctgaggttgcctcttatatgtgtagtggctattcctctatttacttctatccgcctaattatttgagtctatgcaatatcttggcaatagtgctaagaatctttaagcattcccaactctctacctcagctatatgttaaataaattgccacgtaagaaaaaaaaagctgaggtgaggaaacagttaacgaggaaaggggaaaaagataagaaaacagttaacgaggctacagcgtaagcagcggcgaaggcagcgctcccctacccttcctcccaacctcccatatatggctagagaaggggagcgacagcggcggcggccactgcaggcggtggcagaggcggcgcagtcccctcccctccctctcttccagttccagatttgggtggagaaggggagtgacgacgacagcggaggcggtgtggtcccct

SEQ ID NO: 101826 - DNA, 897 bp, Oryza sativa
  unsure (1)..(897): unsure at all n locations
ttaaagggcaggtaagtaatctcctaatattgtttaggggtaattttggcatgggatgtttncttcttttcttatcgtatcaggtccgaactccgttgcacgcagtcacctcgctattcctcccccggcctcgccggcttgtccgccccctccgtcgccatccgtattccccgccgacggcgaacttgttcgttccttagtcgcatcgtccgtctgggagcggacgagtgtggtggcgtccgagcgagcgacaatcttgagcaagagttctggcggtagtaaaaactccgacctgggcttcaggggtagcgtcacgcacgcacgcaatgtcatttgcttggcggcggcgtctcggctcattcgtcttcttgccgtttccgatcactgtgttgtttcatagattacatggatcgattaagatcttgcacgaccaactccgacgaggatgacatggtgatcgatctatggatcggaaaacaataataccccttcacgaattatttttcctggacaaaaacacccctccacatttctacttccactaattctggtaggagtagaactaaatcttaactctacaattaaatatgatagagggcctagattactttctactccgagtagaaagcaccggagtaggactcaaaactgtttagctgacttgactccagcttcaagagagagaagaggtgtagcttgagcagtgccaaacagacctgaagattaacaatatgttgttatatttccagaacgatatgagttcaatgatttatcgatttcagagacgacgaaaatgatactaggatggaacaaggatctcatcaagcaagccgaccggcacagagggagcacgcctctccacgtcgcggcgtcatgggggcaccacgacgtcatcag

SEQ ID NO: 101827 - DNA, 637 bp, Oryza sativa
  unsure (1)..(637): unsure at all n locations
ccaactgtttcttccaataaggacgacacacgaccattcagatgctactgaacaccaaacatattctccctttaataaatagtggattatgaggtgcttgttcaatggctataatctaaagagttctgttcaagtttataaacaaaaagtaagaaaaacagtatacactttatggcatctatccatttctcacttattattttcaatcctttccattgatcgatataatatctgatcttccatcatcaattgatccaattgctaattttggattgttaaagatctgatcttccatcatcttccatcatcaagtaatatatgatcttccatcatcttccatcatcagtatataagagcaattttacggtccttgagaaggtaccatgaggtaccacttagagagtttcttttgtgcttggaatcaattagaacccttgatctccttttttctattggaaatttggtacctagatactatgaggtactatgaggtattaaattttacactaaatttttgatacctcatggtacctnctcaagtaccgtagaattgctcatataagaaaactgaatgcccataaaaatttacaatttgcaaatattatactatttatcccggtgacatactaacatgtga

SEQ ID NO: 101828 - DNA, 515 bp, Oryza sativa
cgtgccatataatggggcaataaaatctagttttcatcctacattgcaacagtgctcacgtgacatcctctatctttccatccacatcttctccatgtgctgcatcatactatccacattcgcatctccatatccgtcggatttctaaaagcacgtaccatatcctcgtttcggacagatttggattggatattatcttattcgttttcacccctacccccccccccccccaaaaaaaaaaatcttcctccatttttaaaaatagttgacagtggtattttttattttcaaactttgatctctcattttctataaaagaattacaaataaaaattatatagtataatcaatgtattgtactatagtgatatacttttgttcgtcatattctaaccatttagagcatgtttggtacagctccaactcctaaatttagcttcaggagttgggtctggagtagagttgtggagctgcctaaacccagctccacaactatagttcattttgtgagagag

SEQ ID NO: 101829 - DNA, 572 bp, Oryza sativa
ctccttttagattttacgtcgtcgatgcgtctctcgttttatacagatcgatagatagcctagtgggttccgaatgggcagaagtatgtggatggaatcgtgaaccgcatgccatgctacagcctacagtggtagatatcttgtgattgggcaatttaggtttggagtgtttgactactactttctcccttttacaatgtaaaaatttctaatattatccacattcatttaaatattaatgaatctaaacatatgtatatgtttaaattcattaaaatctatatgtatatagataatgctagaaagttttacattataaaacggagggagtagcagtctagcacggaaggacaaacactaaaccaactgacctggcggcgataactcggtgccgtacggtggttcgttttgtatgcttccagcaagttggtcttacttttttttcctttccgccggccgatcgagaatgacgtactgatgagcaaactttcgataggtattgattagattgatttggtgaaaaattgacactcacgatctggcttctggcttctggcttccgatcaatatga

SEQ ID NO: 101830 - DNA, 771 bp, Oryza sativa
ttatactgttctcaagcgtgtgctctcttgagtgttttcttatgtcattcatatctgaggccctttgggcccataataagtactcctatgcggctatgatgtaaacgtcacgctttttcattgaggtgtaaacaaacattgtacttctaattgaaattttagagaatgcatgtaactgttaggcactgtgttagcctactgtaaaatgtttaattgaactgttgtcatttgtgaaatatgtataacttcttttggaaatggatagcaaaaccaatgaactaggtgaaaccccgcgcattgttgcgggaatttagtatcataacaataaaaaaaataatgtgtaagatagctagataacatcagattaagtaaattaatgtggtttatgataatttaaatttaaatagtatgtagaatggtgattcaaacataaaaagtaaagtgttatgactttatggaagaagaaaaatagggagatagtttgaaccgtaaattaatcatctaaaggttaaaaacaattgatgtgatatgacttaattagagaaaaaaaaggagaaaaataatttggaccatagattaatcatttaaacactaactaactaaggatgaactatataagtaaatagaatatcataaaacataataaagatatgcgttgaaacattatgtgaattatgttggatgataatttcacatgtttgtatttgaaaagctcataaattataaaactataaagatatagtatgtttacatgatgtttaaatgtgatga

SEQ ID NO: 101831 - DNA, 722 bp, Oryza sativa
ctttcaaatgaccatcaacagaaaagaatagatctagataaaaatacatcaccatgataaattaagaacaggtaactaattataaacacagtgaagaacaaaaagaactatgatttgaaatatctactatacaatcacgcaaaattatttatatatcctaaacataaagttcttgtcctgaaatgacccattccaaattatcagaccaatggtccatcaacaaaaataataatagatctagatccatgtcgaagtacataaagaatagatataggtaagagtatatgtaagcataaaaggggaaacttagaaattatggaaatcacgtagaaaaaagctagccattatccgaaagactcctaaacggacagaaggataattatttatcttcaacaaaaaaaattactgtcatgggagaaatcaattactccaaagtatcacatggattgaaaaaaaatagatctagatctatgtacaacaaaataggatatgggttgaaatatatcaacatggaaagagcaactaaaaatttattggcataatgaagaacgaaaaaactatatattatttggaagatctcttgaacagcaacaaagataatttcttctcttcagaaaaaaaaatcaattggaacagtctataacttcagaaaaaaaaaaccatcaacatgatgaacaaatacaaacccaagtgcataaaaaatagaagtgtactggaataca

SEQ ID NO: 101832 - DNA, 1220 bp, Oryza sativa
ttaagacagactaaagtttataagtctagtcaagagtaatacaagtccctgcgcttatttaaccgcgagcatggttatttgaatagattggtttagtcacactgcagtggatatacactttacccgcactccgtgacgtgcccaacacatgagaagagtcacgacccagtctttcgggtctcttaagattgtggtacccgctccatgacctttgcgccctagtcaactacctcgcttcgcaaaccagaagtgaggtgagttctagcattcccgggattctaagggaagaagtcttaggccaattagtccattttcagtgttggatttcacgctcgccgtgaattcctcgtgttttgctctctcacacgacctacattattatggttttgaaccacaaatgggtgtggtaccccccccttttggtgggactaattgtaacatcctgaaaattcctgacaataaaaatcgctaaaatttcgaactttttaaaacttttgcatcatgatggatattatgattattattgcttgccaaactataaattgtcacaattaaaaattaagctaaagctgcacaactaagtaataattataataataagatatctattattaatcctataagtatttatgcacaagaaagcgaagccaaataaagcacaagccaattattaatttctataatgtacattacaaattgaatgttaaatacttgaaccatgttgacaagtgtcatgacatctaagtaactagaaaaatagtcgccactacaacaaccctatatataaaggagtgttccactggaataattaaattaatatttataactttcatcgaatctctgatggaataaaattcactcacataaaataattagtcctataaatgaattgagctttatataaaatacgtttatgtgagtgtttaattaaacatttagatcaatattgtaccaaatttcaatttacttttatggaataatagattaagcatgtccatgtaaaatacattgttatacaaataaactcgaccaatgtgccattgtattattaaaggacacatttgaatatttaattagtttttaagaaatatcaaagcctagaagttatattggataatatttggataatgtaatggaaagcaaattcattgtggaactaatgaataaccaaataaatattcaaaacaaacatttgaattctcaaaaccaaaatgtataaa

SEQ ID NO: 101833 - DNA, 691 bp, Oryza sativa
actctacttttaattttattatgtttattccaaattttagttagttttaaattcctatatggactctatactctacttctaatattccttatttttaattccgaatttctattttttttcttaattgtatttctatatagactctatactctacttctaatatttcttatttttaattctgaatttcagttatttcctaattgtatttctatatggactctatcctctacttctaatattccttattttcaattccgaatttcagttatctcctaattgtattcctgattgtatttctatatggactctagtctcctcttctaatattccttatttttaattccgaattttagttatttcctaattgtatttctatatggactctagtctcctcttctaatattccttattttttaattccaaatttcaactatttctaaattgtatttctatatggactctagtcttatcttctaatattccttattttttaattccgaatttcagctatttctaaattatatttctatatggactttgctttttctttttctgattaatgtgagaatttctaggccatgagagcgaacgtggaggctcctttttctattcctttaataatataatagattgagcgttacatgtgctcgaatctatggctaatattattttagttatatgcgatatatcc

SEQ ID NO: 101834 - DNA, 716 bp, Oryza sativa
caaataatttttcgggtagtaacttattaatatctacaacttttggtttggtcatttttctatatgattttgtttgaatcgtttgaatttgaatttcaaattataataacttcaaacaacatttacaagtaataaatgatttcaactgaaaaagtcatcaataacaaagttgtataactcatcaatatctataacttttatttggttcatttcttcatccgataaagtgatttgtaacattgttcacaaaatgtacatatttcttatatagtttataaactataagagagatatgtaaattttgtgaacaatgttaatattactttgtcggatgagaaaataacgaaaataaaagttatagatattggtgagttataccactttattgttgatgactttttcagttaaaatcatttaatatttgaaaatgttgtttgaagttgtcataattttaaattcatattcaaattattgaaacaaagtcatatagaaaaatgatcaaaacaaaagttgtagatattgatgatttatacaactttgatgttgatgaccatttcagttgaaatcatttagtatttaaaaatattttttgaagttgtcataatttgaaattcaaattttatataggtcaatcaaactcagaaggagaaataaccaaaataaagtaggtagatagcaataagttatacaactttgtttttgataactttttcaca

SEQ ID NO: 101835 - DNA, 576 bp, Oryza sativa
  unsure (1)..(576): unsure at all n locations
atggaatttgcagtttcattgccatggaccccagcagagaatttttcacttttcctactacaaataaaaaagtagtaaagacaaactatagaaggttgcctaatgataaacgaatcttaagtgacaccaaaagccaaagccttttctctgctaagcttgatgtgagaaggtggaggcttaacgcttaaactattattctcctatgataggtaccatgtgaacatgtatcgtcactgccaactaagttgtggcatgannnnnnnnnnnnnnnnnnnnnggttaatctttcttttcaagcatccactttttaaatttattgatatattcattgtggcatgatggcatatatggatgctgtgaaatggcgggccttcgaaacagacccaagtaaagttgaacagaaaatattagaacccactcttcgtgtgcatagagacgtggggtgaaagagggtcacaatttttgacacatgcattctcactaaactttaacatgcacgtagaataaagcaaataaataagaaagaaaataacaatccgacatgtgttttgcgttttacatgaacatgccaggtga

SEQ ID NO: 101836 - DNA, 741 bp, Oryza sativa
  unsure (1)..(741): unsure at all n locations
actggnttttggacttgcaagnatcgcacatggagcacatcataatgcatatgagtaaaagctgtgtcagtactgtttatgtagcttttgggggtataatacgaggtattatggattttttttttgttgagatgaccactgcaacatgggactttatttcctgatccatgcgggaaatgaattgtttcatgttaagttcctgaatagtttctgtcttccaaaggaacccttaaatggtggagaatgtatcctgtgcacccatgaaaagttcacctaatcccttctatacccctgaattttgntcngnnccttacatacccccgcagtctaggttagactccttacatggactctccgctaccaccccgtgcgttggacgctaaatttttctaactagtactggttaccgtttgctgtgcactagaacaccaatatttgcggctacctcgccgaacaggaaaactccttctttggcactatattgtttttacaatatggattcggactacgcattggacatacatgctcgcttgcccctgacccgaagagatgacgcttgggtaggcgccttttaccgaaggcgattaaaggcaggacgcgccgcccttgacccaaagcgacggatttttctgtttgaccggcgccggaacaagaacccgctttggtggttataacgcgggcggatgggcggccctcgggaacctcttgtgcgccaaaaccgtactattggatggatccgtg

SEQ ID NO: 101837 - DNA, 760 bp, Oryza sativa
  unsure (1)..(760): unsure at all n locations
agtgatgtttacagatggtacagnagctcatcacaaatggtcataacttggccatctggactcggaattggaccgttcaagtctctaatttttccttaagaagtcaagacccatttttgtgctttgttcctgcttgttatatggaatttattagagtaaaagcccttttattttccgttggtcgtgtagacgctgcagcttcggaagatccgctcttcgtggaggttgaagccgacatttgggaaagcgagcaaggcaagtcacatcatccttgaacatattggatcccattttataaaattattttgatttaaattattgcattaccgctttacttaaattcccgcgttatcactgttttatttatccatgcctatttacctttgttatgaccttattattagtttattgatattattaccttgttcaccctagaataaacaaaaccccaactagtggacactctactcatggtaccactagtatgattttaggtagatgcttcgctatttaattaggcaacattatgcggttttacaactctagactttgggatatttatatcacctggacactttggaattggtggattattgtggaattggattcacaccgccccctctattcaaaatccccaaaaatggttttaggctgggctcggggtgcatggttttgatagtagcaccttcgccatataaggaccgctcttcgggcctcttgtgcaaagcactaccgtacttccacatgtctagtgggtaag

SEQ ID NO: 101838 - DNA, 1393 bp, Oryza sativa
  unsure (1)..(1393): unsure at all n locations
aggattggaaactgtgtcatgtctcccgtccgtatgccgtggtggtatgcggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaagtagttttgagcaactaagtatctttaaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagttcctggaagatgaaggctttggtgtttagctcgtgcctgccgtcaagcgcctgtggtcgtcgccctagtcttccgctgtttttcgtttgtcttctggtgtgttgggccttcgccgcccatgtaataaattaactatttacgcttccgcttgttgaactctgaaatgtatcaacttttggtgtaccttgcctcctgggacaaggaataatacacgcacgtaaggaacgcccgttgggtcaattccggtcgtgacaaacaacctagctcgattccatgaccggaaggcaaagttatcaaggttttaatttgcacagaattctccatctgcattccagtgtcgcgcccgccagccttccttaacggcgcggttagtcgacgcgcttgacaccgacatcgtctaagctatccaccctaacgtcctatgtgccatctccatactaaccacctcgttgaaatccagttgtggaccctcagatattcgacgtttcgccgaataaacagctgcttcctggcctatggtaagtaatttctagtaaaatctctgggggtccaactctcaaaatctagtctctctagggtgaggcccgtgattctgcagccatcaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgataccgacatcatctaagctatccaccctaacgtnctatgtgccatccttatactaaccacctcgttganacccagtgtggacctcagatattcgacgttcgcgaaacaaccgt

SEQ ID NO: 101839 - DNA, 932 bp, Oryza sativa
ttgatatatagttcctcttagtttaaatggatttactacaattgtctcttctctatcttagaaagctagtatcacattttaataagatttcattttgagcttaccatatttcctatttctgctgagacacgaaataagttgctgtactatcatgcatgtatggcttatatcatggcccaacagcattgtatcactaaaaggggagacatggaaaagaaacatcctcccaagtcatgatccgattttgttgtaccaaaaagaattgaaaaagattgtgatggtgatgacaataaagcttttggtgttcatcgctacagagcttgcatatcaagaaatgtgacaataacaacagtgtaactaatcttctagaacaataaaagtttccacaggcaaaaaaaaaaaaacagagctagcaccaatgattctctctctctctcttttttttttgcagaaaaataaacacaatttccctttaatttggtttcagcaaatccataagttatgttacttcacttgtgaatggaaattatcccaacaagaggaatctttaggaggtggtggatcccattgctcatggttcgtacttttgtagtacatatagtactggtttccaaataaatccatcagctcaattattacgtacttaggttgttctatgatttatgctacatggagtgagacttatctaggaacagaggaaatttacataaatcaaagttggagtaaaaatatgagaggatatgggaagttgggaataatgtatttttcattttgcaaaacacaaatattaccatgagagtgtttatcagagcggatacaataagatgatgtaagcgggctctacatattgccacatcatatttatacttacgtggaggagagagaaaaaacgggctacaaatttatagccagctgcaccacgggctccaata

SEQ ID NO: 101840 - DNA, 501 bp, Oryza sativa
gtgggccgtgcctgggcgggaggttcagcccatgggtcgacacggcccggcacgaagtgccgatcgggccgtgccagcccgatggctggtgggccgtgcctgggccaggccatgccggtcgggccttttggccatctatactcccgtcgtctgtggatagagaggatggtgggtcccattgtttttttccttttgtctgattaacatgtgggtcccacatttttgtttttattttttatttttatattttgcttgcagtgcctcatcaccgccacgtaggacgaggaccaagttaaaccggccatgtaggcaccacatcagccaaaactaccatcaaaaccgttgagggacatactttgcactggttttgatagttgagggattcgttatatctgtgttttttcagttgaagaacgaaaatcggattcgttgacaagttaagggaccctaaatgaacttattccactaagtccagaatctagtacggcccaacatgttggg

SEQ ID NO: 101841 - DNA, 591 bp, Oryza sativa
attcctgcagccctgactgaggaggagcgtccataatcaaagccccgaagattaagtgaggattgaactatcattaacaaacatcgggtgctcatacgttgtcatctggctgtatctgagtgatcaatgacgtagactatcgagaacgctagtcgtcataccactatattaactattttttataacacacatttgataagtcttttttttctgaagaggttcccaataaaccttcgtgtaccgcaggttcaacaatgatccctacatatgtgttactgtacgaacatgctactggcaaatgtgcacatctcgacaaaatcaccaactcgcagccaatacatatatatgcgagcgccgaatgcatttgcatgggctagcactactagtagtagggtccgatgcttcatcaattactgagctaactactgcagaatctaaagcaaacatacgcggtgatatggccatgccgggaccgacaagatcttgcattccatgtgggacggaaccactgcggatggatgaactctacgataccccgtctaccgtacacccctgttactgtcacactcctgcgcttgcgtgcatatgcac

SEQ ID NO: 101842 - DNA, 614 bp, Oryza sativa
ttcccctttttacacgaaaacatgagcttatgttcgttggatagcagcagccagcaagattatagccttggatagctggtacgtcttacgttcttaaataattgattgtttaagtttaagcttgttttatcttcaaaaaaaagtttaagcttgattgtctgtctttttttttcctgaaaaaaaattataaatgctttgttggtgctagatgggatctgcgctccgaactccttgaacttgaacagtagtacagtaccatcaagattttgttggtttaatatacaatagtagttcacaatccccttaactagtttctaaaataataatggatacgtggaacaggaggcaataacgcacacaatgaaaaatatgccactacttcaagttccgaaagcaacctttatgggatggttttagccaattttcgtatttagggcccctttaaatcgcaggattgagaaaacgtagaaataagaaaaacatagaattttgatagaaatgtaagtgtaaaacagaggattgcaaaacacaggaaaaacataggaatgaccgtttgattgaaccgcagaaaaaacaaaggaattggatgagaaagatagactcaaaggaaagtt

SEQ ID NO: 101843 - DNA, 701 bp, Oryza sativa
atgcatcaactctagcctaagtatcccgcatgatctctgaccaccacggacgtcgtcttatccccatgccgactcccggtccatcaccgcaaatactctcccaagacatcgagtcacctacacatgaaataaacaaagaaaccatattccaagaccaagctatctccaacttgactcattagtagcaaacaacagtattacatacgtatagtatccatctagaagtcataatcatgaaataatcacagatatccaaagaaacaacccgaaatcgaaaccgacacagcgtcggctggtcagaccgcgggctgcgccggtctgactgcgcatataccaccggtctgaccggctaccagagcccggtctgaccggacccaaatccagcagtatcctgtatatcacctgtgaaatccaatcatttccaaaaccacttcgagaataaattccaaataacaaaaccgataatctccaatactaattgttcatcacagaataataatcaaaaacacctttgatttcacaatctcccccttgatgaactcattggcaaacccatcaaaaatgttttggtgtttggaaaaataaaaacaaaagtggtaaaaagcacgcttcgtacaaacgtacacatcgtgctcgaaaaatccgaaagaaaacttctccccctttttaaaagaaagaaattcccaattgaaccaaaaaca

SEQ ID NO: 101844 - DNA, 533 bp, Oryza sativa
aaaacaaaagtggtaaaaagcacgcttcgtacaaacgtacacatcgtgctcgaaaaatccgaaagaaaacttctccccctttttaaaagaaagaaattcccaattgaaccaaaaacaacatgctcttctcaacaattccaaaactcatctcctctcaaaaattttcatctcttctcccccttttgacaatgatttcatcaagcatagaaattatgttcattaatgttccagagcttagcatacatatagcatatcaagtcatgtgttgcaataaaaagaagataaacctatctataatataaaaagcatgtattaaagtataaccatgaaccaaagattttacaattaagcttgaatcaacaatcaaaactaatgatttcatacgatttataatgcaacatcttaacaagcacataggttgaaaaataaacactaaacacatatacctattgcatttaacactctttctcaaattacctttagcacaaaataaccaaaagaatttttgaactttttcttttcttgagcctttt

SEQ ID NO: 101845 - DNA, 594 bp, Oryza sativa
acaaactatcacagtacgtaactctttttatttaaaatattttacttttatgaatattgtttatcaatgtagcatctttaaaaccgtgtcgaagtcaaaaacaaaaaaaaggcttatattttgatatggaggaagtattctttatcgtattttcctacttatctatctcatttttcacatgtgtgcttttcaaacggttaaacggtgcgttttttttaaaacgtatgtatgtatgaaagttatttgaataatcatgttaactcatttttaagaaataactaatacttaattaattatgcattaatgaaccgtttcgttttacgtgctcaaagggttagtttctaacactaataatcgaacacggcctttgccgcttagaggaattttaatagtatatagccaactactagctccaaattatttatagataatctaatagccaaattatacaatagttaactacaaatatatactacatcattaattactgctcccacttgtcatacacacgtagcatttaggagtccgtgctacagctagctacaaatctgcagcctgcttcttttctatctcctctctttatgttcaccacat

SEQ ID NO: 101846 - DNA, 588 bp, Oryza sativa
attggagtgtgttgggtgcattcgtggcaaaacatgacttcgtgattcacgcggcgaactttgatcaattactgccaatattggctacgtgggtccgatgttttagaccgcaatgaaaaagttcaaaaagcaccaaaacatgatttttgaacatattggagtgtgtttggtgcattcgtggctaaaaatcatttcgtgattcgcgcggcgaacttttgtcaattaatgccaatattggcatatattggcacacgtgggtgcgattttctacaccgcaatgaaaaagttcaaaaagcaccaaaacatgatttttggacatattggagtttactgggtgcgtttgtggtaaaaaatcacttcgtgattcgcgcggcgaacttttgtcaattaatgccaatattggcacagtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctgccaatattggcacacgtgggtgcgatgtttagaccggaatg

SEQ ID NO: 101847 - DNA, 1164 bp, Oryza sativa
atattatggcaggagcagcgtggagtcaaagccctactccgtagagggctcgaggctgcgcggatcgcttcctctctttgaacacagctggggtgtgcgacatggctgtggtggaggatctgcccccacccaggtgaaccctcactttagactgtagattgcaacagctatatgtaaattacaataacgatttctctattaatgaacctgcagtttaatctgaaaatttaggcaaaatgtaaccgttgcagtcctttgttttctttctcaaacacaccattccagtcttttggaatgacccttagggcctgtttggcacagctacagctccagagctcagccaaacagtttcagctgcaccaaaactgggagtggagatgggtggagctctctcacaaaataaactagagttgtggagcgttgtttaggaagctccacaactccacgccagacccaactcttgaagctaaatttaggagttggagctgtacgaaacaagccctaaagctgaccaatcacttgtgaagaatccctctactttgcagagcagaagcgttacttggcatatatactttgcagaagcagaaacacaacttggcggtggctggtttatttagcaatctctacttggctttgatggccagtgtggtaattaatttcagaaatctccgattcttgttgacaaaatttcttttgcaggttgaacatggtgatttcagacatttatcaatgatggattatctgcttgcctattctttctgttacatcagttgtgggatgtttttctgttaaattaatctaggttgctctcttgatctggtctagacagatcctaagcaaaggttgcaataaggaaaacaaaaggaaaaggtgagagaggggcttagtatacctgttgactgtagctgtgtcaattttagttcaaatgtttattggttttgtcatgtatactgcactgtggttcatgaagaacacgaagaatttgtatttggtctacttaattgatctaaattatgtagaacttcatgatttccttcagtgcaaaatatttattaaaaactgccaaatgtagttttttttcttttttttttatccctataaagaactgctagaaccttttttaccacgtgcaaaataacatttgcaatttttttaacaaagaag

SEQ ID NO: 101848 - DNA, 586 bp, Oryza sativa
cccacagtgatttggtaaaaaaaaacacgtggcccacgaataggaatactatgatgttaggtagacccgacccatgttgtctgtgatttcaagaacacgggacgacgcgtgtcgaggagcacatgattctcaacattattattattttgggttaattggattcatgtcattataatttttacggttttgaaatataccactactatttgtgtatttggagtcatgtcattacaatttaatacatatttgagatgtgccattacttaccccctatgatgcactgaaatttgtttttgaccaaattaaccctatcttcttcctccatccccttctctctctactccctttcctcccatctctctctggatcggagctgacccggtcggcatgaatccagcagcggctgtcggccttggacatatttgagatacggcggtggcgtcaacgccggtgccggccgctgatgtgttctcgaagctcgtttactgattgtacatagtactagtaggcaaatgtagagacatgttctttcatccgcgcatttttggtctctttttcttcgcgttttctcaaaaatgatatgggc

SEQ ID NO: 101849 - DNA, 507 bp, Oryza sativa
tcgaattcctgcagccccatacacgcagtgatattaaaaccaacaaattagtgggcatctataatacgcccaaaatgaaataaacatataaatggaaatctacagaagattctacggctgcgacatctggagctttaggatagatttttctttttagccttttagcagtcatgtaattttattttctttcatgttggaatccctaatcaggggttttctctacggagatgtaattaacagaatttctatataaatgtatgaattctggaagtaatggactcgcaatttctgatttttatttatttattgcatttaaattaaattgtctctaacgatttgcggataacgaacctactattacaaccatcccggttttcccggcgtcagattctggcacgcccagtgggacctacttctcccctcctctctgagttccaacatgtagaccgcgaatatgaaaaaaaaaggagataaatgcacatatccttagtggaaaaattcacgtat

SEQ ID NO: 101850 - DNA, 675 bp, Oryza sativa
cattctgaataagtgctactagtgttcttgatgtttctagtaaaaaatactctctccgattctaaatatttgacggatagatcggacattatgccgagacagtataaatcactcagtatctaaatgtgccccacagtagggattatgtatgctcgcagcatagccgatagggcaaacctaacatgtatcagctagtagtccgataccaccttatacctagatattagcacaggtgaaatatacaaaaccgagatcaatctaccaagcagggaaactagcagactgataggaagcttaatatactttaaacggatgagatcttgatataaagggcagatttagacgatccagaaccaagtaggggaacaagacggctaaatcaggtaagatcggctgaaaccctgatgctatctatattagcattcaaagaaagagctagataacacatttcaagacaatacttaacaggtcgaacctaaccgatgccgtgttaagcgtgaaaagaaacataagatctaagcaaatagatgaaaactcattcaaaatggtagatacaccgcataatctaagctgacatcgacatctaaacctatcggccgttttcgatgatagaagctggccgatggggttagatgacgagatcaatctagattatgccggatatatgataattca

SEQ ID NO: 101851 - DNA, 684 bp, Oryza sativa
gatagaaatttttgaggatacgtgcaaagggattatatacggtatattgatttttactccaggttggttttaccaaccgaataccaatcgggattaaagatctctataaactttagttccggttaggaacaacaaccaggactaaagttaagatctaccaactaggactaaagatctttgaggacctgatagcctctgacacgaggtgaacctggattaaagatcacatagtccccttgcacaaataaacctggaccagagatcatttttagtcccggcttttcaagcaaccggggctattgtggaaatcggccgacccagcaaagatcacttctccagtagtgatggtggagggttgtgattggttgggaatggaatgttaacggatatgttattatattttgggacagatgaagtattataatttggaacagagggaataactcccagtcaccaaataacaatgtttccgctcgcgttgctctgatttaggagcagcgaaaacaataattcgagctatcccaggaatctcctgtggatcgccattactactcccaggaaggagtacgtctcaataacattgttggtgtactacctccattccatattactttttaagtttttgtttgtcaatgtttgatcattcgttttatttaaaaagttttagaattattatttattttg

SEQ ID NO: 101852 - DNA, 674 bp, Oryza sativa
atttataaaatgcctctatatacaaattacaattgagtaagaaattcaaatttgtttttattttcatgtagatattataattgcatacttctatttataaaaatagaagataagagttgtatttcaaatctaattatacctttacctacctttgtgtgaaattatacacgagaatcctctagttattatatttcaaatttttctgcttgatctgggcatttttctctttgaaattatgtagctttcacttctatattgttaacagtagcaacatgtgtgtatattccaacatgcctccccccccaaaaaaaagaaaaaaatagcccatacaacatgtggattgaacatactagcgtagtatcgttcaactttccatctccaagttcatcctctgaggctttgaactctgtgaagaattaacaagagaaacgaacaaacctattaaccatgtagcctagtggttacagtgatctgagtagtactcaaggtcctgagttcaaatctcctatggagtgaattttctagaattttttggggggggcgtgttgcggggctaagttccctatttcaatggccgtatatatccggttggatgtagatgccgggtagaaaatacccttctcttaaagaaaaacataacaaggtgcaaacgtgcagtgcagatggcaacatag

SEQ ID NO: 101853 - DNA, 514 bp, Oryza sativa
ggcaaggagcagcacgaccagcggtatggcgccgccggccatggctgcctcaatcattgtttggctttgaggggggaaagtgtttgggggtttggtaattggtagcgtgtcgtaatctttcgcgccatgtgaatatgtgatgatgtgaactgcgattttgactaatgacggtaatcaaggagaccatttgactactgctcacatgaaattggctgtgtttaattgctgggccaaatctttttaagtattcgtacacacatttaaaatattaaatatagtttaataacaaaacaaaatacagatttcgcttgtaaactgcaggacgaatttattaagggtaattaatctgttattattaaatgtttactgtatcatcacattgtcaaatcatgggatatttaggctcaaaagattcggctcacaatttacatgcaaactatgcaatcgatttttttcttctatgtttaatgctccatacatgtgtccaacattcgatgtgacctttttagaaaaa

SEQ ID NO: 101854 - DNA, 649 bp, Oryza sativa
acgaggagcggagggccgccggcgccgtggacgacgacgaggacctcgtcgatgtgcttctcagggttcagaaggatgggagcctccagatgcctctcaccatgggcaatatcaaagccgtcgtcctggtaagtagacaagtacttgctgattaatactgtactaatctcccttaattgcacacgaatacttctgagcttagagtagtatttatcttaccaataattaatttttcaatcgtatctacaatcgtaccctaacgtacgttctcttccctaatttagtgaaggttcaatcacactttctggatctataatccattatattcgtgaaaggatgaaatataagacatattttaccaaacctcttttacctgagtgcacttaaaatttgactactgttaatgtcaaaatctacaaagttttaccgtttaagaataaaattaaataactttaactgatgaatggagcgagtatatatgaaaataaaaaaaaagtatgcacactgaacaaaggaaggaaattaaaaaggtttggggggcaacatattttttacatatatgggaaatatgttttttttcatgcatataggaactttttggtgctgggagcgagacatcagctaatacacttcaatgggcgatgactga

SEQ ID NO: 101855 - DNA, 935 bp, Oryza sativa
tacccatttaccaaacagttaaatagtgtatttttttaggaaaaaaacattttatttagtaatgtttccaaagaaatcgaataaatttaatttttaagttcataattattgataatcaattaatcgtgtgcctgtcttagctcgttttacgtgtaaataaaaaataacagctacttattagaaccgagactaatacatgcattacttatttagcccgtaccgatggttgatgtttttttactgtcactatccagttgttttcttgtgattgcacgagatccaaagtacactttattttattttcttaatgtgccaattggacaattggcttagtaaactcgatactgacaagtcaatgaaggatgtttatacataacagatacttcgagtaaattacttaacaaatgccatcagaaaatatcatgtacagcaaaatgttattcgaaatgttgaaaaatacggaaaatacaactagctatgtcaatatgtttcccatcctgaggtccacatcaatctagtgagaaaatatagaaaatgacggtttacccgttatttcttccccaacatgggcatggactaaatggcacacgacataaatcaaatgaagtccaaacatttcataaaaattcagagatggacttcaaatatttacttcgaaacaattttatatgtattatattgaattagtttctatggtcatttttattaatttgcttgatattgtgatttttcctacttgttttatttttcaaaatacaaaaaaaaatctgggaagctgatctaaataagtcgtcagatttttggatgctatacttatactgtaaaggcctgctaaggttaaaaaaattaagaaaagaaaaaaaaagaagggcatgattaatatgaaacttttataatcttccgatggaaaatgtgatggcaatagaaattggatg

SEQ ID NO: 101856 - DNA, 685 bp, Oryza sativa
cattataattattatgtaatcaactatcgatttcggcttaaacagagctaagtgttaacacggtgcttaattcttctctcactgcatcacacatttaattttcttttcatgttattaacaaaatcggtagcgctgcagcggtcatgatcacctgagatgcctcagacatgacgctttgtcacacatgcgaaaggaaaaggtgtagacgtgcattatgcagcaggccaaaaagagaactttagacactttagttattaataatagatccgatgatttaaataatgggtcgtacttgttctagtataaatataaattagttaatctatattttaaattgttaatttaatgggtacacaatataacggtgtaaactttattttaaaacaatgtattatttgagaataatagtccaaagtaattataaaaatagatccaatgatttaaataatgggtctatctgtttaagtgcatgtatatattagttaatatagatcttaaattgtttatttgataggtacacaatataattgtgtaaattttattttaaaatagtgcattatttaaaaataatagtacaaagtaattagtacaccggtttaagtggaaactatcttacattattgatttaatgggtaaacatataatatggtgtaaattttattttcaaatattatagagctaattt

SEQ ID NO: 101857 - DNA, 531 bp, Oryza sativa
tttcttctttttcaccgattaatgtgggaattatttttattccgaattttaattaatcttgtattaggttattatatggactcttattttaacattccttatttttaatttcgaatttcagatatttttaaattgtattcatacttggactctcatttccttttctaattttagattttattttatttttatttcgatttttgatttatctcgtattgggttcttatatggaaacttattttaatattccttatttttaattccgaatttcatctatttttaaattgtatttctacttggactctcctttccttttctagttttagatttttttttatttttatttcgaattttgattaatctcgtattgggttcttatgtggaaacttctttcaatattgcttatttttaattccgaattttagctatttttaaattgtacttctacttagactctcctttttctttttttctttttctccgattaatgtgggaatttctagctcccacagcgaatgtggtgcctcctca

SEQ ID NO: 101858 - DNA, 657 bp, Oryza sativa
aggatccccaggtttgatatttttttgggacaaaagaagtacggatctgcttcagtttgcaattttcatttacttcgttttttatttcctgatgtaatccagaattccagatgtatttttaatcaggaatttcttgttgatatcagtaagagtaagtatgaattgtaacatagtactggtccagcttgaaaaaaaatgttgatagataaaacagaatcagacatctatctatcttctatctatctatctatcttctattattatatactaaaagtccatgaaacttcctataaacgctctcaaaccgccacgtggcgctctaataaaatagagaaaatcctagaaattctaagaaaaaagcaaaacatctatcccttgattttcacttaaattggtgggtccaatattatacaccattagataaaattgatcttaaaactattatattatattatattatattatattatatactaaaagtccatgaaacttcctataaacgctctcaaaccgccacgtggcgctctaataaaatagagaaaatcctagaaattctaagaaaaaagcaaaacatctatcccttgattttcacttaaattggtgggtccaatattatacaccattagataaaattgatcttaaaacaaactaaatacc

SEQ ID NO: 101859 - DNA, 698 bp, Oryza sativa
atagataccaaaattcgtattaaaaattttgagaaattttactatcattgggaggtaataagagcccggtactaatttttttttatactaacattggtaccttttaaaattagaggtagcgagaggtatcaaattttacactaaaatgttgtacctcccagtcgaggtattgtaataaatcacttaaaaaatttagtacctcttagtattaaaaattataaaatttctcatataaattaattccatggctgatctaatctagacatatgacagtataatagtatatactcccttcgtacatcccgaaaaaagccaatattgtatgtccagattcgttgtattacgatgtgtcacatcctagtacgagattatatgtctgccctaaattaataagggatagattacgtgtacccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgaaagatggcaagccagaagatagatctagaacaaat

SEQ ID NO: 101860 - DNA, 678 bp, Oryza sativa
ttaaaaacaaagatatagtattaatttgaaaaaatgtgttaaatgccaatctttccaaataagaggaccgcaagcaattagcagacatcaaaacctgactttaattcttagatgcattatcatactaaaataacttttctatgtatattattatagtaattaaacttctctatatataccattcctagttgcccttaaggtattcgacaactaagctactagctagctagctcaatacgccatcagcgacaccgtccaggttgttgtgagaggggttgtgagatatttaactatttatcactctaagtggcaatctggcactaattcagccatgaattaaaaaattgccaattttcaccgtgagttcagtagtcaactttgcagttatcgtgaaccatgcattaatgtgtttgaattgcaatttgcaatttgcaaaggtcagctttgtcatagatagccagaaattccggctgcctctgctgcatcacaattactacttcatccgtactaaaataaaatataagtaattttgaaccgatgagatacttttcagactatgaatctagacatagagtatatattgtatttctagaaagtgtctcatctgttcaaaatcttttatattttaagataaaggaagtatattgctgtgccagcatcatcagcatgggtgttgtg

SEQ ID NO: 101861 - DNA, 562 bp, Oryza sativa
ctactaaacatatcggacctagttacctagtgtgctaggtatacaaaatgatggaggttcgtgttttgcttttaaaactgtaggatgattatgttgctcggagtgttacctaagtttaaaatatattggaattgaatttagtgtccataacggacctcccgctatggttgtctccagatgaccacgacaggaattagccgaatctattgtctaggctcataaaaagttaatcgtcaaaaaaaggctcataaaaaatttaaaatttaatatgtcactgacaagaagcaattatgacatttcataatactattctgatatatgaaccccataaaactcataataataggtattctcatgcaacttgtagggtcaatatcgtgcctcggtaatgcctcatgtgtcatgtaataatatactagacaccatatgttaaagtgtatcttcatatcttctactactaggtatatccccacaataccttattaccttcataagatattcatacaaataataattgatggtcttcctatcttaattctcttatattttgaaactgagaaag

SEQ ID NO: 101862 - DNA, 520 bp, Oryza sativa
cggtgtcgacgtctatggggtgggcttcctacacaagggggtggacgggttagtgcatatctggcgatttgaggattgattcgtgtgtgctgtttgcctgtttggtgtgtttttttttttttttggggggggggggggggggagaggggagatttgctcatttgggtgggttatgacttacgagggtgggggtggttttgacttgttgggtggaatcgtcggtaaacatttgcaattttgtttgtgattagttctgttggtggattcgatgggtttgctcaaaacagattactcgattgattagctaagaagaactttttttttctggggagaattttttctgctgggagctgagaagtgtcttgaagcagaaaatggtttttgtttggggaaatggtgagttgctgatcaagttttgtggttttgtgtgtgatttgctgattaatcatgcgagcatacaacaccgcaacattcacctgttttcattggatggatgaaccaaatgatgcgtggaatttct

SEQ ID NO: 101863 - DNA, 507 bp, Oryza sativa
acataataattaatgcataagtaaaacctttaaaaattgtgttattagtaactaaaaatacaattctgaaaaagaaagtgccttaaaatatcttcaacttaaaatttaaattttagctttggttttagcttattagtgcaactgatggggcatgattcaccttttttaaattctatttttttattaaatttcgaccactaatcgtatatttaaatgatttaaatatggtattcttaaattcataaaccgataattaaatttttaaaaaaatacaaaaatgaaattcgaattggatggcatcttgcatattccatttctagcccatcatcctctcgtgcggtcgtgccaacgaagcaacccgcttggcgccacacaaacatacggcggcgacaccgagacactctcgccggccgtcgccgccgccgtctcctcccatggcgacggtcgccggacgattcggcttcccgccaccgctcccttttcatcgcctccgccggcgaccacctt

SEQ ID NO: 101864 - DNA, 735 bp, Oryza sativa
ggggcgactttggaagaaccccttgcattaaagcggcacgccggcggcaagaaagcggcggccggggcggggcttgggcggggccggttccccggccggccggcggaacccggcgtgcgccacccgcggcgcaagcaccggggcgcggcaccattggccgtggcggccgtaaaccggcgccgcgccgcctttttccttttcctcagccggtctcggtaggcagggcgagagagagagggagaaggagccgaaagagaagagaggaagagaaggaaaagaaagaaaggagccgggaggagagaagagagagaaaaagaaagagaggagaggaaaaagagagaaaagaaaagagaagggaaagaagaaaaaaaaggggaaaaagaaaaggaaaggaagagaaagaaaataaatagggtttgagtaaaatttagaagtttagaaaattcaaaatagttaagaatttaatcgtaggttaattatagtcgtaaaattgcgaaagttaattataggattaatgaaaatatagttagatgaattcttactaattaaatacctaaaatactagcatttaattataggattaatgaaaatataattggatgaactcctatagattataatctatagattatttttagtaatctccctaagaaatcaagttcgcgataataatttacatatgattaagaactccataattcgatgagtcttaggacatggctaatacctaccaaa

SEQ ID NO: 101865 - DNA, 516 bp, Oryza sativa; identical to SEQ ID NO: 101160

SEQ ID NO: 101866 - DNA, 532 bp, Oryza sativa
cagtgctctccgttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatataggtggtgtattaactatgtgccaatgttctccaagatccagttggaagtctctgctgtcactaaccctctccagggtataaatagccgggagcatctactccatggcactcaccttaccacacaccactccaccattacttcacaaccaccacccgccgccatggagcaagtctcgtgcttcgccgccgccgccggcgccgtcctagttgttctctcgctcgctcgcatgctcctcgcgccgcgcaaggagtgggacgggctgaacct

SEQ ID NO: 101867 - DNA, 600 bp, Oryza sativa
cctcgaatatacgaatatgtttgagatagctaaatagataatatgttatgtatgggtggtctctgtatgttataagttgtaattaaaatgattatacagataatattcgtctaaatcacagtatttatgctctgaactcaactgagaaaatttcatacaatcactattcatgctctgaactccacaacattcctaattaaaaggttgcatgtgcttgaatactaaaaaatcggcacccgatttttttacaactaagcacatataactaacggtagcgctaatccacgcgctgcacacggaatattagatcgagcgccacacagcgctccctccttccagttttttcgttttttaccacccacctttactccgcatcccacctttcatcagtttatttttttcgtttttttaccaccctatcttccgtggttcttttttctcttttccatcttatccgtgcttcatcaaagggcccggtaaaatattaaacatccagattttttttgtttttggttccttctctccagttattttgtttcgcgttttagtaaaatatttatcatctagtttttcttttccagttttctgtttttctagtgt

SEQ ID NO: 101868 - DNA, 599 bp, Oryza sativa
aaagagattgatctgactatgctattccatacatcacccccaaaaggaggtttcttcatcctttacctcacattttgctatgactgtgaagatatccataaattgtataacatctctccacacaaacaaaccttttgctatgactctgaagaaggccgctaaggattgtaagtgtctaacccgcgaaacctacttatatgctaaaataagcgccgcgagtccacttattttgacctataaatgggttacaccctgagccgccaactcattccgcagcagctactactagagtgttattactagttcttttaccactcctcgtatctgctgcatttttcattgtagatgaaaaattgaaaagacttttgctttattggaattttgctgaccgacaacatatataagtttacatttactccatccgtcccacaatataagcattttggactgtgacacggtttttgtgatactactttgaccaacaatatctataaaagtaagatgttttaaataaaaagagttacatattattatagattgtctaatgataaatctaataatatcaattttacgtgacaatattttgtttctattaatag

SEQ ID NO: 101869 - DNA, 663 bp, Oryza sativa
gccaaaggcgttgcttttgtatgaaacaatctcccggtttagctaaagatattttccaaacaactctactccactaacagcacaaagtatatattgtcgttttattcaaaaaattaatataaatatgctaaagtataggtcatagttaatgtttttaatgttaaaacatgcaaaacaaaataaataacattgatataatttttttaataaaatgaatgatcaaacattatgtaaaaaattaacggtgtcatgtattaaaaatatttatgtatttttttaataagacgaatgatcaaatgttatgctaaaaattaatggcatcacatattaagaaaacggagggagtacaatttaagcattaacacagattcaagtgcccaaaagcatcaacaaactcaattttgacttcactcttactaaaccaaacagattcaatcacagttttcaaatgttcccaggaccttagcttctggagtaccaaatgatcgactaaaggttaaaatctcgtcacctagcctcataacctcactaactatgatgttttgctggttacaaatctcgtagagctcatgaaaagtgggggttctatttcagttcaaaagagaaatacctaacacatgtttgttttccataaactatgtagcttagtgatacggttgtgta

SEQ ID NO: 101870 - DNA, 645 bp, Oryza sativa
aaagaaaattaagaacaccaaactcctaaggtacaatagacaattcagtaattagtagttgagttttgaactatgatgggttcaatactaacattcttaaaagtagaattgaaaaaaatatgtcatatttcaaaatcttcgcacttccaaccggaatggaaagcaaattgaattgactccaccattgatttttttcttaaaagaaaagattaactcctccatggtcacaacgtatgccttgcaaatcgcaagaaaaaaaaaaggaagaattaaaaaatctgcaagacaaaatggcaatacataggttggtggagaggatgcagaaattggaaatgttgcaagcagaagaaatttgaacatggaaaaagaataaggaacaaaaaatgttgaaaaacttgagaagaaacattaaagccaaagtgaaaaggttgaattaatcctaggggaaaaaggagagggtatatacctggaaattgaaataaagggatgaaaaatgtttggatggacaaaacatggaaataaatagaaaagagactgcctatcgaatgtacattcaagagaatttctctcacaaatctgtcaaatgtaactacataattgtaatgaaattacaacataactagtatataactacacaattcgaat

SEQ ID NO: 101871 - DNA, 661 bp, Oryza sativa
aaacctgactttaattcttagatgcattatcatactaaaataacttttctatgtatattattatagtaattaaacttctctatatataccattcctagttgcccttaaggtattcgacaactaagctactagctagctagctcaatacgccatcagcgacaccgtccaggttgttgtgagaggggttgtgagatatttaactatttatcactctaagtggcaatctggcactaattcagccatgaattaaaaaattgccaattttcaccgtgagttcagtagtcaactttgcagttatcgtgaaccatgcattaatgtgtttgaattgcaatttgcaatttgcaaaggtcagctttgtcatagatagccagaaattccggctgcctctgctgcatcacaattactacttcatccgtactaaaataaaatataagtaattttgaaccgatgagatacttttcagactatgaatctagacatagagtatatattgtatttctagaaagtgtctcatctgttcaaaatcttttatattttaagataaaggaagtatattgctgtgccagcatcatcagcatgggtgttgtgcttgttggagtgatcatacaggagttgcaaattgcaactcaaatcgttaacaatagtacagaaccattgctta

SEQ ID NO: 101872 - DNA, 585 bp, Oryza sativa
ttgatcccttccaatgcccctaccgttacattttccatcatttcactgttacgtttggttgcaaatgtcctttttgcccttgatgatttaggtttaaatataagcttcaaaaacaattaaaaattttgtttgagtgtacagtatgtgcattttatacaactaaagagactaaataattagtgcataaaattttgacataaattttgaaaataaaataaatgcaataaattaaaatttttatttgaaattttaataggacaatggatttttttatcgggagcattcattaaaagaatgttgtgaacattggtagttctatttttatatgaatgctcctcacttttatgactttttttttaaaaaataaatatgtatttttttatttcattatctatcaatatttttgggaataaataatgcatcgaacaacaaactcataactataatagtcttatgcaagaagcttttatatttttaataatgtaattcatgaatttctttgttcatcgaagggtaaaatggtcatttttatagaaaatagacggtcaactaacggtgaactgacgggaggggtatggaagggat

SEQ ID NO: 101873 - DNA, 810 bp, Oryza sativa
agtgtactcactaccatggctagttactcctagtatcaagcatgaatactggcactctgatcacctctcgacgtcaatgtgttgcacatgccaaaagatcacgccttgcatgcacagctgattaaactaatcaaggcacgaacaggcacctaaccgggctcatctggatagctagagaccaccacccaccataccataccattccttccccccagcttgcgatttgttgcaatgcggcgccaggaccagcaaaagcatgcgcgataagcttagatgccgtgggaacagagcagtagtacttgcaacgcgttgcttttgttcatttccagatctctctctctctctctcactctctctctccttttcttttaaattttcttttttatcttctctattggcgagcatatccctgcaaaagtcactgtttccggcttcccacctgttgctgataagtttagcatatcatgtctacagctacgtgtgtcagtgtgtgcaatttgtgcatgcataccgccatgggcgcgcccatcagatagctccaggccaccacgagctttccctttccaatcaaacaacaaacatagggcaccccccgggacatgcatgcacctggggcaaaggtgcaggtagagagagagatcatcggtctcggcacacaacacgtcacgtctcgcggactgcacaaacgcatcagagaagctaaaggagaaaaagaagctgcagatggggaaatatctccattggttgtggttaattgacatttgacagatatgatgatggataatttcaaatgtttcttcttcttcttgt

SEQ ID NO: 101874 - DNA, 508 bp, Oryza sativa
cgagtattttcgttccaagtgccaggccccgaggacttcagaaaccaataatgtatttgccatgttcaatgtcaggttttcacaatgcgcacgctagtacggtgtgagcttgcaaacatttacccgttgtgcctgtttctgaaatcaaaatctagttatttgccccgtttggaaagtttatttgttggctcatattgcagcagaaccttattatttgctcgaagttggattcgggacttcacgtcttccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatat

SEQ ID NO: 101875 - DNA, 1282 bp, Oryza sativa
accctgcttcctttttcgtttccatctcgctcttttactcatgcaccgatgcatgcaaagacaagcagaggtccccttgattggggaatttgtactgatcttgtttcttaatcaaacctaaagggaaaaaaagaaaaaccctctccactgccgaatgctgatggaccctctttggatggcttcaaattttggactgtatagtagtagtggattctctactcgatctttctggattctttttttctgtgatggacattgggcagcgtttgctgttgattctactacagaatgaagtgctaacctaaagagattacagtacacagtaatttaccctacatttcctctcttattggagtgggaccgtgggactgatatacttgtacggtcttacggatgggtgtcgttttttggttttgcccatgcaggtttaagcagcagagagaagtcagcaggtcgtcacgttaaagtattcagctgtaccagcatcgctcaatcaaaagtccactattgacgacgagcttgactccaacggagcgctcttctccatgggagaaatattctttgcttttttatctagtgggcgcgcatctaaaacctaaacgatgggaatacagttcgcagccgcttttggcagccaaagagaagcgacgaggcagtagaaagaaagaggagatgcctcctatctcagctatcactcactgtgggcctgtggtcactggtcgcgacctcaagcaagcaagcaagcgacggagggcagggatggagggttaagtatcattcctgcacttgggcttcagctcacctcatctttattcttcacttccttgtcttcagatgcgtggtgtaattgactccctacttctaattatactttggtttgctgtgtgtcctttgcctaaacaaaggtagcacgctgtatggttcaattcatggaggaagattagaaagaaaaaggcagcagtgtccagtggatggtgaccagcaggaagctataggcagtagtgactagtgacgctgagcagcatcggctttctttcttcagactgcgctgtaaaatggactaaattgagctttcacccttctttgtcgaggctgatgttttccgtattctggccgtgctttcaatatgattgtcaaaacaaaaggtattgtttcccataacaggggaagctgtttcagatttttagttacacaaggaatagaccacacgattacacaagaactggccagctatatatatactcctatatatcttttggataatctgtccaatagggtgatg

SEQ ID NO: 101876 - DNA, 643 bp, Oryza sativa
attcctgcagccctggcttttaaactgctaataacatataaaagttttatccacatttttttttcattcatacgattaaagaagcaactacatcgatcaattgatctttttattcctatactaattgggaaccctctaagaaagctctcatatttagaaatgtctagtcgtgaattaaggctatgttctgttagctacttcgctagattattgttgcggattatttgctttatgtctctaaaaattaatttccttaaaaaactttcttctacagtatttcttggatctctcaaatgtatttatcaaaacaagaaagtttgggtggttaaagtaaaataaaaaaccaaaaatacctagcgaaaagtgaaaaaaaaataaaagatggtctagaatgaaactttggtaataaaagatagttcacagtgtaatttattcttcattttattttattttttagcagaaacactgtacggttcaatatattaaaaattaaaagaacaatttacagcatgtctatccaatcacataaagctgatctctcgtaatgatttacacgatgtagtaagagaggagtattcacttttaagaggacttccaagaaaacaaagagggtcttctattccaaaataggaataatatggcc

SEQ ID NO: 101877 - DNA, 668 bp, Oryza sativa
aaagttgggaactaaacccggcctaaaacatagtactttctatattaccaatcaaaccacggttcgaccgggcaaaccagtgatccgaccactaagggcccctttgattcaaaggaaattcataggaattttagaagattttatttctataggaatttttcctacaaagtcttttgaataaaagaaatgaaccttatggaatcctatgaaattcctatggaatgcctcttctcatacaagtttttgaggaattttaataagaggtagaaccttatggaagaaatcctttgagtcgttatatctcctcaaattcctgtgtttttcctgtggtctaatcaaacggtcattcctatattttttctgtgttttgcaatcttctattttacacttttatttatgtcagaatcatatatttttcctattcctgcattttttcattcctgtgattcaaagggaccctaaaccaattaaccaagagctttaccggttcatttaccggtccggtcttttaacaactactactagtacgtacgtatccatccctcgatcaaatccagtgatgcaccgaacccgcgacaagaattcactcaccagtcaccacatctcatttcctcgtgctgcttccacccctccctcgtcgccttgccagttgccagtttgccaccctt

SEQ ID NO: 101878 - DNA, 790 bp, Oryza sativa
tagttgtagtagatagcacactgttcttgtggttgaacataactagtgtagtgatctgatgggctgaaatgtatattctgacttcagttccctgactgtaatctagcgctggcgagctaattaaagaacgcataggctcagctagcatagtttgattaagaagcgctcttctgacttttgacagtggactctgttttcttgtagttaaacgagacttggaacattttttttcctagttttgagatatagcacatgagattagtaggcactagtaaagaaagacaagccaaggatcctaagagataatctgctggtgtttggactttggacagctacacatgatgatatggacatgcaccaaactatacactagtacttgtgcgtgtgaagtacatgtatccgccactaccagctaaactagctagtgagccaagttagtgcgtcacgcgagaaacaatcgaaaacgtgacagtcacaacaatatggtaatgttaatgtactcggaagtgccaatctatggagcaaaatgtagctagctgttgttgcaacgattgcattggacgcatctacctactatcgtagaaccaaagcagttttagttaagatttcccatgacgcattcactcgtccaggtactagtacatgtttatttcctcgtggtgcaactagctagggccaacgaggcgaacgtgaacttggtaactaaccattaatttgtacatgtgagacggttctcttgataaatcagagtcagattcaaacagtgtaaacactgtaggctcgttcgtcc

SEQ ID NO: 101879 - DNA, 716 bp, Oryza sativa
agatatgttggatattatgttattttgtttctgtttgcttgattatccggtacttttaaggggtgaatgtaacagatgaatagatggctaggaaagagataaattttcctttcttttagctctgattgttaagaattcatccatttatcaatttgataattagtttttgcaggaaaaaggactggttatgttcttttgtaggacgtgcacttttcatacaaccattcacatttgttaccaatatgtgttccgtacacttttttctaacacttctgtttaattgtgatgttgcctatttatttcatccgtacatgcaggttccattatactgtacccataaaactttgcctggaatgtaatatcttgaagtacttgcttcccaatgaggtctgtatatcacccacgattttagctaggtattaacctttttgagttcaatcttctatacggttcactctatggaccatcttccaattggtgtatttttttttatgttacaaattacccttcatgattcctaactatacgagaccttgttcggtttggaggggattgaggaggaatgattccacaccagaattgttatgaaataaatctcctccaatatatctctttggccttattcagtttggagggtattaagggagaataaatccacagtacaatagatgtgaaatagatcccctccaatccctcactcttagggataataatcg

SEQ ID NO: 101880 - DNA, 673 bp, Oryza sativa
caaaatataagaatttagaatcggatggaacattttatagtagtatgaatatgaatagatccggtcttaggttcttatattttgagggacggagagagtagttaattataagaaaatatgtcgctctgttttgtgtgtgcgggagccgaacatagcctaattaagcaatgcagccatgggtgatgttgatgaactctatttactactatcttatcctagaatataaaaatttgtagagttgaacatgctactatgaaagtaagtagaattaaatgagagaagattgtgattggttgaaaaatggaagtaagtgaagaaattgaacggtggaaggtataattggttcgaaagagaatgttgatagaaaagttattatattttagaacaatttctaaaaaccaaaacttactatattttataacggagggaataattactaccttcttacatgatcattgtcgatgtcattataacctcctaacttaattttatgcgatgtccctaatgttgatgctaattttcggaagtcaccaatcaagaggtgcaaagtatgccctgagacggatgctgggcctagatacttggggtatatttttgtttaaagacgagaatgcatgtggacaacttataaattttgagggtcgttgtcggatatatgggcccggggatatgc

SEQ ID NO: 101881 - DNA, 531 bp, Oryza sativa
tgttgtcggttgcttgtcacccttttctatgaggggaatgaattcgtcagccggctaacgatcgctttcaggctttcactctctccactccagtccaaatctagcaacaagacaaccccaagtttcatgcacctccgctgggataagccacctagctctccccgtcacacacacacactgggagtacttcaaatgttttcatgtgagctgatctgataagggaaggcaacagattgtctcttctgtttggaaaattccaagcgcttcagtacactaaaggcagtctcaacccataatgtctataagcaatgtctatagtgccatatcaataagacatcacaatataaactacaatctacaacccatggtttcttaaagtgggccattaataaatacatcatctcacttctctactaatcatatttattcttcatctattatgaagacactattctttcccaatgcaaaacttgatagtatctagtggataggttctcatgttgaagctgtgtcttgtatgagacccagttt

SEQ ID NO: 101882 - DNA, 1077 bp, Oryza sativa
aagtaagttctctttttatactccctccgtgctataatacaagagattttaggtggatgtgacacattataatacaataaatctgaactacatctaattaaaattctatatattattaaacgcagggattataacgcactagccgtcctagccgagctagaggagtcgtggagtggggcaaggaacggcagggttttggcgtcaagtgcaggcggcgtcacggctggggtcacacacgtactcacgcgccgtgaagactggtaaaacccagcttccagccgcaagacggatggacggacggacggaggttgacagcgactacctagtacgacgagtggtaggggcataggcattgctgggttcgatccctaaacatcactgagatccgcagcaggggatcacgagtgcgcgcgagccaggaagagaccatcatatatacgggagtaattccattctttttatttaaaaataaggggaatgccaccagacgataaacgatgtctcttctaaggtattgcctgatacctgatatcatcccggctaatatctaccaggtatcacgtgatacctcaaaggtatcatcccgtccaaacaggtatcaaccgatacctacctaccagatattaggggataccttaaagatatcgtcccgtccgaatagaatatcattttgtagtattttactttcaataatagaatcattaatttatttataaaagttttcagattatttaaaacttttatgtaaacattaaaaaataaatcatgcttaaaagtatttcataataaataaatccataataaattaaattaaatttattttttaaaaaaatatgacaaatgattaagcatataaaaggtcaacaatgtctgatatactactttctttttttaatatgtgatgttttaactttttacatcatgtttgatcatttgttttattaaaaaatggaagtacacatttttcttttgttgtagcttgatttattattaaatgaacttaaagcatatttttaagatttcctcaaaattttaaatgaaacacacgatcaaagcttgtaataaaattttatggtg

SEQ ID NO: 101883 - DNA, 636 bp, Oryza sativa
tttccatgtgatttcgcctctatagtacggtgattcttgacctcggaattcgtgagggtactattcagtctcggtgcacacagcggatgatcgtgggaatgcaaagctagcaaactgctctgtcacatgccagcaatgtcatcccaagtattgcatcaacaaacactcccacatttctttcacgtgatcctagcgtaacgagccgcggaccgtcgtttctggaaccacctgtttaaatatagataaaaaaaaaactaattacacagtttagatgtaaatcacgagacaaatcttttgagtctaaggggggtgtttgggagagaggggctaaactaaacataagtctctaaggagggacttatacttttgtgagagggactaatgtttagtccctagttcctaaacaccccttaattaggccatgattaaacataaatgctacaataacccacatgtgctaatggcggattaattcggctcaaaagattcatctcgcggtttccaggcgagttataaaatttgctttttttattcgtgtccaaaaacttcttccaacatccggttaaacgtctgatgtgacactcaaagattttcatttcaccaactaaacagcccctcctaagcaggtaaacgtgc

SEQ ID NO: 101884 - DNA, 622 bp, Oryza sativa
catgagagtaggtgggggtggcaaattcactaccgccaccactatacccccctccatcccacagaaaacaaatctagaacgagatgtaacatattctagtacaacgaatctagataaagatatatccagatttacagtactatgatgtgtcatatctagtattagtttggttttttagatacagaaggagtagataataaaaataattttgttagaaatgaaattatattcggtctctgcaaacagccaagaaatatcatgatgttatttttacagcaactcacttaaataaaagcaagataatctctactattataaaaattgaagatatttttaccggtattttgataagtcatccatatttaagttggttttttaagtttgttcgattttgaaaatacaaacggattttaagttctattgcttttgaaaatacaaatggagtcgtacaataaatctctttttaaaaaactcacatactaacttgagataaaagtcggactcctaattgtaacctataattttctaaaaaaatatccaaacgaatttcaacagtgaatttcaccctagctataccgtataacaataataagattaaagtagagttcacccgttgcaatgc

SEQ ID NO: 101885 - DNA, 879 bp, Oryza sativa
tagataataaagtaagtcacaaataaaataaataatatttttttaaaaaaaataaataagacgagtggtcaaacgttgcaagcaaaaattcaaaatcccatatattatgggacggaggaggtactaactacgataaaaacgtactctagatgcgtacttcctccgtttcacaatgtaagtcattctagtatttttcacattcatattaatgctaataaatataaacatatatatttatatatgtctagatttattaacatcaatataaatatggaaaatgctaaaataatttatattgtaaaacggagggagtaacaaactatcatatgctctacgcgcacacatcttgttggtggcatacccaatccctagtggagtgtggaatgcattaatttgttcactgaactacgccgcgtatatatgtaatcgtaatgaagattagtgggaaacaacacaaagtctagaccttgacaccggggatggacattaatctcaccccttgacgtacgaccactacaaattagtaagaggtaacggtcaaggcacatgttagatcgatatagtgtttatatcctcaacgacaggtaaaaatgaaatgatgtgcgaaacaacgagaactaaacgttgcggtttactggaactattataaaaacgatatttcttttactatcgagatcacgtacgaaaataagtctattttttagacagacttattaagagattgtatgaaaaattaaatagattttttcatgccggcaacttggagcagcaagcaagtgggccctacgcatccccgcactattttttctcccacacctttttttttctcctccttatctccaccgtatcactcttttttttctctcttcttctccaaaa

SEQ ID NO: 101886 - DNA, 2028 bp, Oryza sativa
tatctcttgcttctttctgttggcgatgctataggcggcaagcgtagtatcagtaggagaggagggagacgaagggggaggagggatatataggaacggtgggtggggggtgtgggtgggtggtttggcttgcgatagatgccggaatgtgtttgtgtatgggggcaatgggggctaccatactgcgccccctatacggctataccatgtccgcgtggagggaaggaggaggaagctgatggtttgctatactacttttgttctggtgtgtgtgtgtgtgtgttttttatcttttcctcttttcggtggctggaaccgtataaaaaatgccctgctgttgtgttggactttggatagaacgacgtcacggcacaggggagatgagggagggagtggcaagtgttggtttgtgggggcagtcagctcagcccatggataccgcgggatggcttcatcgagagctggtagctggataaagatggaggatagattgttcttgttgctctggtgatgtgagctggcttggcctggaaaatgtgcccttgggggcagctcgccatgtcacacttggcccctttctgtgttcttttttcttcttctttttattgggtttgctttggcagttgctttgatcaaagcaatggctgcattagtgttgcttaaatatccatggtttattctgttcgggtggatatatattgcgtgtgatgacctgtgcattgtggagtgttctgttgtgccatgcatggactagtatgcgtcttttctggaaattttggaggaatcaggtgggatattgcgtcaacaggggaattctttggtcctagtgagtgtgatagaaacaaggaactggaaagtggaaacaccatgtaaaagtatactgggacatgttttgtaccatatgacagaaagaaaagtatagctttattacatgatgccaaaagaactgaggcacaaatttagcgtggaaaaacttttggaaagtaaaaaccatgaacacaaatatacaattaattgaaatcagttatgcgtatggtgaccaaggtagcaatggtgtatgtagtaataaatcatgaaaaagatgatgccctagtgctatctttggtttcaaatatactttgtccccatatatataaagattatattatgcaaaaaaccttcatatagttagatttttaaaaatataaataggcccacatctagataagtgcaaggtaaagagatggcataggcctccaaaaactagggcccctaaaatttgtgtttcaatcaatgctaatataacattaaagggttctgatccattatttcaagttccactctttctccttcactcagagccccatcagttagcctaatacgccaaagcaaaagtcaagatttgaattttgaacttcattttaaagttgattttaagatattttcaacgtaatttatttttagtattgtcttttaatttgctgcaaataaagatgttttggtttattatgaaatatgagcaactaatgaggctctcattcggttggaaaatgtcttactttccttagctccgactttgatgatatcatctcaaaattgtatccataatggtaatataaacgtgcgttgccagcactggagattttatttttccacttgtaaataaaactaaaatgttcatcatgatgcagttcttggttcacgcacttggtcagagcgccatcgccattatctgagcgtccagccattgttgtacgtccgtgcacgattcctacatgcatcttcagtagcagtgcataatatagctagagagagaagcacgttagatttgattgctaactctgctgttatggatataaccacaaacgacaacaacgcggactcaacaaagagcaatggggatggagctcctctatgttatcttgatacggggatatggatacgcgatacggagatacgaggatacggcatttcctagaaaacactgatacggggatacgtttatatatatttaaaaaataaaaaatatagaaagaaaacataaataac

SEQ ID NO: 101887 - DNA, 563 bp, Oryza sativa
aatactactactattctttatctgttgcccatcaagaagacgcaccaagtctccggtttagaccccccaagtcttcccccccgcgcaacagcactccggttttagtaatgcatacgccgcagttttaaattgcctcattaactttgtagtggtaccttgcttcccccactggcacactacctagctggatcggggtatacatccaacagtggcatatatctggtgtgtgttgtgttgttttcagtttacacaggagtattaaaatcccacgagacgagaggagagatagcacagctaacacactcatcactagcagccgcgcgcgtgagagagaaactatggagagcggaggccgcgcatgcgccacgcaagttgcaacgtgcaagtcgccgctgcaattactctactggttcgtagcgagtccacttgcgcgcgtcgcggtcgcggcggccatatcgctcgcgccccggttgctgcttggctttggcattggcatacgcattctctctcaaagtacgcccgcgtcgcaacaaatctggccaaatttctcgcgctgttgtttt

SEQ ID NO: 101888 - DNA, 543 bp, Oryza sativa
acaccgatcaaagataagtaattttacttatcatccatttaaatatgctactagttatttctcgtaaacaagcgatttattaatatatttacatttctcgatgcctatatagccaatattgtgtggaagaatggagagtcacgcattaaattccggaaaatctgcgcgagttaagcaaatagcgcgcactttttttatcgagaaaggactcgtcgtttgtgttttttctgttaggcccgcatctttttcccttttttttcacgttttgtttttttagttattttctatttttgtgttattactttgaactcaaaattttaaacttttaactgatatttgaatactttcaattcaaatttgaaacgttttcaatccatatttgaaaactttcatctcaaatttaaaaactttccactcaaaatttgaaactttcaatctagatttgaaaattttcaacccagatttaaaaacttttaactcaaaatttaaattttttaaagtcaaattttggaactttcaacttttcatcttacatttgaaaaa

SEQ ID NO: 101889 - DNA, 858 bp, Oryza sativa
cgatacacatatgtgccggttcataaaaaccgttacatatgatactgccgtagttataggtgcgagtttattataagaaccaatatctatgtgatgttcataggtatcggtttattatgagaaccagcatatatgatttttgaggaatattggtaccggattttattataaacatgtaccaactaactcagtcaatgagttgttataggtaccggttcttaattttacactgaaatatgatggaaaaaatgttataggtgtcggtttaaagcaaatcggcatgtataaggttaaggttggtctctatgggggtgttttggagtagctgtgtggtataaatttgcttgaaccaaagcagaaacacgatatactctgggtgcaattcctgtgtgcacaaagcgttgatcaaggagtctcctggtacataagcttgggtggacttagcagtttcaacgtgaaattgaattggcatgatcagtcagagccgatgctttactctgcacgtgctgctcgtcgcgattgctgctcgtcaaatcggagtcgatcagtcgactccttgtcggcgtttgatgcgaagccaaatctcgctaaacaattgacgacgatgatgaagacggccggcggcccggatgggcctatttggtatgggattggtccaaatctaaaatttagttctagagttatgtttggataaagccgtagagcaatttaaatccaactctatctttctttctagtttattttgtgaaattattttactcagtttcgtttttattttaggtggaggtgaaactgtttagttaggctctaactctagtagaggtggagctgaaattgtgccaaatagggctgcaggaa

SEQ ID NO: 101890 - DNA, 512 bp, Oryza sativa
tatgttacaaaactgccctggattggatcgaggagggtaatttgtccggtattaaaagttcagggtgaacgatatctagttttctggtttagggggtaattcggtcaaccgcgatagttcggagggataattcgtattttttgcttaaatatagcatccacctcccactagactggctgactggggaactcccttctaacgcaccttctcccaaccccgcgcctacaccctaagtgcatgcttaatgaaaggcttggtggagtctgatatggaacttgttataaaagttagccgatatagcggaacgacgactaaccttcctgatcgcttcaatcattgatcacccaagacacgccagatgacgacacaggaacacacgatatttgttaatgaggttcagctgaagcctacatccccggggctctgattatgggcgctcctccccaaccaatatagctcctagccgctacgagtccatggccacactgccatcatatccctgcatgtctaca

SEQ ID NO: 101891 - DNA, 646 bp, Oryza sativa
atacagacggaagacgtgacatagtttccaacccatcctagcaatagacaagagtaccgacccaatcccacctacggccggaaccccttgaacaggcaggcaggactgagcccctaacagcaggacaccggccctgtgccacaacatctcaactaccgggccgcagttcgtgcctgccgtcaagcgcctgtggtcgtcgccctagtcttccgctgttcctcgttggtctttgtgtgtgctgggccttcgttgcccatgtaataaattatctattaacgcttccgtttgttaaactctgaaatgtatcaactcttggtgtaccttgcctcctgggacaaggaatattacacgcccaaaaggaacgcccggtgggttaattccggttgagacagttccatgatcctcatagcggacctggtacgcccccccaattcaaaaacctaggggagtgggaaagggaacatgctgtggaataaaaggtttatttgtcgcggggaaacttgtaacattacaaacactatacattctatgaaatttgataaaatgagatgtttgaaacaaagctcggtcaatttttggctaattttccatatattctcccgtgcggtcaaattataccgactgcacgggataataggttatcata

SEQ ID NO: 101892 - DNA, 581 bp, Oryza sativa
tgtgtgcatggtgtgtgcccaatactttagaaatttctttattcacagcatataagcttctttatagctattttattttcaatgatgtagtcaactttaggttgcgcgcatcatattttacaaagcagttggtatatcactcggatcatgttatttattccttgactatgcttggtttgttcaagtaaccacgtagtcggggctacacctattaggtacatctagtcgatgcacctaaattttcatttaattatttttcagccctccacagtcttctgatttggtaaaagtactcaggagacaatggcgaagatgattgaaacactcggctttggagtaatctagttcgagagaagattatcttttcgactgtgaaggtctcaagggctactgtggagattataggtaccccatacccacacgacatggtaatccgactagttataggggataacttatatctatggaatatgtaacagatcatgacttgggtattacgtttccttgtatattatggaacggccttaagtcttggtttgataatattgtaaagtagatttaagaaaccgatatcggattgg

SEQ ID NO: 101893 - DNA, 649 bp, Oryza sativa
agtgaggatcactgcagtaacctcccaaaaagcgtggggctctgcattcgtcaccctcctgctccggaagcgggcctgccctggtagtccactccatgcggataccccagggcaccgcacataccccgcagctccaagacaaaccagtcatgtccagaccacgacgactgacgctgccggccatctacaaacaaaaacaaaaagaaaagcaccatttaaaagtcagattttggcgataaatgaagcagcaggacagagagagactagagagttttcacaaatagcaaaggatttttatttttgataatattgctaaggcttgggatctacggctcgtcctagggtcaagggggctctgataccaacttgtcacgaccggaattaacccaacgggcgttcctttcgtgcgtgtattattccttgtcccaggaggcaaggtacaccaagagttcatacaattcagagtttaacaagcggaagcgtaaatagataatttattacatgggcgacgaaggcccagcacacacaaagacaaacgagaaacagcggaagactagggcgacgacaacaggcgcttgacggcaggcacgagctagacaccaaagccttcatcatccaggggctcctcttctgggttgggaaaaattga

SEQ ID NO: 101894 - DNA, 680 bp, Oryza sativa
atcattgaatctcttaattttgaaattgctagataaaatctcttattcctaatgatgatgattgcaaaagttttgaggttttaatgaatgagatttcaaatattagagatgttaatgttgcacatgatttgaaaaataaatcttctcttgctcttagttttgctttgcacacacgcacttcggatgagttgtttttaactaaaaagttgttgcaaaaatatcaaattgattttcatgctagtttgatgtttaacatgatttctgctaaaaagttaaaacaacctcatgatgttttgaattgctcaacatgtaatttgaataagatgaaattgaaagatgctttaggtcgtgttgagtacatggaagatgttgtgaaaaacaatgaagtgctttcttgccccaaatatcttaaaagcaaaggtgtcatggtatattgtgaaaattgtgctaatttggaaaaagaggtttcttatttgaaaaattctttgcttagattttttgatagtaaaaagaacctcaactgattttagatcaatctaaggtttgcacaaataatcgtggtttaggttttaatccttatgctcataattctagacatcctcctgttgtgttaggtgctggtgctagaggtggtgagattttggttaaacctgatactaacaaagctgtgtttaaatctg

SEQ ID NO: 101895 - DNA, 615 bp, Oryza sativa
tgctgcaactttatcactatatttctgtatcaagcacacatgcatagtttcttttacattttagtatacacttctgtactggggttctgcgatacatggggattgcaccccaaagtatgatatgaagaatagcttctcatataaagtgatttggggtaacgcatgttccatatcttcatgtgtatgagtgcaccatttgttgtcatctgggatagcgcctatgtttttatttaattttatagaaatgagaatcaccaagatggcaatgctgcactatgagataaattgctacttttattttacagaacatttatgaattttgttgacatggcataggtttaacttataaatacgttagaaatcattttaatgcactgtatactgggctttgtgtacctttgaaatattttgatctgaatattcttttcagccaaccctattaaatgaatattttcttgtgaaggcttctagtgctaagtagagtgtatccagcatgatttttgtttattgattctgtgcgtacttaaaacccatgaatccacaagcaatatcactcaaatattggtctgttatacatctgtatgcccacctaccgaggttgtgattttactgtct

SEQ ID NO: 101896 - DNA, 501 bp, Oryza sativa
gtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaaaccacaactgcagttcatagggtccacgtctaactactggagttactcataaattcatatcca

SEQ ID NO: 101897 - DNA, 527 bp, Oryza sativa
ttatgcgctgcccctatggggagatcaggcggaggacaaaattcaggaccaagatcttgatcacaccccccacacaaccttcaataaggctgggagagctcttgtgtcattgatatttgtgtaccataagcgacctatggtatactctctcaatcaaattgatctacatactcgatacgtacaccatgaccaaatagagctgataactctatcatattttatttactctagcaacaaacccaaagcatgcaccatcctcactatttcctatccaatagcaaatgaagatattgcacgcgggttataaacacttgagtgcatggatgcatgcatcaatgcacatttactccaatggacaattcactaatacacttaataaacccacacaaatatgtacatcatttaagaataaccttaaaaaaaactatctgcagatcaatttggaatggagggagtatctaacatcttaatctattggagaatgccataaataacttcggaggaaacgatcacatctattactccct

SEQ ID NO: 101898 - DNA, 617 bp, Oryza sativa
gcagttcagttgttcggctgccgccacccctgttgccaggctccctacgaaggccacgagcctgttggaacaaatcatgacttgcatatgtctttggtttttgcattagttgcatgtagagaggaacgtgatatgttcatgtatctgtaagtgatgtgtatgtgtgcatcacgtaggttccatgtttgcatgtagaatcagtcagtgctagtgaatggcagctgcgtgtgttgcagcacaactagcaactaaacaggttaggtgaataacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttct

SEQ ID NO: 101899 - DNA, 681 bp, Oryza sativa
tctgctaacttcagagttggggagatatcataggggttcacctggaggggttatcaaattttagcattcggtgaaatcgtcattgtcttctttcgacagtgaggttacaattggcagcgttctggtacacacattgtaatttacaaggtcaccttaaaaggtttcctttcatgtaacgtgttttaggcgagagctaggcagctagcatagtgaggattcatgataggacaagtgcctcacaattttgttggtgagaaatttatcacatatgtttatgtatctcttgtggcctgagtttttggagctcttctcgttgaacttgtgttggcaacttgaaatgttgtcatttaaagctcctcaaagtcgcctttctaaggctgatttcatttttggatgttcccaacttacgttttttgttcgcacggtttccaaactgttaaactgtatttttttctaaactaagttataggaaagttgtttaaaaaattatattaattcattcttaaattgttttaactaatacttaatcagccatgaactaatctgttttgttttctgtgcatgggatcagttcccaatccactccaaagaacacatctctaaattttcatgacatggtaccatactacaaatacatcgcaatggcttgttttgatgtaacagtagaaatttaaatgaatt

SEQ ID NO: 101900 - DNA, 537 bp, Oryza sativa
ccccccccccggcgcgcgaccaccaccactagtactacagtactactatattagctagtagtctactactatagtactataactactacttatactactattactagtactactactagtatactactataaaaaaatatataattttatatgtatattttttatgtataaaaaaatacacacatacaaactttatatatgatgtgtacaaactttgtatacaacgtgtataaactttatatatgatatatacagactttatataacgtgtacaaactttgtatacgtacatattaaaaaaatcaaaaaaactaaaaaaaacatcacgtatattcgtatacacatatacaaactttatgtacacgtatacaaactttgtatacctgtgtataaactttatatatgtgtatacaaactttgtatacgtacatataaaaataaaaaaatacacgtatataaagtttatatacatgcatataaactttatgtacacgtatacaaactttatatacacgtatataaactttataaaacgaa

SEQ ID NO: 101901 - DNA, 612 bp, Oryza sativa
tctagttaagtactccctagatgctctgcagtgcatgaaatcatttcattcacttgtgaccaatggtaggccccggttaaagaggatcatgtagtactgtggaagtgctgttcttatgtaggagtaccaaccatgatgaataataatagtattggctgaaacctagctttgttgcatcagcaaccacctgtgtggtcacaatactgaagcaaccctgaccaagtgtatataaatttatgaagtagagtatatggagtatgtagcgatgtttcgtcttccctctaaggattagggctcctttggaacaaagggaaaattgagggattttagggcttattcggttcgtaggatttccaaatcaaaagaataggaaaaataaaggattagaatgtcgcgtgcactccattacttaggaatttttcgaagaggtctcatctaatgctaaaaatcttatggaattaacttgtaagactacaatccttaggaattcgataagatctattactataaaacgaatgatgcgcataggaaaaaaatcctaaggattcaattcctacaataatcctctaaaccgaatgagccctaagaggattgaaatccattggaaataat

SEQ ID NO: 101902 - DNA, 701 bp, Oryza sativa
tttgcagaaaaatgcaccgtttagtagtttgaaaagcgtgctaacggaaaacgaggagaatctaatcctactagcctgaaaagaacgcagccttgagaggagaaaagaatccaaattgatgctgacggaagatgaacaaatgcaagtaggcaatcatcatcagacactaaaactgaaagatttacctgctccaaacattttttttcctgacatgtaactctgatggagaaagtgaacacacacgcctctccaaattctctcaagcgtagcagagcaaaaaggcccacgaaagccagagaaaattggtatcacggactgaaactccgaacccctggatcagcatgagcaagccacgttatcttctgcgatgcgccattcgacggcgaacttggcaccggcggtgcttaccggcgacagcaagcacggcaaagtaacccaacaggatgtagttaaggatttcaagaactaattaagtgcgtgccaattgaaacttcaaatgctaaaccactgtcaatatttaaacctttttgaaacaataacttaactaggaacatgcagacaactagtttagccataagtcaatctagtaccagactaccctgcagtgtcatgttgagtgtgtcactgtgacgccccagcaaaaaaaaaaaagaatgaaagcaaaaaagaaagggcaaagcagcagcagcagcggcccataa

SEQ ID NO: 101903 - DNA, 648 bp, Oryza sativa
atccccgattttgatctatacccattctttacccccatctttctaacttctactcacttgttttatacgcacatccttctcaaaccactaaagggcgtgttttttttaagaatatatagaaaaattactttaaaaattatagtaatctattttcaggttttttaaactaatacttaattaattatgcgccaatgtataatacttaattaattatgcgccaatgtatatttcattttacatgatggagagaaggggttccgaacacaactttaattgtccgacaccaattatttttcttggttgtccaagtactctggctttccattctaaaatataaaatataaagacactattatttttctccatgtcttataatatatggcacgcagtcatgtatatagtactaactagctcatttaaatttgctttgttttaaatcatctaccatcaaacttccaatcacataattatttacatgtttcgaggtgatccaattgatgaggtgattaaatttactttttgtttttgtgttagtggtggttattttttatattttgggataaaaggagtatttgttttttttttgaaaaaaaatacactctagatccaggggcttagcccccgggtacttttgttatagccaaccat

SEQ ID NO: 101904 - DNA, 637 bp, Oryza sativa
tgatattatcgttactagtttaaaaaaacttaggttccatgaatatctcacgtttggccggagctatctagaggtttaggccctgtttctttcagcttgggattattataatctagattattgagtcagattactataagctagattgttataatctgtagtagaataagcggttagttgtttctttcctagattattagagcctagattattgggtttgcaagtctaaagagggagtggggtggtattgtgggtaatttttcacccaataatctggaaaaagctcacctaaatgagcttatcagattataataagctgggttccagattataataagctacttcaataagttgtctgtttcttaatcccaagctgaaagaaacagggccttatatatgttctcttttagaaaagtttgtcatttttagccttttaaagtccatatatataaacgaacttttttttactacataattataatcagcttttgtttaattaacaaatttagctacaccccaaaacctatgttacaatgacactcttttgtaactgtggagagagaatattaactacctccgctctaaaaaaggtaaagtttttatgtattattatcagatgacaatatcttaaatcatt

SEQ ID NO: 101905 - DNA, 733 bp, Oryza sativa
agtttatatacaattctactcatttttcaagttcttacactaaatcgcacgcatctacaccaagttcttgtaccgtgggtgcaatttactccattctctttgtcaccttggtagcctaattttgaattttaaattactaacattcccctttcaaacgcctgattaactgaaaatgaatgaatttctgtatattcaattgttttgaaatacttgaactgtggtaagtaaattgtagagatgcttatagttagaacagatggaataggtttgttgtactctcttcggtccaaaacaatgttagacctttcaaaattaatgaaatgcaactttcaccacctaattctttcacataaattaaaagttattacatcaatcaataaatatataatgttacgaaagcttttataacaaacacctgaccatgttgcggactaagctagttggtttccttatagttgaaattgcacatcggggtttaagtgattccaagagtacgggtgcttaaatttacagataattattctttaacaagactttgttaccctcaatatgtacgtgttggtccaatctaagaaagcgtgaggttaactcatgatatgtcgattaactattaactcgcgaggttctcaacatatgccagccaactcttcatttttttttcgttgtaggttatgataatctcgacatatactggtccaatgatgctaatctcttaaaatgtgctattagaaat

SEQ ID NO: 101906 - DNA, 1010 bp, Oryza sativa
ccaaaagtagaagtaaaaagggtggcgatgcgccgaattgcattgatcgtgaagatagattacatagaccccgggtgtacatatttatacccatgggttgatacaagtccttgtcggacaagaaagaaactaacctaaagaaaaaagaaaaataaaaagtccttatcagacactaaacatactttcctaaagataaaaggaaactaacaaactattcctaattaatagataaactgccatgccgcatcctctttaaactcggtcacttagggataagcttcctttagtagattgatttccttaaccgaatatagcaggaatccgactactgatgacttgacaattcacatcagctaatctcaggacttcgaagccgatgctgactctcagccgatgactactccgggcttaccaaatttcactgttaacagtgcgaggcgtggcggagcgcgccgggaggcggtggcggcagggcacagcggcgacggcagcggggctgcgcggcgacgacgcgcggcgtagagggccgcggtcggcggtgccccgtgcggcgggctgatgccgcacggtctaatgccgtgccggtgcctgccgtcccggttctcctccgtgcgcagccggggccatggcagcgagcctcgacctcgcgcggcccacgggaagcaggcgcgaggccggtccaggacgacggcgaggactccaccgagcgcgcgggcgagctgatgccacgcgcggcgacgacagtgagggtcgtaatgtcggtatgttatttgctaatccgccgggaatttttacggttcttatttggggaatttctcaaattagggttttgaaattttggggaaaatttggggattgttactatccgccgaaattcacctccttctaattgctacccaagccttaaatgattaaacaacataaacatgaactaattggccttgagcagtggtaaataagccttaatcttggcctaattaattattaacagaacactaaacatgaggaaa

SEQ ID NO: 101907 - DNA, 601 bp, Oryza sativa
cttccgtggagcgtggggctcaaggcatggttaaccttccttcccaaccaggtgaggagcccacaattcgacccgaggtgcgtcgagtgggcccatgaggtagacctcccgcgttccaccgttaatgtcgaagagaggtcaaaaaacaaaaagagaatctctctttatatcacctatcaacacatgctagccaaaagaaatgtcatgattttatgcacgtattgtgtatatgaaatgaacagttaaaataagaggttaagaatctaaactcagacgctgtccatatgcgccgattcatcatgggcatcttttcttcttcgcagggcataggctccgactttaagatagatcatcttaatacctgatcgcagccctaatcgtaatgtatgcaaactatttctataagggcgcatctattatacagcagtaatggtataaccccccatttcaaatgctcatgagtcacctcactctcccactccatgcgagcacgcaactcctgacacgtgagcgcttgacacacgccatatgcatccattatgggtcgagccatcttgatatgtctttatcgggctgaacagtctagtcaactttggttgga

SEQ ID NO: 101908 - DNA, 571 bp, Oryza sativa
gctccacccgcgccggtccaaaaccgggagccagagctctcgctcccgcttctctccctccccgaaacgacatgatcaagctcctctttcccccttctttttctctttttccaacctcagccaccgcacctccactgccgtttggccgctagctccgagcacaaccgccagctcgctccccttgatcgccccaatgccggttccttctcctcgacgccccaccccgcgcctataaaacagcagtcgccccgtattcggtgtgtttgaaaataaatgaattatgaaaactcgcgatacgggggttgtgcctgcgtggcgttgtcccgtattcgcatataaggatcgattcctgtgggaaactcatcaagcataacaaagtgcaaccacaaggtggtatgggacaccctagctaagtaactagtcggttcagggaaacctcgcatgccaatagttgggaacgcgggggtggggtcggttggagccaacccgggttcctggtaaggcaagaacgcgaagcttgccagattaccgatcgaggtggttggagtttgatttgtgaaaactaaatggc

SEQ ID NO: 101909 - DNA, 641 bp, Oryza sativa
ccgttggtatctgtgtccaacgtttgaccgttcatcttatttgaaaaattagaaaaagtagtcacgcataaagtaccattcatgttttattatctaataacaataaaaatattaattataaaagattatcaaataaaacaaatagtcaaacatatataaatatgaacaatgtaaaattatatttattttaggacggagggagtgctgtactgtcctagtagatttgatttatacgggacgaatggagtacgtgcagctttgcttgttctgtccaaattacatcgtgaattattacgcaggaggactcgttgattgcgaactcacggcacatccggcggtcgccacagtgccgtacggctgggttggccgaccaccgaaaggtgcgggaaggagagctgtctgcgttctactccggtactcacccgacaaaaaccaaacttagtattaaatgagatattttctgctataatgaatttagatatgagtctatccacatttattttactaagaagaatcttatacaattactagattgatttttcatgggacagataaagtattccttatttattttactaagaagaatcttatacaattactaaaatgatttttcatgggacagataaagtattccttatgtc

SEQ ID NO: 101910 - DNA, 725 bp, Oryza sativa
agttgagtacaactccaccgggtgaattttatcaaatccatggcatctattgcttctatggctgagatgaagccatctattgcttcctatggtttgaatgggaattactttatttttttattatgttagtaatggttaagtttctgcctaccaaattaacaaagtatacatgttctcttctttcccaaacacaagaagctacattcatgtaaaaaaaaaagtgttaaccgcatagtacatgcaaacacacataaaccatatacatgcaaaactagaggcacgtgctcagtacggtgtttacaccatggattaatcaaagaatttctgggttatgcaagtaaaattagcttgtatattctcaaattgtctaaatatattgtagacggtgatttgttattgttacaagattaggataaattctttttttttcaaaagagactagtgggaagtgggaactaatggcttcatcccaaccgtcgataaaaaagagaccgtagagattctatcaaatccaccgatggagttggagtgactccaggggatccagacccattgcacatgcccttatacaatagagggatcatgttcgtagtaatgtacatatcatatcttactataaagttatctcccactaactcgttaagcttaacatgcaaagatgccacatcatatcatccactaacaagatgtcacattatcatccactaatccactaattaacaaga

SEQ ID NO: 101911 - DNA, 790 bp, Oryza sativa
  unsure (1)..(790): unsure at all n locations
cgcgtgtttgattatcataactcaatcngcatgcccgcaagtctactctagaggatccccatgctctatcagttctgccaatcttgtttaattcgtgcattgcaaacgtaacaaagttaaaagattcagttttccccatttgtttatttcaatctgttataggtagggataatcctaatgctaaaattagctcatgataccctctgatatgcaggcatcccttcggcaaatgtggtgatggaccgaccacaagatcctttcaactcacgaggtatcatgacatgtactccaccttccaggtaaacggtgttttgctctggtaaactggatcttaatcgctgtccctatatgcatttgtcttgttccagggattgcagttccccctgcagtcaagatgaggaacatggctggaaacaacagtccatggatagaccctctgccaccaccgatgaatgcgcgcaatgggctggcaaatgccagcctcttctccacctctttgccagtccttcctcatgaaaaaagtatgccactttcactcataagacatgtcatgctctagtctgtgcatgtcatgctggaaatagcttgctggccaaacaactgatgtgctcattggtgcagtagggtggttattttttaatttttggctatagtactgtagttacataagtatgactganggattntaattgtgatgtgtgcaaagcacagttggtaagagggattgacactatggaccgagatacgagggaggctgcaaatggaattagtgtgttcaaatgccaaatat

SEQ ID NO: 101912 - DNA, 748 bp, Oryza sativa
  unsure (1)..(748): unsure at all n locations
cgcgggttgaattcatttctacccccctggaacagatttaaatgaatgggggaattgaatcttttattggtggtactgatagcgtgtgattagatttgaatagttgcaagaactatgggcaagacttggctgttggggaaaaggggtggaggtgaggcnatgcaacgatgtggcaacggatttaaatgaattggggaattgaatcttttattggcggtactgatagcgtgtgattagatttgaatagttgcaatacaaactatggttgccatggtatggtcaatgtggctgggagtggaacagttttgatatcaacttgggggaagaaaagaaaaaaagaaggcatatatttctcttggggtgatgagaattgctataacaactgacaagtgaaagcaacaaacattaccccccatggaaggtatccgtgacacgattgatcaatctacaagtctgcaaatgtaagcatgttaacaaacctggtaatatcccaagacgacgacgaagatgacgactaaccaagtggagaagttaaagtgcttggatgaattagttgaggaaaaataggcaatcaatcaatcaactgcatattgaaccttaataaatggtcacaaaagccccagaagaggaaaacaaccgcaggggtagagaaggaatgagcagtcaaccagcaatagtggaagcgctaagtattgatttctattcactttctcctctagactattggggggtgagagtgatatgtgaa

SEQ ID NO: 101913 - DNA, 810 bp, Oryza sativa
  unsure (1)..(810): unsure at all n locations
cgcgctgcccttttgaaatgctangtttcggcatgccccangncgactctagaggatccccaaatagatgatacgtaatagaagacattgaatgctttacattggaagaggtttcgattgcgagactttaacaatatgagtgtccgttttacatattatcggtgtatttttcttttctcaaaattgaacaaaaatgcacataggtcgagttcctaaataggaggatttttttaaaaactttttacatatatagttatcattataagatgctatttcaaatccattctttttaatcttgtaataatagttaaattattgtttgtatgttccattacattgaactcaaaagaacacacctatctccctagaaagtaggagcaatggagcaccagctatatgaatacaaattaaagatccttttgtgaatacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacataccaaacaccttttacctgtacaacacataccnccccccccccccccaattcgttctcccggcgaagtgaacccgtct

SEQ ID NO: 101914 - DNA, 722 bp, Oryza sativa
  unsure (1)..(722): unsure at all n locations
gaccgacgagacgacggggtctgaacgtgctcaccgctttccaagcgtgaaagttttactctggtcacgtgatgacgtgaagccgccagatcctgttgcttttgcttgcctcgggctcctctcggacgtggtcgccgaggagcagggccgactatatcttctgaatttgacccaccagcttgggccgcgaagtctacctatccaaaacatgggccacgcgcgctgcgcgaaaaggggggaaggtgacgggccaatccagcattgccggctggatcgtcctctgcgcgggccggaaaagtggcccacacgaacggtaggtttggttggaacgttgggtgggctgcctgaaatcaccgctccagcttgctttttggcccgcttactcgagttgctaacttgtgttgctattaattcctctttaatcaggtgaacggaaggaacccacatgtttgcacctttgcatcccttagccaatcgctgcaactatatgtaagtaaagctttgaccacatgcatcttgcgtgatgaatccgccgaggagttggagtggggacccatgataaatagtccagctactgcttgcttgcttgccccctaaattatacgggaatcctcagacctctgatccgcgaagttacccactctaatatacaaggcataacactggtaaaacaagtttagacaattntgggtgccgagtgtcttgaggtttccatgacgccg

SEQ ID NO: 101915 - DNA, 918 bp, Oryza sativa
  unsure (1)..(918): unsure at all n locations
agttagtttcttaaatttgtggntattactcgctcccggcgctgcatgatggctttcatattaatgccctacaaagaagcatttgctggatgtagtatagttgttgtaccaatggaaactgactttcactctcccagacccagaaaaaccgcgccctaaagaatattagtaattctccacttgtccactataagaatcttaagtattatgtttattgtgcctacaacctatttttaggctttctttncnggatatagaggatatggtaagcccaaaaagaggtcagttcttgaatggaggaggtaccatatgctagccatccattccacttaatctaatggcctgggaaggcttggtacttggcgctggcggtactgcatctctcgaaaaagcaggtttcgaatgctgttgatggtgggatgacaaatttgtactttcgcattcaggtaccaagtcggagcagaacaccgtcaccattttttcgctgcagtcatctactcatcgcatcctcaaatcgaacaaaaattgtagaggcgaacatggtgacgagcctgacgcaactgatgtggcggtctcccgggcagcattgaccttgggggatgtgggccgatggggaacgctggcgatttcggggtacccccgttgacgctctcgtttcctccctcctcctggttcgatcatgacgacagtttttttcattaatatctaattagacttataaatgactaattagggatggggattcgaggtggggctaacaaccaacgagccccaacaaggattccgcaatggatagtacgtgggagaggggaggcaaggatactaaaaggtggcttctaccgttggttgcgtgagatagcttaacacacatggaaaattgtcttatatttcttttgaatatatagggccaatatggga

SEQ ID NO: 101916 - DNA, 650 bp, Oryza sativa
ggataatgttattttataataatttaagggttctatttttcttaaggtatcttaaaaaaccattcaaaaactttttcttaaggtatgagttttaaatcatttttttctcgagtaaataagaaaccattgctagttaattatcatacagtccatctatatatataccgtatagtatggccacaaatgaaaaatgcgagagcaagatactcaaaattcttgtgattaaatcgtctcaagaaggcgcatgatatagtaagaaagggagggaagtgtatgcatggaaaaaagaaaaaagggaaaaaagaaaaaagggaggggaagcgtacataaccatgtacgtaggtgtatacctatgacacgggacgagaggtgagaccttatagtattttgtttttttaagatcaatttaatctaacggtttataatattggacgtaccgattaagtgaaaaatcaagtaatggatactttgatttttttcccttagaattctaatacgtggcagcttgagagcgttttaagaaattttaaaggacttaacacatgtaataagaatattaaccgcttaatatatatatgtatagggcatatggtaatatttgttctagcttggtgcatgtttatatacatgttgagagaaattaatgatgt

SEQ ID NO: 101917 - DNA, 612 bp, Oryza sativa
cgcataaaaaaatatgtactacttagggtttaggacagctgaaattgatgaattatcttatttatgtgatagctatttgagggtataaacgaataaattgacttataaaaagttaaaatgttgtttaaagagacgccatttagaaacttggaaagcgtgcaaacgaaaatccaactatgaaatcagggaaaaaaagaggatcttaaactcctttataacaccctagtctttgtaagagtgctattgatattcattaatattgtgctcacatttataacataatgaattctttcatctatacgaacaaatagtgcaaaatccaaatacgacataacacaatacgttataattattctgtaatcaactctcggtttcagcttaaacaaagctaagtgttagaaaaaaaacacaacccacagtgcttaattcttctctcgctgcatcacacctttaatttttttttcatgttattgacaaaattaatcatctccatatatgatttgatatgtggcaaaacggtagtgccagacatgatgctttgtcatgcgtgcaaaaggtaaaggtgcagatgtgcattgtgcagcgggcaaaaaaagagaacttcggacgttt

SEQ ID NO: 101918 - DNA, 756 bp, Oryza sativa
agtaagatatgatatgtacattactacgaacatgatccctttattggataaggggcttgtgcatggggtctgggaccccctgaagtcactccaactccatcggtggatttgatagaatctctacggtctcttttttatcgacggttgggatgaagccattagttcccacttcccactagtctcttttgaaaaaaaaagaatttatcctaatcttgtaacaataacaaatcaccgtctacaatatatttagacaatttgagaatatacaagctaattttacttgcataacccagaaattctttgattaatccatggtgtaaacaccgtactgagcacgtgcctctagttttgcatgtatatggtttatgtgtgtttgcatgtactatgcggttaacacttttttttttacatgaatgtagcttcttgtgtttgggaaagaagagaacatgtatactttgttaatttggtaggcagaaacttaaccattactaacataataaaaaaataaagtaattcccattcaaaccataggaagcaatagatggcttcatctcaccataggaagcaatagatgccatggatttgataaaattcacccggtggagttgtactcaactctaggggatctgtaccccaatatatataagcctatgatggagaaaacaaggtggctccatgcacaaaaggtacatttgttagcttgtgactgaactacaattcattttttatttgtttgttgccggtagcaacgtgatg

SEQ ID NO: 101919 - DNA, 542 bp, Oryza sativa
cattaattttgctcaaatatccaattaattcatgtttttttcatcaggtcaagctaattaagtattctctctatatctcaaccatgtcagtatggttccaagtagttgtggtactaaacaaatggacgtgatggcatcagtttatttttttaagctaaaaatcttaaatgtaaattttaaaaacttttttgacactcttccattctaaaatataagcatttctaaagtttcatgtgaaaattaggaaagcaagtggatataaattgtaatggttgtggtgggttgagatgagaaagaagattgattgagatttaacatgttatattctgaaatgagtattaaatgttcctatttgttcccccgcaaaaaaaatattccatttgttatattttaagatggtgtaatatatttggactaattatctacttatacatatctaacctgcactaattgaataaataagtgaccaagatctactagattttatctcgatcctacgccatatagaaaaacatgagtttaattagtttggatgtcaattt

SEQ ID NO: 101920 - DNA, 708 bp, Oryza sativa
tttcattgttgttaaatgataaaacatgattaatattttatgtgtgacttgtctttttaattttttttataatttttttcaaataagacggacggttaaacgttgggcacggaaaccagggtttgtcttttttttgggacggagggagtatgttttagaggacaatgactgaaatatgagcaacagccatcgtagcaaatgcttttaagctaactaggaaagtagcccgcgcacatgcgcgagcacctagattatataatttagtgttgcttgaaattttattatgaatgtttatgtgtaggtgacttttcttaaatattttatcaataatttgttttgaattggttttttctacttacccctccaacattttgattctaaaccaaaattactttgaaaccgtactatcatttgctcatatgaaactatcatttgtactacgcgtgtttcttcttgttttttaatatgtagcacatcttattttgggaatttctaaacttcaagtaacaaattttattatatattatagatatctttatggattttacgatatattactcgatgatattttttattaaaaatatggccagtaggattgtttcatctcattaaagacatacttctactcacttctccttttatttcataagctttattattttctttggaaataaatttaatttgcaataagagcgcaatcatactgat

SEQ ID NO: 101921 - DNA, 785 bp, Oryza sativa
ttgactttcttatagcattcagtggttgtattgaaaagagcttgcttgagtatttgctgtgataacactgtgaaccaagtcaatattagtaatgccaactgaaattggtagcctttcagtttgataccacatttttctaattggtaatgagcatgaaaatttgctactccctccgtcccaaaatataagaacttttgaactctgacacggtctccgagatgctactttgaccagcaatatctataaaaggaagatgttttaaataaaaagagttacatattatgatagtttgtttaataataaatctagtaacataaatttgacatgattgatctttttttttgctattaatagtcaaagttgaaaatgtttgacttgtcaccatgctaaaaatgcttatattttgggacagagagagtaattccaatgaaatttaacgtcagatatggacattttgtgtatgtggacatccaaacttcatgttaacacaggaaataggatagggtcctttagtacttccttttattgtttggggggggggggggggttgctgaaaccactgtatatgattctccagaattgacttgctacaattcaaacaaaatttggccctgcccaagtttaagccggttcacaatattgacttggactttgtccaaaaatgaaaaagcttgcacaaaatacagttgtgattgttagatgactttgccaggttcatttggccaaatcagtccatgttctccatctatgcatcgctaaggaagatcagcaaagggctgcaggaa

SEQ ID NO: 101922 - DNA, 647 bp, Oryza sativa
gtcgtatgaagaaatgaccacaataaaagttttagatcttgatgagttattcaactttgttgttgatgactttttcaattgaaatcatttagtatttgaaaatgttttttgaagttgtcatatttttaaattcaaattcaaattgttcaaaaaaatgttatattaaaaaatgaccaaactaaaagttgtaaatattgataagttatacaactttgttgttgacattttttccatttgaaatcatttactacccgtaaaattattttgctataatcaacttacaaatataaacatttcatatgaaaaatgaaaaaatagtcatcggtgacgggttttagttaatgcccgatagagattaagtatatagcccgtcactgatgagtcatctatgacgggcctagttgttatctcaaacgggcctcaagttggtgcacgtcacagatgatggtcatttgtgacgggctccaacttgaggcccgtctgagatatctgtgcgaccatatctcaatcgggcacttttcggcccgattgagatgacttccttatgacggcccgctatttctaagcatattagagcccgttacagatagaaggatctgtactagtgatcattggtgggccccacaaaaaccgagccgagccgagtc

SEQ ID NO: 101923 - DNA, 2425 bp, Oryza sativa
  unsure (1)..(2425): unsure at all n locations
atggtgaagattaaaacaagattagaaaatttcaactgctagttggtagacaaggccagtgacttatccaacaaaacagttatgtggcctgtctgtgaaggctggttcaatgattggagacattttactaatcatttgattcatcaaggacaggcaaagnaagtaaagagtttcctacagcatataaatttgtataaaatgcagagagttgtgttggttaagaagatggaataaataaagttaggagatgcagagtgaggcctgcacgaacatggagggaatctcaacattcttaagaactcaatgaagatattacagcgcctcggcgatatcgaggcatgttgccttcttggcttctcttgtgggctgttcattctgccaggctcattgattctgcaaacttgcaaaggatttcatttccatagagtggttttctcatatatttgtgtcattaacatctgaaacaattagaccaatccagtatactttattaacttaacctgtgatagaaacaagattatgaacacagttgaatcaatttggaatacaacaacaatgtaccttggggaaattcaacagaacccttccataggtttattatcagattatctgttaattgtcacttctctgaaggtcaaccagagtaagatctgctgcaagattaccaaatgactgcatagaactcaaataagatcttatattaccataatggcacgttttaggaataaacgagcatgtgcatcatcaaacaaaatggaaagccacaatgcaggtctccatttaaggtgtcaggtttgcgaaacacccgacaaatctgagtctgcttgagatctgatgctgatatccccccagcaggaatatgatctgcatattatccagcaattaaaggctgcacatgactcagatccaccacagtgcacaaatctggtgtatttctgtcatgtcctcaagagggacttcctgcctctccttggtaaacaagaacagctaagatgctggcaatgaaagtgatataaagggaacaagataagatttgtttatggcgccattcttaccctttagctgtatgaaaggagcatgtaagcatctgatgttatgcggccaattgcatggttatgtatttttcaaatgcctaaacaaccaaccagatatcattagtagcacaaacaatgaacataatataagatatcattagcatataaacactaatgtttattttctgacttcacaacattcaacttcatagtctgggaaagccaaattgcttctgagagactgagactagtccctttgggacatcctaagagatattctcttcttagcatttcttttttgggttataaattaagtgcacaaactggccatgataaattatgctgaggaatagctgcattctagtatgagcataattgcttgcatagataaacatacatatgcacttccatatctaccattgtttcagccatgtatttttctaacctccctcaaagtaaagtcatattttcgacattattaagaaaataaagaaggaatatgctgtgaagataaatttcaagaacaattaaagcacagacataaccaaagcattcgaaatcattcatagttgttgttggtttgtatccctgttccttgaagaaaattgtagcaaacagatgaagtaactgaggaaggcatcaagtgacagcatgacaatactaagtgctcacaatccactgaattctaatataccaaatatatttctatgcataaaacaaaaggaagaagacaaaacaagtactagtttttttctgtcactttcagttgacaatgctaacgcaaatctttacaatattcttgacttttattgattagcttacgccaaatgtcaatataataaactaaattcttcaacggtgtatccaagcaagttattgtcaaaaataaataaatatattatggaattacacccatgtgtaattagtaatcgaagctctgttctcatggtcaggtaaactagtcaattagagatgctgctgctactgaacttgcatgtagctgcttccaagatttgcaggcagcatcacaaagatattttctgcaacttggatacataggcatccatcttcatctaagaaagaaacatcaagtcctcatcactttacaccaaacaaaaagcaacagatgcctcccatcccccactaaccactatgaatagtgcaacggaaataggtcaaagtaataagcagatgagactttcaaaagaagatggaacaagtcagaaattctcgcggaaaaataatggtacaaattagaagtcagattatacacaatagctgaaggtcaaaaataaagaaataggcagctatccaataaaaaaaaggcaggtacaaatcaatgtcttcaatctagaacaatgttcaagtcaaacaagactcagggcattttt

SEQ ID NO: 101924 - DNA, 791 bp, Oryza sativa
tttgtgactttaaaatctttcagagctcagtcaaaattgaatttctgaagacaaagtagttgctccggcaacaatgttctcgagtgttcagtgaccgtatttacttcaacagtcatgatttagttttgtttatcagtttggtgaaatatttggtttcctatcactgatgagtgatgagcaatctgacatgataaaacttcatttctatgtgggcatgcctcgtgtatagtatgtattgtttgaacaagtatggtctcatagactcataccaagctatatatactaccgtttggaattgtggagattgttaatttgagggtttttctctagctgcatctaagtgcaatacctgattgatgctttcttcttttgatattctgattgaaaaatgccctgagtcttgtttgacttgaacattgttctagattgaagacattgatttgtacctgccttttttttattggatagctgcctatttctttatttttgaccttcagctattgtgtataatctgacttctaatttgtaccattatttttccgcgagaatttctgacttgttccatcttcttttgaaagtctcatctgcttattactttgacctatttccgttgcactattcatagtggttagtgggggatgggaggcatctgttgctttttgtttggtgtaaagtgatgaggacttgatgtttctttcttagatgaagatggatgcctatgtatccaagttgcagaaaatatctttgtgatgctgcctgcaaatcttggaagcagctacatgcaagttcag

SEQ ID NO: 101925 - DNA, 699 bp, Oryza sativa
  unsure (1)..(699): unsure at all n locations
aacaagggagtagtacatggaatgtttgtgttgaataaggaggtgtttgggtgagagggactaaataagtccctccctaggcactactgcaaggaagttggaactagtaactatatccacagctgtatatggaaaggctttggtctctgcagaggaccaaaatctgtacaaggattgtgtgggtgggggttcagtttagtctctctccctctctcttttttggttttcagtttttgaacaggagttttaagccctgtttggcaaatgctctctgtttaactgctatgcaagccattttcatgcctgttgtgcagcttcaggttttcactgttttattgttcaggatttatgtagacaacctcctgagaaagtgtaaaatgttgtcacttaaccttgtaccctgttcttagagctaatatatcctagtatattttttttattttctaaaaatagtaaattcacagaactacaaatactttaagtaaactatcccaagactagatattttatatgttttattataaaaaaatatataaatttagcattgaatttatcataaaactacatattttaacttttgtgaaaaatatatttattattaaatttatcacaaaactactgattaatcattgacttcatcacaaagctacatatttacaagttccatcatgantaaaatactaggatggaacctcttac

SEQ ID NO: 101926 - DNA, 1042 bp, Oryza sativa
tatcaagtcaagattgtcatgaaaagaaaaatcctcagtatggcaaattgaaaaggatgcttctcttcttcacaggtccattgtatcctttagagtagatcgtttcaaacaactttttctcaaatggcaataccaagctagcaccaacatggccttgcatgacacacctccagtgttcatggaagtctgggcaaattatcatggggtgtacaatatctcagcaccctaaagaaccataaaccttgcataccggaaacaattgatcccaataaatacaaaaaggacataacatgttgtgacagcccagggcccgaaaacggcattggtcgcaaaaattccggaatcggagtttacagtcaccggtaatatctcctatttaagctagtgtagatagagctagctagccgaggtggtactaagctggctacaagctgccgctactgctcgcttgcttgctgcacgcgtgcatgcatgggccaaggcccatggcctgctgctgctgggctggctgctagctagctttttcttttttttttctttttagggtgttacacatgtgcagttaaattagtaacatcaccaagctcttataaattagtgattccctgctgatatcataagcagaccaaaccagatcatgaggcgcttaatgaaatacctgtgtgtcaccgattttcccaaatcctagtatctctatagaaaatttagcatatactgtaatatcattacatacctccctatggaaaatagaagcatatgtatactataatgtcagtacatacctctatggaaaattacagcatatactgctgtataaaattcagtatatacccctataggaaataaagcagcatataccatctctaaggaaaaatgcaacgtatacacagaaaattgtaatttactttccttcaacttcaaagagagaatgtataaacgtgaaagaggatgggctacaataccagagtgtactgcagcaaggcgcagcgttggcgacgcatcgacgtcaacttatgaaagggcgaccgagaccggcaacaag

SEQ ID NO: 101927 - DNA, 992 bp, Oryza sativa
tgtgtcacggtcaagcaaagaagcacaggcttcaggaagcttcgcccatcttcctgtcactcccgtacttgccatatgtgatcagtgatcggttggttaagcagacaaataggctacttaggccgagtttagttccaaactttttcttcaaacttttaactttttcatcacatcagaacttttctacacacataaacttccaacttttccatcacatcgttccaatttcaaccaaacttctaaatttcgagtgaactaaacacacccttacatgatgtatgttaatatgcatatgtaacagtgtagcaagtcttcttttaagcatttttattaagtacttcctctgtcgtatattaagattatttttagctcatcccatttatctcaaaataaattgatttttagtaataattatatcaaagtttataatagtaaagaataattgcattggaagtagataaagtgataaatagttatattaggatgagataaagtagggtattttagtcttttgatgtttgtattggtatgtgtaggatgagtgaacaatgaactttttttggaacatctgtattactaatatgcatttgtactaatttttttaccaggtatgcatatatacaaattactccctttattttaaaatgtattgagatatatataaatataattaccttttcaaacaatcttttcaatactatactttaactactactgttttctttcgtttattatcaatacctacaaaatcaacgccatataaaaatagtcaaataaaaatctaacaatactactttattatataatgatataaaaatcaaataaaaagtcataacattaatcaaatatccaatcataccaggtatgcatatgtacaaattactccctttattttaaaatgtattgagatatatataaatataattaccttttcaaacaatcttttcaatattatactttaactactactattttctttcgtttattatcaa

SEQ ID NO: 101928 - DNA, 746 bp, Oryza sativa
  unsure (1)..(746): unsure at all n locations
gggcgtatatatgacgtgcaaagaatagtttagacccaatgaaactgtagagtattattgtttatgcctgcagttgcttcaaagagaacaaattcaatctatctctgttgcttgtgtttcttttgaagccacccttataatttttagcacttaatgaagccaactcttctattgggtatttcaaggaagatatggggtcttgctttcagaatagaaattgtttctggtggttgtgcctgtgcatcctttgttgctgcttaggaaaaataagtctgcatggctcataccatcacttggaatatttttgtttcatatcatctgaatttcaattaataaagtctgtatccggttctatttcactattggtggtttctaaccgtcaataatacttgaaatcaagtttgtagtctgcatctggttctacattctttggtggcctcaaattgttatcacatatgcagattcactattgagtatgtgataattaattatttgtaatgacatttctgttatatcttatatactcccttctttgtaattaacagtaatggaattattgttagttcaatttgaaccaaccaacatgtcatataataaaaacaaatagagcgtgaaaatagcatttttcgaggttatgtgactaaatcccttgaacaaagaactttaaaatagaaagggagaaaagaactaattcggggaccgagctcgaattcgccctatagtaggcgatcctatcnngacgcacg

SEQ ID NO: 101929 - DNA, 1813 bp, Oryza sativa
ggagcaaatctcgtactagaatgatccacccatatattgatctccatcttcgtcgtctctctctctctctcggcagctttatgtgctgtttaaaagatgcactgtgcatctcttgctagcttctattagtagttattcaagacctgcaactgatgaggttgatcatgagatgattcatcagtagcgaccccacccggaagaaaaggaggggtatttttcataaaataccttcctattatccttgagcaagatcaatgtatgtgtgattaccaattacatatgaaatgtaatttgatccttgagcaagatgtggttattgaagtctactaacttgagaaatgatagtaaagaatttggtaaaaagtgggttatccataataggacagctctcgatacctcccaagcctaccatggcaaaagcaagcagttggagtgatcaatctccatcatttcttcttcagcctctgctccttgatcttgtctttatattcatagagcaagcaggacatggtcatatctgaaaattgagtgtttttttttcagttcagagagtttaatgcttaataacctactagtattactctcttacctaggcacccactaagagattattacattggagcctcatctccagccattcgatcacgatcaataggaccataagaaaggattagaggatggtggaaatactgcctctgctttctattagaaatgatagggatcaaaggacaacgctgtgaaagatgatatggatatgggccgcgtcaaatacgtgcatattgcgacattgaattgatcagatttgctcaaaatgcagaaacttgtatgtatgctaaacttgcatcaactggtttctaattgctagaaaagcatcagcagtagagaggcagaatggtatggcaacagctcaccaccggtttatctcacagctcctgacgcctcccaggcctatgatattagtaactgcagcaagccagtttcttggttgctgaactccatgagctccacttgttcatctctctgaacatcagtgaagaaaaacaagtttgctgctacttcatttcatctgcccttctatggatcaaaaaagaagacagcatagtatcatacacgaatttattgtctgataaacattcagtaatttaagagtagttagggattttgtctcatcttattattggttgtgtgccttatggcagaggcgggtggagtgattggtctcccatactacttctctctctctctcatttcttacttgttggtgtctcaattgagagccccattggttgccctaataagctaaagcaaaagttaaattttaaattttcaaacttaattttgaagttgatttaaaatattttcaacgtgattctttttaagcgttggcttttaaatcgctaagaacacatacataaaagttttacttataaattaatttttattctctaataagccaaatccaatgggagcctgattatttaatcgtctgatctgatgccatcatttcaaagcagaacttagctcgggaaaaactgacgacatgtaattaatgttattgctttaatttcatgggagtggattatataacactgtgatagatcaatgtccccatacatatatattggtagtgatcaatgatattatgacaaaccaatgaatcattgaattgttcttcctctcctgctttgaatagcgaatgttcaacaatgtcacttcacaaaacatagaaaattaattttatgatccttaagaaggtatcggaaggtaccacactttctaatatataaaatttaatacttcttagtatctcaca

SEQ ID NO: 101930 - DNA, 1080 bp, Oryza sativa
tggttgggcgaggaggatggtgatgtcgtccccctccatccctcccctataaaaatgttgcggcgctggaatctagtgtagcgcttcagtcttatggtgttgctagattgggttccgggtttcgacgcctgtgggaggctgcgatgatgaggaggtgcgtcgtggtggcccaacagaaattataaaaattgtagatacactcatagcatgacacatcaatgatagtaaaaatgtagtaaaagaaaagttagtacatatagccttttccctttcattttttgttaacacgtttcacacacggttaaacagtgtgttaaacaaaaaaaaaagccaagcctctctggtgagagttgacgagtttctgcctcatgcagctagggccgaagaccggggaatctgaggtcaaaacttttcatatagaagtttcttaaaaaaacaaataaacctattttttaacattgtaataattattacttaattaatcatgcgctaatggttcatttcgttttgggtgttgctaaaaatcccaccacgtactacttccctctcgagcatgaatgtattgccgtttgtatgtcatcgtcctatgggctgtcatcttatctgaattcctaatggcttgttttgaaacgcgaagttgtaaaagcatatgaatagaaaaaaaaaacaagaatatcgtataatagcatgtataaaacaaaggatttgagaaaatatagaaatttcgtaggaatggatgttgtgatgaaccatgaaaaaacacaggaaacgacagtacgtgcaaagttaattagagagttagccatgctcttatccctaaagaacagtataaacaaagggaaggtccgatgatgatatgatgcttaagccttgcattagtggcatcagagcgcgatttgccttgatcctacacgatgggaacaaaaacaaggtcatactggatgttttttcccactattttcctgcgaaattagcaccatagaaaagatttctccatttttcctatgttccgaatggatgaatatggtaaccatttcccataggaattggaatcttccgtttttccttcaaggatccttc

SEQ ID NO: 101931 - DNA, 2366 bp, Oryza sativa
atcaggagctgtgtttgaaatggacctaacagggagatgaattttgcatgagatgggtctagatggaaagaatgcggcaaccaaacacacccattcctgcacacaacatagcatctgagccaggctcatgcagacatcgatccaaacaggctctactgcgaggagagtgtccagtgacatgaaatttcctcatgtctctcaggcctacccacaaaattgtaacaagcttgcactggagtgatcaatctctttcttagaagcttgttgtgctccttggtcttattttctagagtgattttatagtccttgagaaggtactatattttctaatgtaaaatttaggaaaaatttcacaattcttgagagataccgagaggtactaaatttggtacctcctagtaccaaaggtaccaagagatactaaattttacactagaaaatatagtagcctccagtaccgactcaaaaactgtaaaatcactcaaagtttagtacctttcggtactccaggtactaggaggtaacagtttgcactaaaaactttgttaccacttggtatctctcaagaactgtaaaatttctttattttctatgtgtggagcaaatagaggatattaccctatatatgaaaattcactatatgctaactatgttttcacatttaatgtaccatatctatatatttataccagtgcaatctttttttattagctagtagtatacctcatatagatcgatggtgttggtacttgtgatattctattaccaggagagacaagtgtaaaagtaattaacgagtctagaagacatcaatgagggtgagacgacacaataatttcattaattgtctcacatacattcaagcggttcagattgagttctcatccatgtaacttgccgtccggaggaggacgggaagaagagatcaaattaacaacgtgatcgctcttagcgttcaaaataagagattgtttaggcagcaaattaaatcgtcgttagctctcaaggtgtcacagcataaaaattttcagtggaagaggcaaaattttcagcacaatgtgcacctgacagtacactactgtaatgccattcagatcatcgtttcaggtcaggttgatcaatttggcataaaccacaggcttaacatgtacatcaccataaacagtaatggaagtttacggatttgttatcagcagcattccttgaaagttaagaaactgtcatctctgctgtacatggcattcaggtgatcacatccactcaatgaagagtttgatatcaaacgttcaaaccgcccatgagattcagaaattggttccaagaatcaaaccaagagttgcattgcaaggatatctgctgatgcaccaggcagaatgaatataaattactgtatctaaaaacagtgtccagtgaagtccggatgtctgaaacttgcattggaggaagtatggtcagcaaccagcttaccagttgcatatgtttcagctcttggtgcctcccaggcctaccatatcgtagcaaagctatggactgtctaaaatctccatggttcttcttgtttatctcaattaacatcaagctagaaaaacaagattggctacctttcatgcttcttttatatatggagcaaaaaaagatagcatggcatcatatagtatcatgcatgattttaatagctttcgcgaaaaaaatacacgattttaatggaagtgcatctacattattgactgagcaatcaacaaaaatggtggtttatgatctttaacgatccatctcaaaatcattcacccagtcatacaactctacacaatcaagtaaccggatggagtcatgaacttaattcttcatcaattgcatttgtggcgtcaacgagaaactgacacaattccattgccttgtcacacttgcaggacccaccacatggccctcacaagaatgattacaatgccaccaaagacatcatgatgcaatagttcgcaaaacttcatggtcttagcggaaggtgaaaaatgtctgaatctgctataattgtttggacgatgagagttatgctgagatgcagttattctgaacttgtgaacatatttccacagacaaaatggcaaacaaagtgggtcaatcatgttttacaattccgcatagcatatttcaactacagtccaattcatgaagtgtacgaatagggaacttagtttttttttaaacgaaaagcggcaaaagacttaccgaatatattagaaggaataaaagtcacagtacagacagggaaacaaagaaagcaactagcacgttaaaagagtcatgctatgaattcagaaggtcgaacattgactcttaaaactctttgggccatcagataggccttt

SEQ ID NO: 101932 - DNA, 5951 bp, Oryza sativa
tgctgccgttgccagttcttcaattcagccggagaagcgctagatgtttgtggttcagatgatcgaggacgttattgactgctccaggaagggacttggtcagtagggtgatcgacaatcgattgcttgcgatcgaacgaatcaatgttttgaggtgatgcgagaactcctgatacttcccaggccaatagctagccatacatgccaacacacactgcctgaacttctctttggtttgccgttcttagtaaatattttcatacaaaagaacattaatctggttctatgaaacgctggagctgttgatgtctccatctcttagcttctgtgttggcatttcttaccctaggtatgttattgggcctttatagaatctgatttgatgtgatcatttaatacaagttccagttatttcatttgagagggtaaattccaattcatcagcacttacctctaaaaagaatcgggagatatgccatgttcatcctaacattctgatagatcaatgtcgtctcagaatcagcatgtggacaattttttttagataaaggatttatataaaacttggtctctacatcccaaacatatacgtacacaaccaaccaagtccatacatataagcactaagcccctcccattacatgggtcacaaaatacacttaaaagaccaaacaaagtaccaagttcaaccaacaagacctaagaaacacttatttccccaattcttgccccggccactggcacctgttcaatggatgccatcgagtatggatggatctatcgtgtcctctcaacttgtcaaaatttcttgtttattttgtcgtatattaattttgacacaattctccaggataaatggcagcgaggacatcacgataaaattaaatatcaacttttaatcccttaattcgatgcgaatatataattattgatccttttgatggtattcatccagtgtggcattttccattgcacagatgtgtatcaagccgcacacactctaatttgcatcagccatgcgtttgccatcctttaatccttacgacgtgaacaaaaggatgcttaagatctgtaccgtgcagggtggatggcggcgaggcatgtctccgtacctgcgatgcttgatctgtatctgcatcagagcattgctgcatcctgcacgatgaatggcggcaaaggcttctcgcacctctcaggtcgtcttggcgagcatcatacctctaaaaggattaatgatgtatatacatcattaactaaggaacaaatgtagttgtagatagtatatggagatataccccattttctaatttaaatatttttattttttttcatgcttgaagaggtatatatgtccttatacttgagatataccttagaggtaaaaaaaattaaatgggttgaactgactataatcattggcagtgataagacttctctaatccttgagagctatacaaggtacattcagataattttattatccttgagaagatacctagaggtatcatattttctagtgtaaaatttggtatctttaggtactaagtatctcaagataccaaaaaatttagtgtaaaatttagatacctcaaggtactttctcaagtactgtaaaattcctcagtacatatacctccacctagaggtatgcacctccagattaatacaaatatctatagctcttaaaaatgggggggaaattcaagaatgtcgtataccccaaaaacctaccgagagggctaaaaggtagtggaagtcagcggaagctaaaaattcaaactttgcagtatcaaagttctagggcatttgacttcaccaaaaaaacatagcaatcacctcaactgtccagctttcatttgtatagcaagctaggatcgtccgggaattcatctcttctgtcatgatagagcatccgcatcaccatgaagacagcttgtcgtcgctgctggatgctaattgggtcgacttattggcagggttgctggagacaacgcagcaggacaatgtcatccatcccaatggcaatttgatcagctccatggctgaagtgacctctagctctcggcaacaaccaagttacaatagagattccgatggttcccaggcctagctgccatggcaagtcactggtatccatatctccatggctccatgggctcttcttcatcccatcctcagcttgtcactccatcacatgtgtgcggtggtaggagcaatacattgtggggcacccctaatgggcaggtgatcgctcctagtgatcaacccgcccctccccatatactcctctcccttctctcctttcatcataaatttaaaaaaaagttagtaaaaaaaattagaaaaaaatctaatactctcattaatgtgcatagactttataccgtaaactttacacgtataaactttatgtatagaaatattctatatataaaatatttgaatctaaatttgaatttgaattgggtatttaaacttttgacttataaacattcactctacaaactttaggtggataaactttagatgtgtaaactttacgtgtataaacttactaaaagaggaaaataatgcacgcataaactttatgtacataaatattctatatataaaatatttgaatccgaattcgaatttgaatcgggtatataaacttttgacctataatttttaggtgtgtaaactttagatatataaactttaggtatataaacttatccgaaaagaaaaactatatggtgaaaaaaaaaagaaagtggtgaaaaaaattgatcgtctcaggcgatcgatcactaattagcgatctcatacattgtgaagagagcaatttctttgtgaaaggtttctccaactttattctcaggcattgtacacactctaagtccatcatcaccaatcagtattgcagaggctgagtcttcttaggctggttctatcaagttgatgtaatcatctgaaattaatagaagcttcctttatcaaaaaatcaccaatcagtataggttcgaagttacaatgaataatcaatcaaagcatgtagtactagaggtaaatttaaatgagagatgaaactctcatttatttaaatatcatttccaatataatttcccaaaatctctcaagtttcagtttggcaaaaggagaaagaaccaacagtcaccatgactaagatagcttacctcgatcatcttccatgccatacaagagagctagaggataccgttgctgcatcagcaagtgagcaagatgattctgaagcctacatggctgcaatttgctgtgaggcagccgccgatggctacagcggagaccggcggctgtggagggaaccggcgatgtgatggcccacatatcagtgagaagaaatgtggcaactagtctcagcggtcaggattggtttgtaaggaaagtgatatgcatcagagctcctgatgcctcccaagccaaccaccattcatgaacagcaacacgccgtctagagtttcctcttggcttcataaaactctgttcattactatctcagaatgttgcattgggtctctacaactatatgtagcattcgatttgatgcgatcattttgttagtatggtagttagagatgtattaggataggattgatttgtagggtagttttcgttatctctgatcctttcttatctctaaccatgtacatattctcctacatatactgacccctaaggcccaatacaacatgtccaatattcgcattatatctttcttcctctactatttaacacatttaatacagtaagctattctatagttcaatgaagtgaactgccgatcgatcaacgatcatggtcaatccatgtaatgtaattaactcaccagtgatcggtgatgaaccagggaaggcgtgacgaaattaacaacgtcatagtcgaggcagcaggttgctagctagttcttgttctgtcggcatcagattttttcaatggtaaactgaattcctaaaatgttgttccgttcaacatttcaggtcagattttgtggacaatagaccattcctcccagcatctttggatccatcagatcgagcaataaacagatgggaggaaactaggtgacatctctgaaaatctcaagagagaaattttcatgcgagatgtttaagtcctaagtcgatcaaatgcagaatggtggataccttatatactctgttattcggcatgctagaaagtcttacattgtgaaacggaggaagtacacattaattcgcatgataattaccatcaaaactgtactttttaccccggcgcatgatgcgtccaacatgccatccgctggtgaaggtaacgcaagtgtatctgccttgccgtgccaggaaatggacatatatctcttcaacgccatggaaggcatcacgatgcaaatcaattagatatgcaacagctactaatttagtatattcggtttgatgcgatcatttcacccatcctgcattcactgtcatacttcccgttgcaccaaaaaaatcgagccgccattgtcctaggtgctacatgagaagtcctgatgcctcctaggccaacagcacgccacattgaaattcttgaaaaaccacatgtcctctagaattatgttgaaattttcagctaagaaatgtcaggaaagcgcagccttttgaatcgaacttagcccctcaaacaacctaatctgaaattcactcttatggagatttgaactcaggaccgtggggtgctattcagatcactgcaaccactaaattgcatgccctttcacaatggatattttttcatatattaatttcagaactgtgcatgcagtttaatcgctaccatcaatcattgcattcatatctgtgatctccatcgactcgttcatttctttctcaatttgggtcccttcatctattttttatggagcaaaaagtgtactgataatgaatgcactttctggtggtagcaaacagagtattcaactctgaaaacgtatgataaattttcatggcagttttttttttttgacaatggaaatataacttcccgtctctataccaactaaaaataacatggtcatatttgtgggctttagggttgaaacttagtgggtgtagtcatgcacccacgactccaccaccacaccaccacccaagtggtgcttcccccttgacttgattgagaaattaatcatcaatgaggtagttgatattctttaacgcactgaactttgtgtttgcagtggtgcctcccccttgatgcatgagaacaatgagtttcaactagctaggtgccatgggatcagtttgttactcatttcttgcattcaaagcagcaagtcaatagcaaggcctacttttgtgttggaggcatcccaatgataaaatgcagaatttctaaccagttagcttggtaaagaataattaaaacaatactgagtacttcagcttcaagcataaggaggaataactcatatcacaagttcataattattgacgggttttgtctggggagaaaaataacggcaaacagaaatttctgcaggacacagtagcagaaaggaattgaatcaagccaacaatttttcgatgtgtattcatggttgtggcatgaaggatatcccgttgctttcttgcattggcaggaccagagtaccccccagaacgtagaccagagagccctcctcgactatcctgtcatattgtcgtgacagacaaccgctggatggtgggcagcagctatggattcagtggctatggcgatgagccccccagcaacattagaacgctggatgcatgagagtattcacaatcggagtggcctttgttcagtcttccatgaaatgttgatcatctccgataggtttcaacgaaaatttgcaggaacacagtgtccatagactaccttggaataatcttgtaataggaaacctcccaatgcctgccagggctacagtggcaacaggccat

SEQ ID NO: 101933 - DNA, 540 bp, Oryza sativa
cctggcggcggcgacaccagcaaagtaaacggagcaacctctccaaaaggaagcctcgtagagtagccaacgaagcctcctcgccgcgtcctcctgcgacgtcgacgatggccgcggccctgcacctgctgcttcctctatcgtcactaccacgtccggatgtcgccgcgccgccgccgccgccggcgtcacgttcttaccaccagctgcagcgacgcggcgtggtggtaaccgcgagccgtagccgccgtctgattcctggcacgctgggtgaccgcgtgtgccgcttgacgcgccaaccgctgcatcatcatcacggatccactcatctctcgaccgatcaatctctctcgctcgctgtattgtagtgccgatcgatcaatcgattctatgtgtacgggataaactaacccaaaatatatatacaggcgatcgatcgattaaactactggttgtccaatccgaatcagattctgagaccgtctcgatgatctcgggttgcttagctgctgcccagcagcccagcttgtcgcagcgaat

SEQ ID NO: 101934 - DNA, 715 bp, Oryza sativa
agcaaaacatccccataggattcgtcattgaatctgaggaattctaacaaccctgacaatcgaaattgcacagggggtccgagctcaacccgaatgacaaaccatgtgcggcttctgctactaggaatcaaaagagagggccaaaacgtagaccagccaaccaacaacaatggggcttttgagaggctgccaatagacttctgtcttgctttgaggcctgagatggctaaggagagggcgacctgcaacatggaaccataagattttgagcagaacaaacacccaatcacaaggcttccaaaggcttcggcttgaaggaggatgtagatgacgacgagccaaccgctgccgccaacagaggaagaagctgcaccaacagtggcaccggctagcacacagcaagcgactggagttcagggggcgacaactgccacaccgccgatcatagcacacatgccgacgcctgccggcgccacagctagcataggtgcgacagagggaaacaacgccaccgctagctcgggcacggcgaagggggacgacagacgtcgtaacgccgaggacagcgcagagaccgtcgccacctcaacgacgaccaccgaagtgccaggcgcgacgcagactccgtctccaccaccaacacaaacccgcacacgagcagggtgtcggcaaccactgccagaagctccttctgcaccaccaccaaggccatcca

SEQ ID NO: 101935 - DNA, 590 bp, Oryza sativa
tttttttctctccaatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaggtgggcggtggtcaggcctgtgatttggctgcatggacaaagcggaaatgccctccctcccctgagttgtgtgtgtttatatcgttattattgctaatattgttacatgcacagctgaggatgtacaacggtatagtgtggctggaaatacacctgttttggttgtaatgtggtatgcatgtaattggtttaagatgatttaggttttgtctgatctgtttgttattgaagtttaaattacaggtaaatcgtaatgtagaaatagtag

SEQ ID NO: 101936 - DNA, 579 bp, Oryza sativa
tgcacagcaggtgttgtgactcggggtatattcatgtcggcgaggaccttgttaaccctttcttccacccttgcattcatgctagcttctagttcttgaatgacctcaaccttaagttcgtccttcaaacgagcgtccctctctttcttggagactttccgtttcctgtattgggatctgtactgagggagtccatgcttccagggcacatcgctaccaattccccaagttcggccaggatgttctttggttccgagcgcctttgtgaggatgtcatctttgcgcctcttcggcgcggactcaacctcgctttgtgaagcttgttcagtaaccaagcccaactagaaaagaagatagtcgtttatacgaacttgtactttatacgaacgaaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggtagggacattcgctgctgcagcggctgcatcttcttgg

SEQ ID NO: 101937 - DNA, 606 bp, Oryza sativa
tcctcgccgctcccaactctctccagcaagctgcacccaccacatgtgtacatagtagcattcatcaccattcccctgataataacaagtctacgtgtcgcgtttttatgctgattcatccatgctgtgctttgggtacaactttggatataaactctccttattttctcctaggggcggagttgaatgaaatgaaggaggatgtcactggcttactttactttactttggattaagtttagactaatacaaggatctgaatttggactgaagggatgcacatatggtgaaaattgatgaactatatagttaaatagtttttggaccggatttatgaaccccccctccctctatgtagctctgcccttgctccctccggctgggaaagagaaaaacagaactctcttatacttgatctcacgtgaggtaaggagctccgtaaagggtagtgagtgccggttgatggtttctcggtgcgttggagcagaaggctggagagtggttgtgtcggcggtgatgacagcctcagtatggtctctgcgcaacaaggctcagcaagcaataatcgattctaacatcaaggtgggtaccgagctcgaattcgcc

SEQ ID NO: 101938 - DNA, 1253 bp, Oryza sativa
ctgccatcgcttgctgcaatggcgaacaccaaccctaatcctcaccgtttcctatgtgctgatcacgtggttcatcaaggaggagtcatgaggattccccgcgttgatctcatagctgctacaaagctcccaaaacaccataaacagtatgctttggccttgctggaacggttgattcctgagaacctctggaatgaccattaggtaactagtacgtaccccgctgcgttgctgcgggtttaatagatgacttaatacataaatttttttgactcaaacaatgatgaaatgggaaattaagtgccttctcaaaatcataattttagttacatctatattcagatctgagatacgtacgattatcctttacagtgtttatattgaaaccgtacatgcaagcttcggtataaatgtagctgtagtaagtagcaaaaaaggggttgcaagtagcaatatgtatactgcatacctgtacgctgctaacctggtcaattgatctattccattgtactgtatcatatcatgattcatagaaaaccaagcacacagataatacaaacttatggtcacgtagaattacttggagattatactcgcgcctttgatcaaactgagaacacaaaatgttttgacagtacatctctctagtaaaatccaaacatgatttcttggttggtggaagaggatcaatagtcatccacatatcgatgtgttcgagagggataggaaagcatgtggaagaattgggaatggaacagtaattaggatccgtggagggttgggatggaatgcaatgatggtgattaaagccatgaagcctccgtcagtcactcaaaaacatacgccagacaatggtttcattgtgcaggaagatggtcagatggggagatttacgtggagatagcaagacggcaggaggtgtttctaggtctttgctgtggaaacagattggctttctttacacctgctggcttctatcgaaggaagacaggcgtcgctgacaggcaacgcggttttggacgcaagggggcatgcgaccgtgaggattattggatgggggggggcccccccccccccatacatgcacctaactagaaaaaatgccgcgcgttgcaacgggtaaaatattttttattgctatacactttttagtcccaacccaccccggtatctttctatacttgcctatctttgatgtagcccacaagtggagctgtatgctcacctcgcatgggcggctgtcgtatccaacc

SEQ ID NO: 101939 - DNA, 678 bp, Oryza sativa
cccacggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgactctgcaataaatcataacaataataccttcagcaccaaccattctctgcacctacggcctcagcaaagaattgtcgtcgatggaagaagttgtttctctccccgacctactccaggccaagcaaagggcaatcaacctcaggagggcgataccaagcagaagaccgtcatccgcttcaaacagcaatcagaaggaagcttctcctgtgaatgatagcaatatgcagtcctatcacatcatcacagaaccaatcaaggatgatgcagtcactagaacaatgccagctatatctctccagaatcaaaatgagcagccacgcttgtggttttcagttcactacttatcattgtgtaatcgaaagtttgcagcaatcatgtagtaaataaatatattcatgtctataaacagtgagcttgctatgtttatggatgattcctgttgaggatacaatgtaccgatgttaagcaccttccctttttgtttaaggcagggctttgtattcatgtaataagggagacatgtgtaataaaa

SEQ ID NO: 101940 - DNA, 757 bp, Oryza sativa
ccgtataaaatggctacatatataggttggaggatttgagtaaaaaaaattactacgttaaagggtatgggattgtgtttaaggggtgctgctagcgtgagatgagagtaaaataattactaatagggaagaatggtgggtgcagatagtatggggttgttgtgaggagtgccacgaagctacgtagcacccttaaggtgtcatatagtagttacggtgacgctacctagcatgttacacgcgctaccgaatcagtagcgcgactcacaacagcagcgaggtccgcttttttttttttgggcgccccaccgcttcctgattttcgttcgattgctcctccccgtgcgtcccaacgtccgtgaaaaaattactcaccctgaatttctccctttttactgtttcggttggatatgtatgccacacctcatccgatatccacgaggaggagcgagtaaaaaaattactttgattcccatgtcccagacgcatgtatatatccaacagccacgagttaaaaaatcactgtccacatgtttccgtaaaaaaattactcgtggggtctcccaccatctaaagtccacactccagttaaaaaattactattggactcatattttcttcttataagcccaccctccagttaaaaaattactatcggactcatgaggcaaatattgcacttgtagactggcataaatgtatcggtaaattattgtgccgtcagtcggttttgttgaggttggtttatattagtaat

SEQ ID NO: 101941 - DNA, 683 bp, Oryza sativa
aattcctgcagcccatctgccggtgtggcttgctgagtactgtggttgtactcattcttgctctatctttctccccccccgttcagtaagagaagctttggagaagatgtcttaggaggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactccttttcttccttcttcaaatttcaactagtactagatggtcaggtcagtgaagaagaagacatcgtcagttgtttgccgaagctccggaagactgcaggatccgctagcgaagcaaaggaagcagtgaagccagctgtgaagcaggagtgaagatcttggagaacccgtcgcagaacctaagccaccctatagggt

SEQ ID NO: 101942 - DNA, 850 bp, Oryza sativa
atagatgtttcgtaattaaaaaaatcaacgtaaaatggtgagggaagaacctacacgaggtgaccatcgtacaaagatccaatgttgaacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgttcattggtttgccatatggtgagtgagttaattgcttcttggtattgatgcaaaaataaataggtctcaaatttttggaaggagggagtataatgtaatatgattcctggagagatctgaataacttggttaatcatgtctactagcttgagaaatggtgagcaaagaacttagcagattgagactattttgtaattgaaaaattcccggtgcttcctaggccaaactattatggcgataagccacttgaaaaatcttatctccatcaattctccttctctttctcagcctgagatccttattcatattgccttttataggtcaggaaaagggatatggtgatgtaataagtgagctttagtgcaccgtcagatgtggagaatgggatgtttccattgtcttataacgaaatcgttaaattatatatggcagttatataaatattaaggataagatatgtttagagtccttcattattagcgaacagttgactatgcattgaaatcagctttcttgtctctatcgttgtactcctatatatacaattcacgaggctccaaaacaaatcaaccaataatcgcagtatatttctcttcatggactatttaa

SEQ ID NO: 101943 - DNA, 683 bp, Oryza sativa
ccaatactttaattatttctcagacagcatccaacttagtaatttcgaggggtcaaccttactgcattaaaaaaacaattaattagccgatcgaaatttagagatcgtgcacagtgatgcttgtctcttttcagtcgtgcgaattgaagtccaccccaaattaaatttaattaactttccccccaaaaaatatgcctacatcctgctgctaatatataacataatcaattctacgtacctatatgatcttatgtctagtaagctactaacagattaaactagctagctagctagagatccaaaaaattaactgaccagcttgtgcatgctctgcttaattatcatgtgaccctactaacacactctcttatgatcatgcccttgagcgtgcattgatgatcaattagcatcaccaaccaaaccaagtactactaattattaatcaacctagcttgcacgcacgccaagtccccctccttgatggagatagtttcattggctaagtaatgactcatgaaataattaaccaccaaacaatagctaaatacataattaaccccacgctagacaccacgagtagcatcaaatatactaaatctacacaatattttcgcgctagagggtacggacaaaatccgtcaaaattattagagttcagctggttggtgagttcatcagtttag

SEQ ID NO: 101944 - DNA, 813 bp, Oryza sativa
caagtccaaagaggcggcctccaaggatgcgaacgtgttgtcaacgacgcacttggtatccaagctccacagcaaaggaaccatcaaaagagaatgaacgggaaatagctgaggaaatagggaataagggagaagagatgaagggcaaatgagtccaatgacatttttctccactcagatctaacaccgttacctcaggatgcgacggaagtgctatggtacgaaggaaaaacggtggcctgtgcttctcgtcgaaagcgaaaaaattgtgtgctattttttggtaccgctttttttcttgtgctatggatcgaattttctcttttttttctatgagagccaaacatttggttactaacttgccatagatctgacaagggcatgcatatgaaagtgcagatgatctgattcactgatgcacgcctcagttcatctcaactgaccacaactaatcactctaccaaagcttccaacacaaatcttcactggggtgagccctacaaaacaaaagatgaaattctccacttctttagttcttacaagctgattgctgatccaagtaccagattggaactcccctggtgtctccttcctaggcaaatctctaaaaccatccatttccccttccaaatcagcaatcaaatctcaatctaaaccctcccttctaaaatcgtttcttactttctttggaacctcacccaaatcgccagcacttggccacaacgccacaaaaccatgaaccacaccatgattctcactagctactcctaagctgaaatccaataaacactggagacgaaatcctcctccgaa

SEQ ID NO: 101945 - DNA, 680 bp, Oryza sativa
cttggaattcgcaccgtcggaagtgcgtctatttaagggagttttggggattcatttgaagtccgcctgtagtggaaaaattctccagcccccaagcgcctctcgtcttctccactcccgcaaaaaccctagttcagcaacttaggtcctttcaccggcgatcttcgatcagcgatggacctcggcaagtcatcttccaccagcgcatcgctgaaggagcttcaggaagacggcgcccttcctggtcgtggagccatggagagggaagcaggaggtactaatccccagcccgtcttaggtcgcatggttgcgatcgaagactatgttctctgcggttttctccctccgccttccgaatttctcctcctgattttgaacttctatggtctttctcttcttcatttgaaccccaattctattgcctttcttagcatctttgctcatctttgcgaggcttacattggggtagagtcttttcttgatctttttcgcttctactacgaactgcgttggatggagtccaacagggtatctggctccgttgggttccgacttcgagatggcctgaagtcgcgttatatcccgttctagtgcccttcttctcgcaacaaatggccgaatagatgggtttatcttgaggtcaaagattcgaacccttgtttctcggtcccacagaacaa

SEQ ID NO: 101946 - DNA, 1251 bp, Oryza sativa
taacccttaaaaactcatcaaatttaccctcaaaagttgcatctaattgatctttaaaaacaagcatagatgaatctattgtagatgcaatttgttgttggatagattgtgatacctcatcattgcttaccgagtcgggagtgagcttaggacgtggcccgggcttgatgatcacgccttgacgagtcctagtgcttgccctcatcaacgcctcctgcgtgaactcgttgatgtactcctccatagctttacgatcttctccttcgaagtcatccaatgtgaccaggatcatattggatggctccacctccgtcttggatggcggcttcatcatggcgaagtcgaagttgagttgacgatgaacggatctcttccccaacggagtcgccaaaaatcgtgttggcaactttttgtgacaagtcgacaagcacgatcgcaacacctaaacgccttgcggtgatatggagtcgccaaccacctcgatctaaccaaagggccaaatcaagatgggttttgcaaaaagaaaagctaaaccggctagcggagccgatttagagatcaaaatcagcctctaggctgatttagatcgatatgaggataactacccgtctcgtgggcaaaacggaaggttttcaggacaaacctacaaagaggtgtcgcactctcgcagcggcggcggacggtttacggcgcaaaccgacaaagatggactaaaactagggtaaaatagaaaacatagtaaaagaatgattcaagtagattgtatttgggggttttacaatgaaccggccttgtcccttaaataggggttggtcttaccctctataggcccttctctacgtccaactcgggatagaaaccaaaggaaacacgaaacatgccttcccgagcaaggaaacccgagacccgacgaaaacagactcggactcggaccctgccggtctgaccgcccacatacctgtggtcagaccggccctactagccggtcagaccgcccatatacctacggtctgaccggggttgtgaaggaaactcggcactctccaaactttggcaattttcctctatttcgtccataggtgccaaattttggtgtaaacacatgcccccctgcctttttgatgaatatcgtgaatctaaaagcatagaacatattgttttagggcgataatccaattaccggccataggactttctaagcatcttaccaaatgctcgggaagtatttctttaagtatttcccattaattg

SEQ ID NO: 101947 - DNA, 507 bp, Oryza sativa
ggccccccccacagtacaaaatcgccctagcggagggcggcaagggtgccgcctgcaaaattccatgccccctcgccgcccatttgcaggcggcgccctagcggagggcggcaagggggccgcctgcaaatttcgttgacggccgtcgcccgagagcgaacggccggctgccacgtcattttcgccgccctctgggagggcgatttttaaaaatcgccctcccagagggcggtaggcgactacttccgtcaattttcaaaatggaaaattatttttgtaaaacttttaataaaaaaaattcgtgaaaagggtagcttaggtagctgtgctttttgtaaggcccaaagtacagtgtgagtttcctggcccatgtaggataggcctttgcactttggaagcccaatgttgcacttcttgcttcaagactggcccaatattactgccctctttgctagtccattactctacacactctctctctctctctctctctctctctctctgtgt

SEQ ID NO: 101948 - DNA, 723 bp, Oryza sativa
aagatgaacaaacacaagcctgacattctttttttctgaagtaaacttttcaaaaccaaatttctgaagaaaccacatcttcactgtcttcccagtgatgatgtcatgggcattgggccgtaggccaatgcctatagatagcccataccaattaagttagagataatattgttagttagttagagataatataagattaagtccttacttaaagatcaagttggtaccatctatataagaatgggattgtgtctattatgaattaagcaatgaatatcaattagtctaatctctccctcccaaacaatgttcttctccctagcctaaatctacatcccttctctaggagctgatgctgcccggctattctcccgacgatgtttatctcgtcatggcctcgggtcatgacagatgattccttcagtggactctgaacactgaaacagtacagcactacactacagctcatcagaaaaaacattggaccggataggaatgtcataggatccagttcccaaacatttgttcaagatggcctccagctatcactcatatcagtggatgcatggcgtcatctgcaagaacagtaggtagagccatccttttccatggtagagtgtagactactatagtagtagcacttgctacattggatactgctacaactctagtgctatccagttgcacaagaatctgttcttcctcctactaccaccaaattcc

SEQ ID NO: 101949 - DNA, 1257 bp, Oryza sativa
  unsure (1)..(1257): unsure at all n locations
ctttcaatcaaggttgtcgaatctgacgtgggttaccctatcagcatcttcggcaccgtgttagcgagagatcagtatgactataggtgtgtgtatttgttcaggcgtagcagggacgatccccagatcatcacctcaccggtttgtattcgattcgtcctccctcttactacactgccattcactactcaatagcatatttccttatttttatgagattagactgtttctgtcaatatgttctggttttaagttttaccgggatggaataatggaaaccatctacgtggtcaaaacaaccgtataaaagttcagggaggtgatgttatagaaccatgtaaaatttaggatcaaactcaatccgttttgtgagatatgaaattgagaaaccaggaaaaaataagtccttttcttgctgtttgcctgtttcatatctcacaaactagattgggtttttttcttgaacttttacatagttgcataatatcacctcacccacacatgagataattttcagtattattggaaatatcaaatgtttatcaagtggtttgcacgtctgcacatattttctcttgctttaacctgttataaacactgtaagaacaaatcggcttggctacataccaccaaaagattcatcaattcatctcagaaaatgcatttcactctgttatattctttttttcttgcacattagggtaccgtgtaaatgaacagttggtcctcaatgtactagtgagcaagtttgattcacacatacacttaatgttttatctcattttgtgaaaatagaaatgaggcatataatgtgattaacagggcatgatggaagttgacagtgctaaattatcaagtcttggatcttctaatgacattaactgaattctcataagttgcttatgattaaattgcatgatctagagaagtatatctttgtcatttaatcggtccatactgcccataaaatgcatgagttggctttcatttttgtttgatcttttagttagactatgtcttattttagtctaacaagcacacatacatgagagaccgaccaatttatagaaattgggttggtgtcagactcaccaccaccgaaggttttggtgagcaactgttttggttgtaaacacttaaatatcaaattgttggtatcttctcaagtttctgttgaacctgctcttgacatcatttgaatcacgctcgattantgagcttggttccttttatgtaattttgttatgttatttccgt

SEQ ID NO: 101950 - DNA, 519 bp, Oryza sativa
aattcatcctcgaaattgtgcaaagaataattaaaattcatgtgaaagcctccaacaattaaaatgtgcaaatctaaaagtcaaataaggcttggaggatttttgtatatttcctaaaagcctaaaatgcgtaaataaattttagtggaattttcagagcacaaataataattgaaaagaaatatacaaagtggaaaaggtttataaaaagaaaaaaaccctaaaagaagtcttctttccccccttcccttcttgggcgggttgggcccaatcctctctttccctttttctttttcttttcccccggggccaatgggttcttcccgggcgcgcgccgttaacaggggggcccgcccgccaccctcgttgacgggtggggcccacctgtaatcccccacctggggccgggcccgcggttggccgtgccctagcgcggccgccgtcgcgaatttcgccgccccccccggtccccgggcgcattaaagaggggggaattattccccacgattccctctcttt

SEQ ID NO: 101951 - DNA, 1153 bp, Oryza sativa
tgagatattttacaatgaccccgggtgtacatatttatacccatggggagatactagtcattgtaggacaagaaagaaacttttttaaagataaaaggaaaatataaagtccttataggacactaaacacactttcctaaagataaaaggaaactaacaaattattcctaattaatagataacttgctatgccgcatcattcttgaactcggtcacttttagataaatagatcaatttccttaaccgaatatagcaggaatccgactattggcgatgcgataattctcctaggggcttaccaaatttcaccgttaatagccgcaaccgccgcatgctggagctatgcgtggagcgccaccacggtggactggtcggcaagcgccttcgcctgccacgccaccgccttcgcccttagctgcacgacacactccaactcggtgccgtgccgcgtgacattcaaggcctccggctccttctccctcattcggcgtgcctccgctcctctcctgcgcgccacccatctccttgccggcctctccaccccgcctctttcgagaaccctcccccacctttgactcctacgacgaggatgcgcggtatggagtagaaggtggaggggacgaggagctcgctcgccgctgcccctctgctccgcccatcgcccaccccgctcgtcgcttgctctggccttctccttgcaaggaaaagagaggatagagagaagcagagagtagcgaggatgacatgtgaggccacatgggcctcaccattgtttttattgttttgtgtgtgtaactaatatgtgggcccatgatttttttatttttctggatcaaattgtcacgtaagtgtcacgtcaatgctatataggatgaaaaccttgttaaaagatctatgtaggttccatattagccaagcccgggtcaatactactgagggatctcatttgcatggctttgtaagttaaggatgtgttgtatctggttttctggattgtttgcatgattttgtaattgtgttgtatccggttttccggattgaggacgaaaatgcgataaatggagggacctattgtgaacttattcggcctccaaaactagaaacccgtaacgtgccaaacgggcccaggaaaggaaggagggtatgccttta

SEQ ID NO: 101952 - DNA, 1601 bp, Oryza sativa
ataccccttctcgtcaaatttcaaaaccatttattttattccctcaattaaatcctgatgtttcttttgagaggcactcaagtcgggttccactgagcgatttattttttcttaaaaagaatgtgtgcctcacatggacagaaaccggctagcgcctagcctctctttctctccgacctgtatgtaccattgaaaaagttcactttgactctcttttaacttgatcaaatctgattcatatccattaaccataaaactggatatgacgacttctctaactattgaaaccgtcaaaaacgatgggaggccacttcgctgttggcgctggtgcggaaagggctgggatgggagagagagagaggagaaccacttcaccgctccccgtcatcatcctgacaccctgttgcgcttacgccgagaagaagaaagagggagagagggggagagagagaagagggagagaggttactagagagaagggatgacaggtacaagaaaacaccatatttatatggacttagtgcttctttaatcatttgtatttagaattttttgttagttagtgtttattattatgtttatatatggtaaaatggtaaatttgaaattataaaggtgaaataaacatgttaaggagtcagctcgtgagccaagcctagttaggcttttagctcattaaggttaatgaggtgaggttgttactgttatagataagacatacctaatatttttatgttagacttagcaggacccaccgtatattaagtcttgtacagaatcaagcctcacacatgtaagatgttttaaataaggaaagagaagcagagtcctacttaggcatgtcaaggactactcggatcgtacttggcaccctagttatgattggacaaggggactcctaatgatataaatacaaaacgccacaggtgaagaggagagatgtgaagacatgccaatacagatttagacaattcaaggaaagcttagacaaacctaatatggagtcatagaggtccacgagagggatctaggcgacctccaatctcaccaagttcatattcgaggaagcgtactatactagctgtcgaccacatgtgagagctctatgccgctaagctgaccaagactagattagattatcccaaatttagtactcgtgtgatactgatatatataaaggcaacactgacttcagccaataggaatagggctattaggggacccgaacctatataaaaacttgtccatatcggacacgacttaaactttacaaaaataaacacaccagcccattacgaactctaacatagatttctaaaactcataaaagaaaactgactcttatcctaattaatagatacgattgtctaaaacaaactccttgtttggcaatatctttaaatccttgatccgagctcgacttatagtcggaaactgtctgtatctgctatcttttccatatcggctaaccgagtctaattttgtatcgatcgatacggctctcagccgatgcgctgcattggccttggaaaccaaattaactccttcaaatccgctgttaacaggaggctgcgcgaggagatgggaggtgcgcagagagg

SEQ ID NO: 101953 - DNA, 1504 bp, Oryza sativa
  unsure (1)..(1504): unsure at all n locations
tccttatgctgtgcaagctacccttgctgtcaatttcttggaggggctgtcaaatttcaccggtacagtaagtgcttggactactgggaatgttgaaaatgagatcatcttatatgacagtagagtggaagggacagagacaactgttaggaatgatggacgtgttacattaactcgtaatatagtagctgtcgtgtgtaaacacaagctggtgctcaaagtttgtgtgtttgagggtggcagtgaagttgcatgttttaagtttgttctagggcatcgtaatgaagaatgtactcggaagaaaggcccttatgtgctgcaagtgaaggttaggtggattggaatcatagaacactacaatcggaaaatgtgggagcgtattgggagatttggaaatattttatggtgatagtatgtgaaactctgggtgaattatatgtggcgcatacatctctagcgaagtatctttgttataggctgtaaaatggggcatgttttcccgaatttccacgaaacttgtttgtttattgcttaatgtgttggcagtcctgtgtgtaatgaacatggatcgatctagtgttcgtacactgaaatatatattattggtgttaacttttgtgccgttgaaattgtactccacttggtaatttctgtttgcctgtaagctcatatctggctattctttttcctgccattgcaatatgcaacacaagggtgtaaggctgtgttgtaatgtagaagattaaaagtttagaggctgttgtaacaagtattgcatcactgtattaattgtttgtaagagaaacattcaaacccaacacatgtacctactacatcaaatacattgataactggcattaccacatcagcatgtttgcttttgcgattaccctgtgcagagatggttgtatgttgcttggcaacattatcgaccacaacgtgttttttcggcaattgtttgcttggaaggacgcatccaatttagacaaaaaaccaggaataagcgggtgttcctcatcatcgtcttcggtttaannnnnnnnnnnnnnnnnnnncngcgccgggggtttcttntttgttgtttcctccttcttccgttttctgccgtgtggnnnttctatnttggnggtgtcccgnttggggcnncccccttgcttttgctcttgcttgcttttgccgcccgnggtgcattnccnttccggccttttgtcttgnnnccggttgggtcgccccggttttttcccttcccccgtcctcttttnccctctcggggttctttccggtcccggnnnttgccgccttcggtggggctcctctggngtcgccctgccggcctccnngcttgngtttnntntngtgtcncntggntggtcgcagtgcaacacaaancccctggggggggggggngnngaaatctttcttttgtagacgaccccgcgcagcagccgagngctctcgtggttagatctcatatgtcgcttctcgacatatccgcggtcatcct

SEQ ID NO: 101954 - DNA, 761 bp, Oryza sativa
gtgcgcccatgtgtgactatcgtctagggcgaattcgaactcggtaccctgattttccttcgtccattcttgttgctggagttggtggagcggacggaaatggagataatgggactggaaagttgcttgcaatcatatgattgatctacttatttcttatcagagctaaaattgaaccgcttgactaggtcttgctcactgccttagatgttacaacaaatactgataaccttatatttcccagattggaaagattgaggagggaatgactaccaatatgcgagtcatgaacagtgtatgatttttcttatttgcacagtagtatttcatcagtatatcatgttccatgacccatcgcagcatgaataaagcatttgcaagtctgtctctcctcatctgaacaaatcaggaatatagtttatttttttctagggaatgggttggagctctgccatttcactgatagaagaaagcaggaatgtagtttatgcatttatatgtatatgttgaagacgtattattatatccttgctgacattgttggattttgtcaaaatagatacatgcatctcatgttagagaaggaaaaaaaaaaggacaacagttagacagctgtttcttgaaacctcctcttaggacaagaaaaaaaaatgttatgctgtttgttgttaatgaaaaaaaaaactttatgcttaagatttcaactaattgagcgggtttcacattttttttgtaaagattctgactgaggcagcaactgg

SEQ ID NO: 101955 - DNA, 650 bp, Oryza sativa
ccgtattaattaagctcacatatatcacactaaaaaattgtcaaaaaataaatcagtatatcttgtaaaaattgtaaagctatagatcaatatatgatatatatctttttcacaaatatacaagttaaaattcaatctatataagtagaaacaaaaatatcacatttgtgaactacacattctatttatagttaaatttgtcaattttttctacttgtataagttgaatttgaacatgtatgtttgtgaagtaacatatcacatattaatctatcttactccctccgtcctataatataaaaaggtttagggttgtacacggttattaagaaagtaggtagaagaaagtggtggaggattgtgactggataagtagtggagatatgtggaaaaagcgaatggtggagggttgtgattgattgggaataaaagttgttatattttgggacaaatcctgagggctaaaagttgttatatttttggacggagggagtactatattttataaaatatttttgatgacttttaagtgatataaaaaatagtaaatttcacaaaactagagttattttgatcaaactatcgcaaaactacagttttaagacgtatcacaaaacaacagatttagcaccatatttgtcacaaaacaa

SEQ ID NO: 101956 - DNA, 817 bp, Oryza sativa
catgatccgattgcaccattaaattcgttgtaattaaatctttaaagcaagaccacacatggatatattccgacggaattttttttagcttattattgaattatttttaaatgttgcacgatgttccactaattatatcggaattgtttcactatttagatcgaaaatatttcaatcgtttgaatcggacattgtttcaccttatataaaaacaatgtttcagcaagtagcgaaagaatgtttcagttcactgcaacatttgatactataagtacactaggtgaaacatttttcgtggaacaaaaaatgaaacgaattcccttaatagaaggtttccaaaatattgttgatgtgaaaacacgaggcctggaagatctgcttaacttcagtgcaggtccaaaaatcttgcgtttaggtttgtgagcgtgccagttgatttgatcctgcagtcaacaagaaataaagacaaagaaactacggttaaattcataaatgatagccgatcgaccagtcgccgatgacgtatgatttatctttgagccgatatcgtatttgattcgatcggcaatcataaataggcaagaaagaactaaatctattcgatcggctgtaggtatcaacggaatataatccctacgtcgatatatacttaaatcaagcgattgggatagatcggtcatcacgccgagacagtataaatcacttagatcgaaatatatactaaggaaaggactataagcattcataacatagctgatcagatagatctagcatgaatcggctaatactccgataccactatattaagatattaaag

SEQ ID NO: 101957 - DNA, 708 bp, Oryza sativa
cgcagagatagtgcctaaaacccatcgctgcaagagcggaaagcgaatggattctgagatggtcacgaccggcagactcaatgggcctgacccaagttcttccttcaggcgcttctgtctgaccaactcttctgccatgagtagggattggtgacaattcttgaatgcccttctgcctacttcaatgttatggccacctacatcattataacttgtgctaatattgttcatattaaataccccttccttctccttcttggagtagtgcagttgagaacgcggaggcagactctcttcagcgtcgctcatcctataccattttcctgtcacagtaagaagacaacatagtacattataattggggaacacatgcatgctggtatctactagtagaagctaagataataaccaccgacttgtgagctagttaaactggtggtacaggatgcagaggaatattcacagtacacattgggcaggtatgtgcaccctcattgggcaggtatgtgcacccttctaactgatgctaatatgctaccaccaaccaattaaaagcaagtctggattttggaaaagaaaatacatgcatgtcagactgtttttatcctaatgcaataaaacaacagcagaaaaaggcaactactagaagtgcatgttttgtagtctagttaagcagttgttgataatataatcatcggtaatattgtg

SEQ ID NO: 101958 - DNA, 631 bp, Oryza sativa
tgcttcgatatatatttttctagaaaatcatgtaagttagcatgcgagtttttttaagatatttcttatactgactccttctatattttcaaaagcggacgaacttaaaacccgactcaaatactgatctgtatttccaaaagtaaacgaactgtattttccaatatggttaaaaacctattcatacacggataacgtaccaaaatatcggtaaaaacatctttaatttttataatagtagagactagattcatagaaaggaaggctacatacagtggcggagggcagctaggtagcgtctgtaccccaaaagtggtttttacacaataccaaacatataattttaatactacaaaaataaaaacaattcaaacacaaacaagaaagctgttcaagaaagttagaaactcatttgtattattagattttaacttccacaaatctataccatacaaattaaactagtttgataatttattgataaatatcattatttttctaatcatcccatctaattcagagtctgaaccacatgacgaaaattaatcctggctccgctaccagctacgtagccacttatgtcttttcctcacagagatcaagtccttgaaaccaatatatcaagtagtaa

SEQ ID NO: 101959 - DNA, 1210 bp, Oryza sativa
cctaggtggaaatggtggtggatgaccaggagaagatgaatgagaagaatgaggttgcccttcgtcttaaagggaaaggtggtcccatagaggatgttgaaaaggtcagttctcatgggcctgttatcggtgcctagtatcgtggttatatcaaatctgctttgtagttaagtcctttcaacttgtctcaagggtgtaaatgtctaggattcctgtatggtgcaaatactctataggcgcacgcttagagcccatcaagcccatcatcctgggaggtagaggagtctgatttctcttctcgttccttggttcactcgtcccatcatcttttgtttgttctagatcaacaggattggcagagcctcttgccttcacccatcgatctgtgcatgtgtccgaccataacccttgtccccatcaccgtctccattcctagctgccctccatctcctatctccctctccatccctagctgaactcctctggctatgttgcatccccatgtcctagcttctcaaacctagccaccaggggtagtgatatgcccgcaagccacccccactgccacatgccgcataggagcagtagctggcaccaacgatgtggtcgtagctgcggccgtgatcgagaagacgttgacctttaggaagaaaatgagggattttgagtatgacatgaaagtttttggatttttcatttgaaaactttgtggtttttgaatggaagtttttatttgaattgaaagtttttgcaatttttccgatgaaagattcatatacgaatgaaagttttatgatttttagataaatgttttcatatgtttcaaatgaaagttttgtgatttttgagatggaagtttgaggcaaatcgaaagttttgaatacatggcgatccttgagtcaaaggctggctccttggtgctagcacaagatgcctcatgaaagaaaaatcaaaaccatcactgtgagcacgaccttgtgcgacttgcatcgttagcacaaatgcgctatctagaaacccccgtatatgtcttctacaaggtgattgaaaataatacttgactttgatagtgtcagggtaatgtataaggtataccttcataaacgaaggtttatggtaatatacagataccatataagggaaggtgactttgtaataaaggaaattatctccccgaatagaaagtgtcagagtccaacttagaggggca

SEQ ID NO: 101960 - DNA, 637 bp, Oryza sativa
cccctcaaatatgagtcaaaagtgtatctctatctccattgctctcccatatggtgtcttcccctgctttgttttcttgggagtataagatcgataagatatagaaggatgagatatatggcacaaaattaaaatgatatctgaagcatgcagagaaatatggagcctttaaaaaaagtattatctttcttcagatttagggagttaaaaatagggagatcgatgaagataccttataggataacaaaaagcccgtcaacgccggacatacaggagagaagagtcttgaagtcttaacaaggtgatagtgatttgcgcacaacttgcttgagagagtaggtaaacaacctagtcagtcaatgcccccctcatcaaggcccaattgtcagcagtacggtctccactatacatcagtacgaaaatgagtaaacctcgccaaaaactatcaaaactaggtaaaagaataatctctctttcacctatttaatagcgattttgacccatatctatgataattacactttttctagagagtaaggaacagaggagaaaaaatggacccacatagccaatggcagattggagagctatggctcagataggaaagattgatccttgttgtcgaaaggggtaccga

SEQ ID NO: 101961 - DNA, 650 bp, Oryza sativa
tggtgccttaagttgattggcttttgatttcttggagtttttgttaaagcattaattctccggactttggcagacttgactctttctttctacttcctccgttcccaatgtaagaattcctagcattattcaaattcatagagatactaatgaatctagacacatataaaaaagatatacatcaatcaaaaaacatatacatcaatcaacacataaatctaggtaagacaaaaggtcttacaatatgaaacggagggagtactgcatatggcaaatggtgttactctatgtcacaaagtcgagcaatgcatgtgagacaataattttttttaggtttttacacaggagggatgagattgttcgcgtggtcctaggataggaacgatgttaccaggacaagtaacgtggtatatgtcacaaagccaagtccaaccgaatcgcgacccagttatgcacccaatgtctctttgacactacttagcaagaatccgccctagactgctaccgcctactcgagaccgttgtcgtgcagatctcctctatcttctgcttggatctatgaaaggagaagtatagagtggagagagataagaaaaaggtgagaaaaatcatgggacttatgttgcccccggtttcatggttgacgaatc

SEQ ID NO: 101962 - DNA, 512 bp, Oryza sativa
accagaaagagaataggactcggctcgtcatacaaaacgaaatcgtggcgcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctg

SEQ ID NO: 101963 - DNA, 590 bp, Oryza sativa
aattctagctcggtaccccacctacggtgcatgtctcgtggcattactccacatattttttttcgtggcaccccaaacgctcccacatatttggtccgcagtcgcagcggtgggagcagaatcttggactgccgtgagacggcgatgaggcgtaggccagaagaagcaagactccggtgggctcgtccaacatcagcaggagcttgccgttgttgatgcagtccaagcaatgcttcccctgcatctccctgaaatgcttttccatctaagcttcggtcggacatgtggacaaaagtttgtgcttgactatggtgtccatggcctgcatcagccaaagcctagtgccaaaagccgcggcagcgatcactcttcacctggggcttcctagtgggcgcgcaagcgccagctgctcaactcgcgctgcgcaatccccacccccgtaatcagcattaattaccataatcagtactattatttaaaaaatacataatgagtatgtaaaaatcaacacagaaaaggatatgataacgaaacatgtaaacattttcgatatctatgaaacatattatttgagcaatgataccctatag

SEQ ID NO: 101964 - DNA, 633 bp, Oryza sativa
gcctgcctcgccccaccgcgcctccgaggtcgccgtgccattcccggcgaagtcaatgggaaggggaaaagaaataaagagaaggagaaaaagaagcaaagagaagggacaatccggacatttagaaaaatatctcaccttttttatccggaaataataaaataatacaattggtgtccctatggccaattatacgttttttagagtcccatcagtcgtgttacgtttttgcggtgtctcccagccaattacatattttttgcgtgtcctgtggcaaagtttgcattataactatttttattatgtggcatattagatactcactccgtctcataatataatcatttttttatttcaacacaatttttgatatgatactttacctaacaatatctataaacttaatatgctttaaataaaaatatatgcatatcatgatagtttgtttcatgataaatatagtaacataattgatcttttctattttttttgttatcagtagtaacattaataaaaagatatgcgctattttataaatgcttatattttgatcagagtgagtattaatgttgcttggtttctagaactatgatacccataggaccccgggtcattaacgtgtataggcctcat

SEQ ID NO: 101965 - DNA, 684 bp, Oryza sativa
ctgaaaatgacaccctgttctgagagtttacaagggaagaacaattacttggtttagctttaaggctgagtttaaaatagataattaagtgggttgttgttacaaattttttacttaattatatggataaatttaatattttaaaaataatcttaacaaatacaagtagctcaaaacataaagggtataaccgtacaatacaaccaaataaagttttcttgaatttttctttaaatgtgaagcaaataatctgcttcaataattaaaaaaaaacaacaaaagctctttaacccttccaaattgggaccctactatactgaacagcagagccatctgtcaaaggtgggccccacctgatagtgagagatgttaagctgcagtagtagcttgcagttagccaaaggggacagtgtccttttcagaaagcaatggcgtaacgcccccaccggccgcagcctaagcctaagattaggcttaagctaagctaagcttagttgcttcacatgctggctttccgcatctttatcatggctgtcgccaagattggcgcccccaacttgctcttgttttacaactcgccttcaaagttcaaatttgttttcctttttttgtcggtgttggaaataattcccaagtcttatgtatgggcatttttttccttcaaagttcaaaaggtgtatgttg

SEQ ID NO: 101966 - DNA, 624 bp, Oryza sativa
accacaaagtaatgttacactttgcctttttctcaaaatggcaggagcactgccaataaaataagcagaaacagccacaaagtaaggtacaaagtttattattcccatctcccaagcatacccaagcacctaatagctataatgcaggtgcaaagagcacatcaataaaggaagaagaatgccaaaaagctagtcatcaacaaagcaaacaccatgtttgagatatctggcagaataaaatgtttatctcaaacaagtcttcgtttcttttctatttatattttatcagatttggagaaaaaatgatattagtatctcactcacatattttttcgtaatgcctgctcatgccatctggtcttagtcagatgtcagacagtggcctaaatttcacgattatcaccagccacaagaactattactattcttatatggggaaaaaaatctgagccacaaataacaaatattaatagtatgataaaatgaaaatattgtgcacaaatatataggagcatacctctatctatgtttactgcaaaagtgcttgcgacatcttttgattcactgatcccaccatctttacttttccggacattgtgaaggcacagtaccaacgcgaaaagt

SEQ ID NO: 101967 - DNA, 647 bp, Oryza sativa
tattatcataagataaatttcatgaaaacaaaaacaccatgcttcttccataatgtaggaattataactgagagtatactggtactacaagagaactaatcaatttatcatcaaaccctctcatattgtgtgtgaccatgtgtgctttgaaatcataggaaaaatgcctttcctgatcagattactagtaggttatccagatattattcactactagaacctaataataaaaaaaataagattatgccgaaacatttttttatttcataattacttgaattgactatatatgtcaatatgtgaaaaatatgtgaggatatgtaggtatatgtatactagtattggaacagattctgatacaaaggggcctctactacgttacgtcgttgtccagtaactttcgacctttcaaggtatggaatgactttctgccaatgaattatagggcttacatcgaactattttttatgccaaataaaattaacactcagattttgtcacaaagggtctctagtatgtattgtccactttccacgtgtgcaacaattttgccaatgaattgtaggccttatgtcaaactaattttggcgtcgaatgaaattaaacaatgacattttggcattaattctgtagcattatgccaagta

SEQ ID NO: 101968 - DNA, 1120 bp, Oryza sativa
ttgccttagccgattgcttctattaaatgatcagcttgaaatttctgcaacattgctgcacccaggacagtcctcgatagatggcaacctcataccctcattccagcaaaatctaaagaactcgcagccccaatgaggatcaaaaccgtcatcaccttcttcataacgcctctcctgttgtttgtcatacctcttctgatacttattgataattttagccgaatttacctgaaaacctcttgcatgaccccccatcggctgtccggctagctgtgtgcaccatattgactggaaaaggattgccatcaaccttcattggcctcttagagtcttcaaatttgattttgcctccctcaatggctgcttggatctgcagcctgaaaaccttgaaatcattggtagaatgagacccagaattatgccactagcaataccttctcttgcccaattcttcagccgatggaattgtatgaccaacaggaagttgaatctacttctctcagagtagcaaatcaaaaatcttgtcagccttggtaatatcaaagtcatacctctcctattttccagaattctttacccattggcatggtataacctttttgcttctcacccattcggctgctgctatctcagagtcatcatcattatcatcatcatcatccgatccatatatgtaaggacatacatgattaacctttttgaagttcttcctggcttctgcaaacctctgttcatgcaaggttaccttctgtgcaaaatgtgacaaactatcaaagtcttgagacgagaacttctccctgatcggagcaatcataccctaaaagccaaatcggctaactgggcatcagttaaactcaaattgtagcacttattccttatctctctaaatctctgaatatactcatacacaggctcatcatgtctctgcttgatcgctgttaaatcgaacagtttcatctcgtgaatcccactgtagagatagctatgagagtgcttctccaaatcggcccaactattgattgatccacatggcaaagaagaaaaccaagtgaaagctgatccagacagagacaatgggaacaacctaaacctcaaggcatccacagccgatgcttcacca

SEQ ID NO: 101969 - DNA, 759 bp, Oryza sativa
tcgtatctccggcacaaacagttttcaaatctgagaagtgagcttgacttacaaattcatatatactataagggaagcgagatgagaattaagctagtaattaaccacatacaagattgactatgggtgaacatgaaccacattcatttaataaaacacatgcagcatgctgcgaatttttgtcttaatggacttggggtagaccatgacttgtattataacatcccgatggccaaatgaaacattgcaaaaagggggaaaatattctgagaatcactcggctgacaccttatctcgagatggaacaagtggactggcactcattcatgttcacccatgaggagggtgtgctaaaccagatgacagctcatcatctcgcagacatggaggtgatgaggcgatcgtacaaaaatatctgcatgccatccgaattgaagcaagttgatgcaatacgctgcatgtgcactacggatcgcaaaatatgccatgccgcattcatcactggctgataatacttcgatcactgggaggcaatctttgttaatcggctatcttaattgatgtgagatggtgcactaccaccatcgcgcatcttgtttctgcaaagcttgtttaacgcacttatgaatcgcgcatacagccttcccttctgaactgtaatatcatcaagctccttcacgctagacaacagcctactcgaagtgtactcggagcatggttctggagcctccatatcttcctggtgagtcgacgtaccta

SEQ ID NO: 101970 - DNA, 904 bp, Oryza sativa
tgacttttctaagattctaaacatgaggaattttaacgttggactaaaaccatttgaaagtagacttcattaacttttccacaagtatgcatagctcaaaaaatccttctggaccaacggctaggtccattctatgttggtgctattaggagggctaaatccgaatctaaaacaaacataacattagttcttgtcttgtgtggcccaaaagtgatatggtgatattggagtggacttcggtgaggccatggtttggtccccaatcaactttatgcaaataaaagcacacaaaactcattgtgcaatgatgttttttcaaataaataatatgtaaatcttacatagaaaacatggttatatccaagctgatgatgtccttatcaatactatttaccttttttaaaaatctaggctttttaatttgtttgttagtatttaacacaaaattactaacaaaaaagtttgtccattatacaattattgtagaaatttatagtaagtacttgttcggctaatccctctgtcataggtactgaaggggatttgaagaggtgtgcaattaatcctcttcaattccctccaatatcttcctcatgggggcttaaccacacaagccttatatgacctagttattgcaaaagttctataaagtttcggtggtagtatacacatatataaactaacaagcacggcaactggctcgctgattttctagtttggtaaaattctattcggaatcggccatttgggctttgatgtcgaatggtgttccatttgaataaagctgcttttatttttattccaacatgcttgtaaggaaaaaatatttattaatgtacacaaagacatcattgataatattgttagttattaaacatttacattagtttatcctaacattttg

SEQ ID NO: 101971 - DNA, 664 bp, Oryza sativa
ggcgacactgaagcacgatatttgttaacgaggttcagccgaagcctacatccctggagcacttattacagacgctccttgatctagcatattacagcgtattagagttacagcgactcacggcaggacaccaccaaaccactggtggatgataaggcttgctagaggtgaggatgctagtcataatcatcccatcttgctccaccaccaccttagcccactcccaacgtaacggtaacctgaaggtcgccccaaaagaaaacatatagatatttatgatttttttgcttggtcaatattgttctccggataaaggattttgtcacccacataatgaagtgttaaccgaccatcaattaacaaggccaacatatcttctttctttaaaaatagggccaacacatgtaataaaaataacaatataaagtgatactgtcgttccacagatagagtaaaatattaaaaagatgcttcctatggttttaaaaaatataacatttagaataacatttggttaaacatttaaaactttgatcatcaatagtttttcaaattctaagtttaaaaagaaaaaaaaggaatgtgtaggtttccctaacaagtataatcataatgccataagcatattaaattttatgaacttattatcatacaaaattgatgg

SEQ ID NO: 101972 - DNA, 1583 bp, Oryza sativa
ttcacctttgatccaccagaccgattctttttgtgggaaacggtcttgtcttgaattagaatcaggggcgaagcccagtgaaggcccgtgggtgcagatgaaccccccccccccaaaaaaaatagttattacccccatatctcggccctatatgcacccccctcggcccaatatagtgcacccacagcccaaacaacagtccagttagcgttgtaagcccatgaggagagtagaagcgagatcaatcttttctgttctcgacttcttgtatgtcgcgtcacgtcgccgccaatcttgacgactccgcctcgcgtctgtttggcttccacgccgctgctctacaatcagccaatcccagtctccgagacagctcgccgtcggcgttgcccctgcttgcttagcacctgcattgctccagccgcagcccgcaggagccagaaaggcaggaagccggtcgccaggctaccagctaaccaggagcaagcgtcataccacactttctcaagccaacaacgacatcatccatctccatcatctgaccagcacacagccacattgtgcgttagtagagacaaggtaagaaagcatgcttcatctatttctttttcaatcaatttgatttattagatacaaaggcctaaaatttttattggttgtttttttttttacattgtaggattaggaggccagtaggcttcaatttggaatccttcataattggaataaaattgcagattgggggaaaatttgagaattgaaggtgctatttggatgtaagtcatgtcaattttcattctacttctgtacttgaatgaatgataaaatcagtatacatttacatcctcctaaatcatctaatgataggttacgtggagaaagaagaaatgaagaaagtcaccaatgaggcccttgttcgtcgcttcatgaaaatgcaaggacacagatttgatgatgattgaagataatgattgtatctaagtgcgttggattttttttatttgaaaaatgagaactgattttgatgttaacttgttttaggttatcaaatcatcgtcgaggatattgtttgcttatgcagatcatcttctgctcatgggttagtaaccaattatcaattatcaatgttattagtggttttcttaattttgaaaaacaatgtttttcactttttttattttattgatgcatgtgagtctctgtactgttgattaaaaaattatcgatcaacagttccattgaaaatgtagcttgaagttatgtatattgatatacttgtggcaaaatctcgaaccccctctattttgctctagcttcgccactggctgggcgcggccaccggcgacacgatgcagcacggcggcgggcacgggaggtggccggtgcaagggaaaaagggagaggagatgggggctcaccgggcggtacggcggaaggaggcggctggtggcgggctcctcggggtggcacggcaacggtggtccagcggtgttccacgagcgggaaccagcggacggcggtcggaaggacctagggaacaaggaggaaaggttagggtagggatgggagttgcggcgcggcgagaa

SEQ ID NO: 101973 - DNA, 1908 bp, Oryza sativa
ttgaccacctttgctgccattttctgttcctttcccaaagctgggctggtctctctctctcctctggttctctccctctccagttttgacatgggagagggtgtatgtagaatactatgtgtgtgcatcttgaccacgccataaatggtgtagggacttgccgttaccagttgtgggtggtggtggtcattggggtgcaaaagaaaagattgtgggtgggcttggttgtgatgtttctcaccattgtaccctagggcctttgcattttagatccacctgtgtgttctttgctccctcctttttcacaaaatgtatatcagcggtggagccaggaatttataaagatcagggctcaaccaatgcgattcgtcgaatcttcaaactttccatggatttttgaatggatttacaagggatggagacaagcctaggatgctcaagcagtcaagctagccgtctccgtccctgtgtatatgtctattgttctgaagaattcgtttccacatacatatttgtttgttaagaatgctaacagtatgtagttattacgatttttcattccttgtttctaattgaatgctccaaaagaggtaagatgttgtatcatgcatttatatgtagaggtatctatggtcctttctcattgatttttttcttaatttgagctttattgatctgttcttagttcgtacagtgagccatggacgaatattatgaagaggactgggtatggtttcttttaggacatttttcgtttactatatctccttgtgccagtgcagtgatagctgcaaatgcatgttattctgttgtcttggcaatcagtcaaggcatggtccagttctcagcgagtttcaaaatgtgaattataaatgagcgttgatttcagcagcgctgataataataatgcgtaaagccccagcattcatttgattttgatatcgttttccctctgttgcgtctactcagacgaatacaacgtagtagagtttgattgagtaggccggagtatattattgtaggaatggatactatggaactttttttttgcatgtactaaacacgtttcccatattttaaggagtgaagaagcaaatacatttttttttcttttgaaacagaagaagcaaataatagtactagaatggcaagacactgagaatggccaatgcacgtgacattatattatgtttcttgtgtctaatgtgccttgcaatgtgaaaaaagtagtggttgatcttgaataaatgatgcatacccatacaagcatgggcaggaccgtccttacagtacctacttgcactaaaggcttgtgatatggtgtactttttggtccctatgcaagaaatgcgggtacatgtcttctaggacttaaaatactgtctcatttaccccgtgtggccgatgtgtctaaacttagaagtgatttgaattattgattattagttatcccttaacagtagaaaagatattctaccactgataattgaggtggtagtataactagacacagtccattggattagaaaagatggacaatctacattgatttctaggaccatcgcaaaacatcttctgtaagtatcttgtatttgcacacttgaacaggaccaccagaacacaaatatgccaacagtggtccaagatactggttgtttcatcttctttttgtccacttatagtgcaggcctttgatcgtatcaagggtcatacgaccagaactacgatgcaatatagtctcggtcccatctatttttaagcaactaaggattcacccttttttaatttgccttggatagaaaacacaagaaagatatcattattgatttggtggtcctggtcagtttcttgattctttggtcatgtcctggctggtatgctggaccttgtaataataggtagcagcca

SEQ ID NO: 101974 - DNA, 513 bp, Oryza sativa
  unsure (1)..(513): unsure at all n locations
tgagtatgagaactcatactacaaaactatcttcttcctgatctttatgacttcaaaatttattcatcttttgcctcttgcaatcggttttcatgagttgataccttctacatcagatgagctaaactttcaaactcttgaatggaaaaatctttctttgataggtgttgacaatccttgaaataccaattctgctaattgtgcatcacttaagctcaaactatagcatcgaccgcgaacatcacaaaatctttgaatatattccaaaaccgattcatctacttgttgcttaagcaatgccaaatatgtgagtttcatctcattgattccagcaaagaaatacttatgaagctgcttttctagatcggcccatcttttgatagaatttgaaggtaatgatgaananaacccccaaattttaaaatttaaaaaaaaaaaaaaagggcccccccatccaaacaataacaatggaaagaatctaactttcaaagcttcaccagctgatgcttctcc

SEQ ID NO: 101975 - DNA, 1644 bp, Oryza sativa
ttacatacaaaccaaatacatcacatattatacatctcagatctatacaacaaataacaaaattatacatctcagtgaatcacaattgtaaaaaaaaaagaaaaaaagaatggatgccgtagcgccgcctgccgccgctcgctactcggcccgtgcgcggcctgcgtgcggccccgccggccgcctaccgcgtgcggccccgcctgacacgtgcgggaaggaggaggggaggaggcggccctcgctgggcatcggatgggaagggaggaggggaaggagagggctgggatgggagggatgggaagggaggaggggggaggagagggccgggatgggaggaggaaggggaggaggagagggagatggatctgaggagatgagaggccggttgttgaggagattgaggccggttgtgggggagaggatagggaatagggattatatactacgtgtgattttagtcccggttggtaataccaaccgggactaaagtggtgagctttagtctgggtttgtgacatcaactgagactaaagatccccgcccctctgacaagagactgacaggggatgaactgggactaaagattgtagaatggctatggggttttaaactgatctttagtcccagttatttttataaccgggactattgtgttttgggggtgaccgagcaaagatcagttttccagtagtggttggtagccaccatcacctcaccgactccttagggcattctcagtgtatacaacccaagttgcttataggttcccttaacttggggcccatggaaattttctacgagagctacaatgttttgttgatgagagatgtataagtatggacctcacatgctaaataaaatatgcaattcctagctacctttacatctaacctcatcatcgtccatatatatatctcgccctcagagagatggccaggcgtactttctcgcatcgagacgagaattgatgcgacttatttattcattaagggcatgttgtaagcttatagccgattgatagcataggatcgcctaagattttttccacaattaatgtatatatgtcagtcataagaagcttatgacatctccttatttccatattgcatatgtccttacctgctatctatcacgattatcaaccaccatcaccgcccccctcctttctgctttcccaccctaatcctgctcaaaaaattgtcattgggctcactgaaaatggagcgggaagctagctcgttggagcatgagtgatgcaacagacgagagtctggaattttcaagattttgctccaacattttacttgaatttacaagattttagccattaaatccgatattgcggtaacgtaggaaaaaaaaaagggattgctatatggcattcgaatgaaatttggggatgaaatcttacagattttggaccattggatccatgccaagattcgtgcattggcttatctcctccaactccagtgggctccccttcttctccagcgctggcgacacctcaactccggcgggttagggtttggggttggggtgagggtaggagggtggttgggggaggaggaagagggggtttcctcacggcttatagggatggccgtgggcggcggaggaccagctgagggtggtggactc

SEQ ID NO: 101976 - DNA, 520 bp, Oryza sativa
ttcgtaaaaaaacttaaatcttggctatgaacataaacacgtcatttgattacttttttatgatgggatacattataacttctttcatctggtactgacatagatccatatttaatacgtgtgtatgtgatctgcacactattgatgctctaacatgctaaacaagcaactcgaaagctagctcgttaagcttacaaactataagactaatttgacttggcttattaaaactagagtctattcgagccgagctcgctacacaagccaatttaaactactactccctccgtcccaaaatataaaaagttttgaatggatgagacgtattttaatactacgaatttagatagactatgtatttaattaaaactccttatattttttggattataggacgaagggggggttaacccgaaaaaagggccctttttttaagggggaaaaggggcccccttttctcgcccctggggaaaccgaccaccacgggatcgacgtctcgctacgctgtggcgctgcgtgc

SEQ ID NO: 101977 - DNA, 4379 bp, Oryza sativa
ttatagtaaaacgaatctgaataagtgacatcacatctaatattagtggaaggggtaagggtgtcgggccagtatcattgctactgagatattgaactttggctccaatgacctttgacctatgcaagacgtttattacaaggttcatttctaaaacatttttttagatgtttattataaaatactccctatgtcctaaaataagtgcagttttgtactattcacgttcaacgtttgatcgttcgtcttatttgaaaattttgtatgattagtattttcattgctattaaatgataaaacatgaatagtactttatgtgtgactaaatatttttaaatttttcataaattttttaaataagacggacggtcaaacgttgggcacggatatccactgctgcacttattttgagacggaggttgtaatcgtttaaaaaaaataaaatgtaaaaaatccagctcgtacaactcctatccaagagatcagaagaagggtacgggtacatgatgactcaggtctgaggagcacctgccacttggggacaggccttaacggtagtagccatctgcccactagcttaccgctcagaaacttgggtccctctgaattctgacacgcctgtcacttgggcccattctgacagaagcctcatcagccagcagtcatagaaacactagccccaacccaacggtccatcgccaccgcataatacgtacgcttctcacaatgacagatggaccccaccagtcagtgataagtacgctcctaaccttttgcctccacgaaactctcgtcctttctcaccgttttttccaagcgcgtgctgccgttccgttcccaccatacccctgtaggagtacatgccgaccaaaccccgcacaccacgcgtcgccgacgcgctggtcccacgcgtgtgggacccaccagcccgtgacgcgacagtattttctcacggtatcagtggggagcgtccgcctgcttatcctgccgccgcggggaccatggcggcacagtaaagtagcatgagggcccacatcacctggagcaagtacgcgacctcgtctagcccacgcgtggcatccccaccaaacagccactgacatgtgggccatggctcggtgtgcccccaccggatagtaaatgccggtctagatttttcgggggagtacctatacatctttcgaaagatttttataatcgtatcacatagatttttaatctttagattaaaatccgatagatataataaaaggcaaaaggcaattaagaaacaccataatggacactaaattaccatatcctcaagaaaaagatcaaatccaatacaaaatttaaaatttatatacgaagattcaaaaattacagtgtaactaacaaaagttatagtgtaagtttcataaattacactgtaacttataaaaaaatgcactgtaaatttgagtgagaaaatcgagtgagacataagaaaaaatctttcgagcgagatatagcaaaatcgatttttcggtctccgttgccgtgcgaggtcttcttcctttttccgacgtggggcacgcggaagtggggccgggcccacctgaaagccacgccgtactttgtttaatcactgacgcgtgggcccgggtcactgtgggtcccagatatcagtgagtggccttgaggagagttggtgccgcccgcgtccacttgtccgtcggctgcaggccgcgactggcctacgcatccggctcccattggctgctgctgcccacggcccacggcctcgttctccacaccgtggggcccacggagatgtggtccaggtgcagagcgggcgacacgtgtcgcgtcgggaccggacgccgggatcacgcctcctcttcgcgccattgtcactcgcgcctaattctacccgccctttaatctctctctctctctctctctctgtgtctggcttgaacggaggcctcttttcttttcaaaaaattacaaacaagtccttgttatcttaaccttttttgttcaatgaaaagagtgtcaataactaaatatgcaacagtttcacaatgtacgtatgcatatattaccctttcaaggagggggttttggtctttttacatatgatactataacagctactactactaaataatatcgttgatttgtcggtatatgtttgcaaatgtatcaaaaacatatgtaaatacatcacacaattgctctttttttatccgttcttatattatctaaccaagagctcaacgtcacggattagctagactagtagtttagtttggacatttcttggtagttacatataataatcctataatgaccacattcgaccaaattcttgtatgcagaatctgttgccttgcaatccacgaccaatgctttattattcgttgataatgagtgtataatagcttgtcaatggtatagatcaataacttgatcttgcttctgcggtaagctagctattgtgatttgatttgaaatgtgtcaaatcttttttaaaaagaacaaataatatgtgttatctggccaatagtcaaatgaaatttaaagagcttgttttatgtttattgaaccatggatgtggttattaatttagttttaaatatggagttcttatccacaaacttgtggttattaatttagttttaaatatggagttcaaagattgggattgatcaagatccaaggatctgtttagtgtactactagtctccagaatcaaagtttgaacatcatttttttaaaatacattatatgaacaactacaagagttacataatacgggagtactttccaatatgaatccaatgtaaccaatttatgcctctaagcatacattttgttaggccaattattagtcaaaagtttaaaaattaaatattttgaatttatgagcatttattaatcagtacagagattatatatcggcctttctaccaagtatggatatctgtatatcctgtatagtttttatttgacaagtatatagacattgcatggtaaaagaattgcaaatctaaaatacaaggggtaattataaagggaaattattttagagctttacatggaaaacagaaagaaaagtattcattatatgattaaataaaatccatgtgagattttgtcaattaactattagatgtgacaattattagttgtttgtcaactgcacaattaaataaagaagacactttttcaaatggaaagctttagctatatagatgtactttaaaagttataaatacaaccttgccataatttagttgttacatttttcattcactgcgtttaaatcttcactttagccttcttacagccaagtaggtttgcaaaaaatgacattgtgcataatacatacatcaaatagttaatgggatttaatttatctttgtataatttctttgttgcaactatattcttgtttgcattaccacattattttaaagtaaatttcaataagtaattcagcaacaaaactatcaaaaggacaacacaattccctttgaattcttgatatgtacaaaaatgaagacagaaaaatccttaaaacagacaagctgaaatgattgagttggatatatattttgttaaacagtaccttttgatttccacaatcatttcacttgacatattttcaggcttatgtgagttgtgacacatattttttttgcaaaaaaaacatgaaaattttgtgagaaattttatacgatgtaagactaccgacatcgcaatcggtttttgttgtttgttgattccaagggaaccaaacaccatggtgattgtttcatctcttatttgttgtctctaggctctctctgatgaacagaattataggtatatttatccttggaaaaacaaaatataggtttatgcttttatcctgaatttttatacattcttatatcattgtgttgttacgttctttctaattctgttaaatatatttgtagttttacataatttactccatattttttagaagcacgtcgtacacaagtttgaacgatatatatgattgaacgtacatatagacttttaaaatgacaaatatttggtgaatattaacggtaaaaatccaagaaaggttgtagagctagcaactttgtccaaattattgcattgctttgtactgtcttacatgtacattaatatactgaagaactaagatgcaatattgaggggcctaatcatggaattatgtgcaaattgtaccctctcatttcctagcaggcatatatactactacttcctccatcctgtcacatccacccaatatcctttagtatattatgggatggaggaagtactgtataaaattaccgttgcaaacactaaaaccccatggagcacacaatgcaaagtttggcacggagaacgttaac

SEQ ID NO: 101978 - DNA, 1444 bp, Oryza sativa
atataaccatgttttctatgtaagatttacatattatttatttgaaaaaacatcattgcacaatgagttttgtgtgcttttatttgcataaagttgattggggaccaaaccatggcctcaccgaagtccactccaatatcaccatatcacttttgggccacacaagacaagaactaatgttatgtttgttttagattcggatttagccctcctaatagcaccaacatagaatggacctagccgttggtccagaaggattttttgagctatgcatacttgtggaaaagttaatgaagtctactttcaaatggttttagtccaacgttaaaattcctcatgtttagaatcttagaaaagtcaagtacctttttctagtctgaatctactttgggccttataattgactcttgcttggttggcctatgttatggacaacctaccatcccatgtaactcataaatagatagccttcatcatagttaagatttgggttttgcttagatcggtttgtgtaatgccaacttcgtgagcttcatattcatctgcaatttagattgtgttatccttgttgttctgaattccttcgattgtttgcataaacataacccttgtggttaggtcgattatgagagcatagtcgataacggcaagacttgtgggtgtagtgattgcaaagtgatgatcggctgatcggaagcctcaaaacgatatcctaatgtcaccaaatcgaacctatcggaagatagggcacctgttcacatcaagaattttctataaattgtgtgcagcttttacttttcttaatcatgttccatttgaattatatttttcctgttgttggtgtacctattcaacattgcagttgcttctcttccttatttcactgttttagtcacaccagtcataaatatctgattagaacacatttcggttaagctgaccatcaattttgtatgataataagttcataaaatttaatatgcttatggcattatgattatacttgttagggaaacctacacattccttttttttctttttaaacttagaatttgaaaaactattgatgatcaaagttttaaatgtttaaccaaatgttattctaaatgttatattttttaaaaccataggaagcatctttttaatattttactctatctgtggaacgacagtatcactttatattgttatttttattacatgtgttggccctatttttaaagaaagaagatatgttggccttgttaattgatggtcggttaacacttcattatgtgggtgacaaaatcctttatccggagaacaatattgaccaagcaaaaaaatcataaatatctatatgttttcttttggggcgaccttcaggttaccgttacgttgggagtgggctaaggtggtggtggagcaagatgggatgattatgactagcatcctcacctctagc

SEQ ID NO: 101979 - DNA, 547 bp, Oryza sativa
cttgtcatttgagtaggttaaaaaagctgaacaaaatgaagatggttcgaaatcagttggtactagcagggcaatccgttggctgattgctttggagaagggaaaagacatgatgcaagatatgaaaatagttaaatttttatgtgctaacggcattccgtttaatatattgagaagcccacaatttgctgaaatggtcacagccattaacaaagctcccagtggatacaaaggtccatcctctgagaaggcaaggacaactctgctagatgcatgcaaaagaagcgtagaacatgatttggcaatagtcaaaagtacatggtaattttcagttgctaacctttttcatccttgtataggtgcaaatttattaaccttttaactgaatattgagttattgactatcacttctttatttttgcatcaagcaggtgcacacaaggtgtttctattgtgtctgatggatggactgatataaagaacaaaccacttatcaatgtgattgcatctaatagccgaggttcatgctttctatatgcagaagatt

SEQ ID NO: 101980 - DNA, 1686 bp, Oryza sativa
ggagcgtcgcggtggggttagggtttgggagtgaggaagcgaatcgcgcacagcttgaggaggggggagagagagagggtaggctaggctgcgggctgcggcgcacgaggcggtagcggcaagggaaggaagcgtctagaaaaaaagtgtgaaacggcgtatgggacacgtgcacggctgctgatcgggttccctgtttgtgtgtagccctatcataggatatacggacacacagtttaaattattaaacatcatattatacatataaactgtgagacgtttttattaagcctaattaattcgtcattagcaaatgtttactgtatgaccacattggccgtgttcacttgagctacatattgcagctgttgaactgctgttggctatatcaacagtactagcagcacaaaatttactgctagtgctgtagttgttgtgctgtgaagctgaagccacggcaatctcatccgaacccacccattgtcaaatcatggcgcgattaggcttaaaagattcgtattgtatttacataatctgtgtagttattttttttttctatatttaatactccatgcatgtattcaaacattcgatatgataaggtgaaaagtttttacgtaaaaactaatcagggcttaattcgtcccatcgtattattttactttttaaattaagattcatctcgtattgttttacttttaaaattaagattcatctcgtagtactccctcgataccataagactcgactatatgattattaagggacttgtggaagatttaaaataaaccaaatacaaagaattaagaagtgatagttaatgtatgtatgcatgtacattatattatgagatataagaaaaaaatgattatgtcttactctcataacagtagtatattttaggatatagaaagtagtacttctgcttttttgatatttttttcttcaacaaagcaatctctttatcccataatataaataatataagacaatcatacttaacataatctttattagtttaatactaatgtttggcttataatttctcgtatgctataacaaaactatagcaatataaaagtaaatttgagtgacaatcaaataatatcattttcaacaaataaaatgtatatttatattatactaattattagttagatgttttaaaagttaaatattaaaatacttatgcgtcttatattatagaatggagaaagtaactttttttaatttcttttttcttcaacaaagtaaacaaacacacccgggatcgctcttgtttctcgcaagtatctttatatccaaataaccgaacggcatcttgaacgacaaagggggacctcttcaaggggtattcttcaaagtggatttgagtattttctccggtaaacttttactatcatttgatcaacgatttttcacgagaattgaactggttcgtgtaaaattatttcgttccaaaggagccctttatatttttggaaacttccaacggttggccagcaaaacggtaacaaacgaaacagctgtatgggataaatcaattttgagataaatataaataactacaagacacaagtaaaatattcacttcatcaccttctctgttctcacttccacccaagagtctaacaagaaataaaattgctacggccataatgaccggaagcatgatttttcatggct

SEQ ID NO: 101981 - DNA, 2808 bp, Oryza sativa
atgaactgccactcattacaatgttttatgcaaatcggtcaccaggaacaactgcattggtcgggcaaaagattctcctaattaaaaaaaatcctgaccaataactaactaaatattatcttccttagcaacatggtctaccttctctaacatttcatgttcttcctaactaagacaccttaagcacacaataacactcaatgataaatgtaaatgtgacatacacataactagaggaaacaactgaataaacatttgctaattacatgcgttgccaccaaaagtattatcagcatagaataattgttatttcttaaaaacttgaagaagtcattacaaccatgtgatggttgatggggtataccaataacttctgcccatccatcagctgattccaattactatctttccgctattgtttttgtccaagaaaattctagaattccttcagatgacaactacgggaagcaaagataaggagaacgaatctaatttctcaatgccagcaaccaaatccaagaaaagaccctcaggtttattaatagcatcactaaaataaaaggctacaattcaacagaatacaaaattgattagcaagcccagtattatagagaattaacactaaaaacactaaattataattttctaatgaaaagcccaagcatcaactactcctaacaagcgtgatcatgcttcaatgatttcatgttacataggaagcaattcatccatttcgttcctctgaacaagtatcataaattgatgaacatatttcagcaactaaatagtggcaaaagaagatatacaagagaagaaaacaagaatccctcacctttttcctgttaacaatgttaacacaatctaacagtctaccatcaataggacaaaaatgcatagtgttaacatgataacatctacttatgcaaattagcattggaagtgttgtgttccatggagttatcaatgtatatttaagataacatggtatagaattaaaaaaaagaaagaaaaagaaatccactactagagattcaaataaagcctctgagcctttgtttgttgttaacagataaagaatattcccatcagattctccatttgattgtatccaaaagcatatgcttcttatgccttcaaggtgtagctgaatatctgggtggtatagcttacatataactgggaagagtccttttgtggtggcactaactgtaaattgagctggcttgctggtggctaataacagtaacaaggttccggagtatgtagtgctgcagtaaaggatttcaagctgatagcttaactacaggctcacagttctcaaagaatcagtcagatttcaaacatcaaatttggagaattttctgagaagattctctatctgttaacgatgccttacagcatctagcatagaaggcttaatttgcatttcccaatagtagtggcaattagctccagtattgtcgatcgctacatagttacagtacccaggagacaacatcaaagtgcctaacaatcagaaagagtaaacatggtaaaggaataagtacctttgggtaattccaggaccatcattggatgccccaaaccctgaatcggcccaatctgacattgaaatcgaattgtcagaacatattcacaagtatcaagaatctatgttctaaatgaggagtgtaagtgctagctaaagtaaaaaaaaacagccatgcatatactttgtcttcatcccgactagaatgattcgaagcaggaacaaattagaagatagtggtaaaattcttactacaactataacacaccaaacaaatcaaagagctaatagccctaacacccaacatctacagatctgaaatcctgaacctccctgccataaatatttaacatttaggacaagatttggtcaaaatttaaaattacaaccatcaattttgtagtagaaataagtttataaaatctaataactttttatattatgatagtacttttcaaggaaaatctatatacaacattttattttgttttaaaactaagcatttgggaaattacagtcggaattttgaaaattcaaccgaattttgttctaaacgtcaaatatttatgaccgcagggagtacattagcaagtgctaacaaagcaaggttgctaatgtttaccaagtagaacagccccatgctgttcacttgaattcagtaaactcatactgactatggagcaaaggatctgatagttttcactaaactatgttgtagatcatcaaaaccaatctaatttggtggggaactaactacaggcaaataatcaatttccctcataccatttggggttcgctcatgctgtgctactcaaacagcttacttctgagatcgaaacgaaactttgcccgaggagaagaatcctcacctgctgcgcgattttgatacctgccatggtatcggtcatcatcatacccacctctgcctccaccacgctcgtggtcatatccatacctacccaacacatcacccaagcacacgcgatgaaaccgcagagcctcgaagaactaaccaccaatccagtacagatttcgaccaaatgaccaagaagaaacccctcacctcctgtcgccgtacccgtaccgcggcggcgggctcccacggccgccacggcggtcgtacccgtcgtcccgccgcgacctcttgaacggcggcgaaggggatctcctcgacggggagtggcggcggccactccgatacggcggggggctggaactacccccaccccggccaccgcctcctccccggtggtggttgtcaaaatagcgctcggggcgcg

SEQ ID NO: 101982 - DNA, 1360 bp, Oryza sativa
cagtgtttttcctctttttaaaaattattttatcatctgtcgaactgccggcaccctgtcaactgcggttgttcgataggtaccctgtcgaaccacggatattcgatagagtgccaaacttgcgatttcgtctaaccgacctatatttttgcgattttcctttaaaatcgtattatttccaaaaaaaatcctatacaagcacgttgggtgcatgcactgcacgcagatgagtgaatgcatcgcgttgatcgagccatggatgtcacggtgcatcgacctgggatattaattaatccatccgttctgcttcatcttataattaagtcgctttaactaccttttaagttaaagttctataaatttaactaaaattatagaaaagtttagcagcatctaaaacaacaaaataatttcattaaatcaagaattgaatatatttttataatatctttgtgttaaaaatactactatattttttttatgaacttaatcaaatttatactacctctgccttacaaatactctatttttcagtttttagatgtaatgtatgactattcgtcttatttaagaattttctatgattagtatttttattgttattagataaaaaaaagatatgaatagtatttcatatgtgattaactttttcataaaatttttaaataaaacgaacaattaacgttggacatataataaatttaaaatgcagtctttatgaaacggagggaataagtttaactgataaaaaaatcaaaacgagttgtaatacgaaacggatggactggtcctagtgcggtgtcttggatggcgaagctagcgaacgaaccttccatcgatcgatgagagatcgagcagccggagaaattaatagttcccgtgtgcccggccggaatctgattccttttgctaaagtgtgcgcatggcgtatgcccaatactttggaaatttctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggatggttcaattaaccacatagtcgggggctacacctattagggtgcatctattcgatgcacctgactttatttttcaccctccacagtcttcatatttggtaaaagtactcgggagaccatggcgaaaatgattgaagcactcggctttggagtaatctagttcgagagaa

SEQ ID NO: 101983 - DNA, 1323 bp, Oryza sativa
aacgcccaaatatgataacttatagaataggtgggtgcatggttacttggtcagcaaccttcgtagacttgtgctcctgcatcctactagtagtacaaaattttcttttcttccctcagctaagtttcgtggacttgtattaacagaaagcaaagttccccagcactacgaccaaagctcggatgctcatctaacctggagccatggctgctgggtggatttctctctctcttctcgttgctcttcatccaacccaaactccctactgctagcaacatctctcagctgactgaaaggtacagcaagccagaatctgtttctgctctagccgcagcctgctgctgctgtgcttttctcatcttctgttcctttttgtttcagaaacttttaccttttcttcatagatgaccactcttgaaaaacgagttgctaacaattctcaaaaaaaaaaagaaaaaacgagttgctgacaatatcatttgactgcagtggatcagggcaggttcagagcagggggaaatatgagaaaattgagtcgtccatatacaagaatcaagatcaccacagagaaggggaaaaaaaggaaccaagatctataacaggaaaaaaaacgcgaatattagggaaggatctaatatcaaataattagaagtggtgaggcttcgaacccaggtcatctagcccaccaccttgtggagctagctggaagacccggggcgtttctctataacagggaacatgtaagagatcattgcccatgtttatggcctctgttttcttttgtgcaaagccttttgatatcgtgacttgttttttgtatctcaaaaataatactattattagtgactttcatttgaatttgctccaaatgattgcagacatcaggaagtttactcaacaatatagttgcagtatatgctgctaacagtaaataattcttaggcagtggagcaagtattggcagataccctatttcttggttctcagaaaaggtcgtttttctccctgggagaaggtgccttggtgaaattgggcacagaggtggtggaggcagcatcagttttgacatattctgagcacagcatgaagcaaatcgagagtgaatttacgatcatgagagcatttatcagtcaggttagtgcagagaaagttggtgacaaaacgtttgatgcctggttggatcaggttagagatgttgcccatgatgtcgaagacatcgtcgatgagtatgcttacctcgctgcacaggccattgatacaggtaccttcttcaagaggaagttccagcagaccaagaatgttgcagcctggcagaacatctcc

SEQ ID NO: 101984 - DNA, 731 bp, Oryza sativa
gttcataaaggctatggtggcattttaacaattgctatatggcctcttccaccgaatgttggggtgataggtactatgattaatatgattaatggctggaacttgaatttagagttttggcgccaaggggcttgataccaattttcaaacattggattagtgtacatgttcgtcaaacattgaagtgtgatcagatcttcaccttttatgtctctttcttatccttttgtttgaaatggaagttagtgtggagtttgacagtgactggagtctggtgtttgatagtgattgccttgaaaatcttagattgaagggagactggaaactttgaaattcaggctagtggatcccgctgtggttattgttgacatggaactgctgtagatatgtcatatcatgttcttgtttaagtgataatttgaatcgttgaaatggtgttaatagtgtgcttagtatacttatcggcttgtttccacagctcaccctatcatcatatcatgctgcatatactatattgctttttggtgaaagactgttctcaatgatgtttgtcactctgtgtaagtatgtttgaagtttgagctcagaacaacttttttattgttccactcctttgtaacaaactatttaaacttatacagtgtaagtatcgtgccgttgttactttttagtaccaaagtgtaggaatccaagtttttattacaaaaataagaaacaaatctggggctgca

SEQ ID NO: 101985 - DNA, 662 bp, Oryza sativa
tcataaacagcctctgtttataacatatatgtgttctgtcatcaggtaatcgtcacagaagcccagatttgttgtagtgatcatccctcaaccataaacagggtataatgcattcccatcttcgaaagttgctgcaattagacttctttggtggctgagaaagttgttttttgttggcatgaccagttaaatatggctgactttgctgagtcagcaggtgggacccatatatcagtgacttcctcctcatctcatattctttctcacctcttccctctctctttctctttcctctcttccttctttcacctctctcactgtccatccgtcctgtagccactggccaagaccacgtcgcgtcactaccgccgtcccctctcctctcaccacccgccccccccatatccgcctcttctttacctgagccgctatttgctttgtgctttcccctcagccccactccaacccaccccacagctccatccacttatctcctcatcactatggatccgatattttgctatggcgccgttggcatctcgccccctcttgctagttgtggtggttgttggatgtggctgtcagaggtgtctcgggtatggtaacagaggatgagagaggatgttcatcgtgcaggtggatatggatgcattcccaaccca

SEQ ID NO: 101986 - DNA, 525 bp, Oryza sativa
atttgcataaatgcaaatagatggttatctagtatgttcttattttgtttaactatatccatgactccatatcactcctcccttcgtgtatatatttctctgcattctcttattatcagttcatttcatacatatgagttaaatctagtagattgttgctatttgtttatttatttttgttcatacaagcatacaacaagtttactgtttgctttttgtatggcagttttgggtgcattggataaactattgacgatgaattaatttttgttttcttagggatgattgtttcagtacttggttatagtttttaggatttattttcctggtgtagatggaaaaatatttggggcaacaattttttgaactgaactgaattgagagcttcagttgtatctcttgatttcgtagtatttttccaggcctactatgtacgttaaatctaagcatttattgaaattggcagtgcatgctcctaaacatttttgtgcttttgatgtgtctgtcactattcaatagtttcga

SEQ ID NO: 101987 - DNA, 687 bp, Oryza sativa
cccaaaaccttctttagcaaataaactaaatttctatatattctttcttccccacacaaattttctctctcatcaacttacaactaaattttggagataaaaaagtgtgcaaaacatagctctaaatgtaatatgacaaaaaaacattggaggatgaagttgctaaccttttaggcacctccgattttgtatataatcaccaaaataaattcactagaaattttggcatgacctcccctcttttttgaagaaattttgaagcttgctcgggcagctagaggaggaagaagacatatatataggggtgggactttagtcccggttggtgttatgaaccggggctaaagatccccgatctttagtcccggttcataacaccaaccgggactaaagtcccacccctatatatatgtcttcttcctcctctagctgcccgagcaagcttcaaaatttcttcaaaaaagaggggaggtcatgccaaaatttctagtgaatttattttggtgattatatacaaaatcggaggtgcctaaaaggttagcaacttcatcctccaatgtttttttgtcatattacatttagagctatgttttgcacacttttttatctccaaaatttagttgtaagttgatgagagagaaatttgtgtggggaagaaagaatatatagaaatttagtttatttgct

SEQ ID NO: 101988 - DNA, 614 bp, Oryza sativa
ttacatgactacagattgaggcaaaatctcatttatgatttttaagtatacaaaaactaggatatttaaaatcttgcacatcactaaaacaatattcctcaagtaaaagtaaattttcaccttgctacaacattagcaggacaattcattgaacttcaacaatacaacatgattttatataaaaaaaactgtaaacttccttttgacattgaaagttgtaacttgatcccatatgtgtgtgtgacaggtgtgtccaacctatcaaacataccctaaaccctgttcttgacaaagtagcaacttttgataacatcatcaactgtttttgtagttttctgaattgtccagctaatgctataacaagccgataattgacaatatagttgtgttcttttgcgaaattttactcatattcctctaattctagctgtcattccaaccagtaggaattcagctccatgtacatggatgagttgattgaatgatcaatttacagcaatcctttttcataattaatgcttgcagatatacacctggtgtttatccgcttccaaatgagaaagattctgcaaacttctataagatagcttcgaaacgtctttctgaagcaggat

SEQ ID NO: 101989 - DNA, 1111 bp, Oryza sativa
agtagtagagattaattaagcataaagttcttttagtgataaattaatcaaaccacaacaaaagaaatttacctaaattttttaataaggcgaatagtcaaacataatgtaaaaaaatcaacggcgtcatatataaaaagtagaggtaataatttgaaaagtgtctactacagtacaaaactagacacgcttttccttatgctatataaacaatcttttcaaaatattaattactagttgggtagttgggtgtccgtgcgttgcaacgggaaaaaaattatacataaatttaaaatcactatgggtcaaatgatgttaagtcatcaatgagtgaatttcttggaatagaaaacttaatatagcacggaaaataattacacggaaaataattacagattttggatgttagtaacatgaacagctccaagtaacacctggtgctaacaatatgcactccttatagtagcccaaatgaaacaaacaaaaggcattatatgttttggcaagccagcatggaaagagatatagatttaagactcataaaaagtaaattgaagataattaattttttaattatagaatgcattaacagcaggtgaccaccccaaccattttccagagtttacaatccagaatgaacaagtcttactacattgtgactataagacgcaccgaagtctgaaatttcataagaaatgttagtcaaactaattttcacagatctagtccaattgagctttaatttgatgaatgtcatatttcaaatattttgaaggaaaagttcaaaatatcatattgtgtagaaattaattcgaaaccatcaacagatatatatctaatcagaatcagctaagtagtagtactaaggagttaggaaaaactatgagcttcattcagatcgcaggtttgatttatcttctgtagatcgccattgctgacttgtgctccagattcccattgttgcttttcctaaaatgcaattcaacaaaccgaggatgaagcatggattagtcaaagattactaccaaagagattatatgtagatctggataagtagcaacgagatacattattagccactttcctggcagagtgctactggtcaatgctg

SEQ ID NO: 101990 - DNA, 804 bp, Oryza sativa
cctgcagcccctttattatatatctaagttacttttatcatatatataaattactttttcgagttgattaaattacttattatacattcataatatttttgagttgtttattttattatcatttttagtcaattccattatttgtgttgattaaatttaatttctagatatactcacgcttttacctccataacggatctacttttaatgtcatgcaaagttacttcctttttgttttaagttacttctataatatatgtaaattaattttaagctttactgaaattacttttatatgtttaagaagtagtttagtgaaatctaaaagtaatttagatatactataaaagtaatttgtaatttttcatcaaaatataatcatatgagatcttgttagaaagatttaattcttacgaacataaccgtgtaatcggatgagtagtttaagagaaaattttatttgaaacataggtgataggaatatattttctatttacttgatgagaactagtactacagttaaagtatctagatagagactcgttagcactaaaacgagaggcctacacgtgaacagttacagacgaatgtcgtgcatgaatacacgtcatgctagagtattagaaacgcaaacgtttcccatgcatgcacgtaaattggttggagttcacgtcacaactaaaagttatactataacggagacatgcaacggtctaattctaccgccattagttattatagcacgatagggctaacataaatgcgattgttgtcatgtatgtacgtggaagatgagaagggcta

SEQ ID NO: 101991 - DNA, 636 bp, Oryza sativa
aagcctagtagggcttaaacataaaggctaaaagtatccatgtctactcactagtggatccatcgccgggcggccgccctggctcaccggtacgcagatgatctattataattctatgtaattaaaaatacagaatttagtggaaattttaactccacaacgcattatcctttacatcaataccatagttttcaaccatggttattcttagcatcagtgtactcctatccaaccaattgtgccttttcaaccataaaattgcatgcacaaccagttgtgccctcctctaacaacatccctaatttttagatctaattcattcaattggtgtgagaaacctagagcccataacaaagacattcgaaccaagcacaatacaacaaattattttgctaattactaatatactagctctggctcctactatttatagggtgaattcattgtaccgaacttgacaaaacgattgcaatgctctgcttatcttcgtccagtaatccattagactaaaacaaactaaaatccagattagcaaaatcctaatcgactcaatattacacagtgcaaggtgaagaactgaagacctgacctagagttggggaatcagaagtttggagcatttccagattagctggg

SEQ ID NO: 101992 - DNA, 642 bp, Oryza sativa
cctgcagccccgcgtgccgcgtgggccgggagtgcacgctaccggcgcgcgcgagaattaggattctcgaaattactctggttgctgctttgctttgctttattgatcgtggtgcgtggctgcgttgctgcatacctgctgtttctctgaataaacgtatctctagtgtagtagtgtatccggtgcggagctagaatgaaattgaggagtgtgttcttgtttaatttactttatcatggatcttgtttaaactggtacggatgtttaagtttgtattgagtggatgtacaaaatatactagctataggttaaaaaaaacctggtcactcggcaccccttcgtatgctcaagttccgccctgactgtactagtagtagtgtctcagcgttcggttactgacttcgtgtgtgtttcgtgtttccattccgaacagacgatatcttaattttactgtgttcgagtccctgttgtttttgagatcacgccatgttcccattcaagacatggccgacagagacgaggatacaaaatagacttattttcagccatataagagaggaaaaagtacaccgaaggtccctcaacttgtcatcgagttacaaaatcgtccttgaaccacaaaaccagatacaacgtatctct

SEQ ID NO: 101993 - DNA, 1000 bp, Oryza sativa
aaaaacatctaaaaactgaagtaagactgaagaaacaagagggtgtgtgacagaggatgtctgaagggaatgacattgggttggtgcaaccagaagtactgccccaactgcattatgggataacaatttacccatatgagcagagttaaccaaagtctgtcctctgggaatagaaacatcagataatgtgacttccaattgcccattaatatgcagacttaactccctggaatgaagttaagggtaacagggctgtgttgaagaatccaatcacaaccaaaaataatgtcatagcctttgacatcaagaactctgaaggtagtagcaaaggaatgaccctgaatttcataaggttgatcaatgcacattgttgttgtagtcaaaacttcaccatttgccactatgactgaaataggatcattgttggtaatatccagtctcgctttgaggactactctgggagacatgaaggtagttgtactacaggagagcagtgagatgaagagaacccatcttgacatgcaaggtgaaggtcgttaatctagcatgcggaccatgaagagcatgcatcgaaacttcatctgtggaggtgttaggggtagggctatctggtggggtactaaaaggtgcttccacctgttcttcttatgagacctcctcatcctccactgtgactaaatacaactgtttgttgcctttacagactctgccatgtccaggaacccaaggctcttggcatcaaaaacacttaccagctcctcttggttgtgtccctgtagtaggtttgtgctctagggcaggcaattctctcctggcaggaacaaatggtgctttggtattcggttgagtggaactgttgtactgtcttggatgagcactggggatatcataattgcgagcatgttcataagtttgaaccaatgagtatatgggtaagagacttcagaggtcgtttgatatggtccttgaggccagagatgaaatagtccaaaaagaaata

SEQ ID NO: 101994 - DNA, 730 bp, Oryza sativa
ggatctgcaggacttcgccaaaaggtccagaggttggaagcccaggacagaagaaatgctgaggcaaaagctcagagccaagctgaggagattgagaacctaaagaaggcaataacagatactcagaagtcagcagcagatactcagaacctcattcgacagatgatagcatttggacagactcaggtcactcatcagaccactcctccttgacttggttgcgcttaggtacacatcttcatcttatgatatgcctcttcttacataatgcagtttctgtttcttgttcttggacctctcatttttttatactattagtagtattgtatgatatagttagatactggaatcaaatgaacataggtactgtttggaatcaatatctctactacaatgacttcctatagtgccaggactcatgaggctgaataaataaaaccactggtgaatataatttccaaaaggttgctgcccctagggactactagattgttgagcttgtgttcatttcttactagtgttaattcctgacacaatgttctttgcaggctgttggattcattttggtgatctgtgaatggagtttggtgtgactgtgactagagtatgacaccatgtgttttgcttttggcatgactggaccggagtgtggttgtttctgttagtgatctcgtgatgacaaaaacttgtgtatgctattgtttccatgactgaaactgtaagtggagtg

SEQ ID NO: 101995 - DNA, 659 bp, Oryza sativa
tagatggacccgagtccagacatggcccaaggtctggaacagttgagtttattgcagaccagggtggttctctccgtttcagaggagctaatctgattgtttggttttactaatacatggagtagaacaagccgaacaattgtgtatcagaaaatggcagggttggcatgcatgagaaagcataaaaactactgtagatgtatgtatctcctatcggagtttcgttgttttgagtaaaaattttgatattctcaaatatatagtagaaactgcaaaaacatccgaatgatatgtagaacagaagctgatatcacttaattagttcatgatctatattatatctggggcatacacaacaggcctccctaatcctaatatatcatacaattaataggtaagatccaactcggtgaatcaaactttaatcctagtaatcactacacgaagacctaggaactgttcaccttgatgccatttttaaccataccatttttttataaagttgccaaaaaaatgtttacgttcaatttgttgctgaatttgataaatacataagaaatcctgccaaaattttagcaatattaccttcttactaaaattttggcaataccaaaatttgataaggtttattttggctacaatttgaacaggcccctaat

SEQ ID NO: 101996 - DNA, 522 bp, Oryza sativa
cggggacgggcactggaagaaggttttttttggcttggtgaggaattctgggttgctttgggtagcctggtgaaatatttattggccttgccaggtcctattccgaattcggaaacggcaagaggttgattagagtaaattaggatgggtttgtctttcaatgtttctaaaagtggtgtgaacatgcggattcccaaaacattgtcagtttccaatgtattgtatgactcggttttccttattttcattttgactgattgtccgattaatctttttttttcttcagtttttaactaattctaatcctaatctagttctatttttctttttccttattcttttggattaatcttattttcgttttgactgattgtccgattcatcttcttttctcctttctttagtttttaactaatcctaatcctaatctagttctatttttcctttttcttatttttttgattaatgtgagaatttctaggttgtgagagcgaacatggaggcttctttttctattacttt

SEQ ID NO: 101997 - DNA, 737 bp, Oryza sativa
ggtcaaacgtctgatgtgacaccccaaaaatttccttttctccaaactaaacacagctaaggggcccctttgaattggagggaaaacataggaattttagaggatttcaatcctataggaaaatttcgtatgaaaccctttgaaacaaaggattgaatcatatctaatcccttgaaattcctatggaatggacgatcatatagagattttggaagaaatttagcaagagcttcaacctcttgctaacttttctttgagtctatctctcccatctaattcctgcgtttttcctgcggttcaatcaaacggtcattcctgggtttttcatgcgttttgcaatcctctgttttacacttacattcttatcaaaatcctacgtttttcctattcctacgtttttccaatcctgcgattcaaagggcccttaaccatagtcaaaagttcttttttccaagtttgatcgtgtgttttatttgaaatatttgtttgatttgtatttttgttatattagataataaaccataatagtattttataccgaacgcaatttggaatttttgaacccctaaaatttaaattaaggccgagtttagtttgaaattttttcttcaaactttcaactttttcatcacattaaaatttttcaaatctattgcccttgactatgggagcaggtgtaggcttactctcatgcatactgtatttatttagaactttttccagatagggctgcagga

SEQ ID NO: 101998 - DNA, 721 bp, Oryza sativa
agtactacggggaagtgatcaacccccttggtcatatcctagccggccgccgcgtacgtgacgtactgacgacgcgattaccttggtgctcgtggatggatcgatggatgttggtaaggatgcaagtgagactagtaagtagcattttcttacatttttctttcaaattctatacaagtattggaaacaaactattaataatgtctttattttatagtttatttaatagtttacatgcatacagattgattctttactcgctggataacaaagtcatcatctataatcaacgtgatgtttttccgaaataatcatcctctactaaactgtctctatttttatttgagcaaatagtaaatgtgtatctgtaaatgctctatatgcatgcaaccaaccaagattggatcaacacgaacataaaagataataacaaaccatacgtgtgaagtgactattctcacaacaaaccactcataaaacccgtaacttataatccgatcatgagaaatgttaaaaagggctaaagagatagttccaaatcattgggaaaggcgtcctaaagggcattgatcgcacattgatcatcaatgataactttgttatccagtgagtgaccttctgtaatgttgttgccatctgactatttcagtggagatatactcgagaccttaactatgcaaggtcaatatgacatacaaactactccctccgtttcgaaatg

SEQ ID NO: 101999 - DNA, 871 bp, Oryza sativa
ctctgtttctctcctcagtgccgcctcatcttctgcctgaacaacatcctctggcggattgacttggttgaatcttgttgcactctctgccttctcctcaccagcctgattaacttctatttgggtaccgttgatgaaaaggtcaatagagttgtgatgcttggcgacctccttgctcactacctctactgtcctcttaacgttgggactattgatgtaccgtgcattgtagcaaatctttgcctccgaaagcttttcaaggttgctgatacctgaaggaacactcatctcgctcgctgggaacgcgtacagattcagtcgaagatatgtgagcttcggcattgcctctttttcgaaggtcagccatgggacagggcaatcaagggagaatctctcaatctctttgaacccttttgtctcaatcactattgcttcttcgggaatgaactccaagcatagtaccaggtgctgcaatttgaccaagcctgcgaggatcttgacatcgtctgccacttgtttgcaaaccgtgatctgcaagaaagtaagatacacgagcctttcgatccatcggggaacactgacaaattttccggctattaccttaaatttcttaagtccttcaggtggttttgttagagaacccagaaactccatggaacaaccgagcccacaatgaatggtgagggacttaagcttcctccatctttctatggataaccgtagggcctcttggtagtcttcgtcactgcactggtgaaaggaccatgttattgcgaggacctccaatctctccagatcaccgagagactgtattgactttgcagagaattcacttaaatcgatagttgctagcgtctttagatatcttaat

SEQ ID NO: 102000 - DNA, 600 bp, Oryza sativa
acgaaatcggaatcgggcaagcactcgaccttaccatagccaactcagctaaggacgaacccctgatggcagctgcctcttatttctggtcaaacaccatcaatgccttcttgtttaaccatgggccgatgactccaactctcatagatatcagcatgattacgggtttggacgtcacttcatcggctaacgctatgggcttaaacacaaagaatcaatacgacttcaagaccaagagcataggcggctggtcaggctatgtagcagcatacatgggccaggattcgatcacccctcgagaacatgtggctttcttgttaatgtggctagagaaatttctcttttgtggatccagctgcggtcctacaaccaattggcagttcgtaaccgaagccttggaaacgaaaagacaatttcctttaggcaaaatcctcctcggctacttgtaccaaatgctaaataatgcatcggctaagctagctgtcggctcagtagtcggagcaggtggaccatggtggctactgcaatcctggctaaatctggtagtcatgaaagttgtcaatcggccatccgtgacagaagcagaattcccaaaactgg

SEQ ID NO: 102001 - DNA, 509 bp, Oryza sativa
aaatataatctataaataactaaaatcttgaataaaaaatttcacaagaccctggcgttacccaacatagagttcaattaggaataaaatttaaaaatgtctaaaatttggaatattgaaagaatactatatccagaacacaacaaaagattaattacattcagactaaacaatcatgttcagaaaagtcatctgcataaatcttagcaagttcaatgagcttatcttcatcatagttggcaaaagaattccttggatcaaggcaagcaatacatctcaatagctgagtagacctttcagcaaaacgattgtttaactcaacaataatttgatcaagtaccacattaaatatgcatgtccggccggccgctcgccgccctgcgcagtcgccactctccaatcggcaatcggtgatgtgagagacagggaggagatgaggagagctgataacgtgagagaagagaaagaatgctaagcggcgctcggtgatgcgggatactgcgtgatgc

SEQ ID NO: 102002 - DNA, 537 bp, Oryza sativa
ctctattgaccttttcatcaacggtacccaaatagaagttaatcaggctggtgaggagaaggcagagagtgcaacaagattcaaccaagtcaatccgccagaggatgttgttcaggcagaagatgaggcggcactgaggagagaaacagagtttcagagcgagaaagaagatgaagatgaagcagagtgccatgcctagctcctattgaaaaggtaatcactgttcgcgtctagctgtttatcaatattgctacctgcaactaactccaaatttagttgataaatttcttgtcaattacttgttgccgcatgaaatgatgtccgcctctcctgacaatacatctcacagaacagtgagataataactcctgcatcacgtggtcgcttctgtattgctgttggtcgccgtgtacatatgtggcccgcaatttgcgggctaccatcgttatattttctttcatatattaccatgtatgaattatatggttgttttaagatatatatatatacacacacatgtaaataggtgtcaattaa

SEQ ID NO: 102003 - DNA, 847 bp, Oryza sativa
agtggtattttataaagtaagcggtgatacctaccgaaagtttataccctctccgttccaaaatgattatcatatagtttttttttagttatttctaaatgatcatcatttgtgttcactagatgataccccgcgcgttgcggcgggccattgtgggggcatagacatacttgcatggaaaaggagttatcgccacctcctgcgaccaagaagcgcgttgtccccaccaccacctgtgcgcgaccacgccacgctagggtccgccgcactacgccaccgctgctccgctcaggaagtcaggaggagataagacacaccgaatcctaaatccctcattgggctgctttagattgacttgggcctactgggctgcggtatattcacatgggcctcacgtgttgtgtttgaccccagttttgttcatccaacggtgcagatgcaatctaatctaccgatccaagggctgtaaattagtgatgatgtggatcattgaggattgagctttcgaatcttaattgcacttagtgggagataactttataggaagaagggattcattaagtctatttgttatttgtgcattggagtaaatggacattgatgcatgtatccatgcacacaagtatttataatccacatgcaatatcttgatttgctattggctagaaaatagtggggattgtgcatacatcgagtttgttgctagagtaaatatagtatgagagagttattagcttttattagtcttggtgtatctatgtgatatgtagatcaatttagaatggagtaagtactccatccgtttcgaaatgtttgacgccgttgacttttttaaatatgtttgacc

SEQ ID NO: 102004 - DNA, 647 bp, Oryza sativa
gggagcaccttatcccttcccccacatctttcccccccactagaaacgtcgctttcttcccatctcctctcccaagctggctgcacgccgcctccactataacctgcatcttctagctatcctcttcttgggtatgtgtcgacgagccatatgttccccggcccttactcttttctttgtcctctctagcgtgacaaacgaaacgaaaccacttttttcagattatttaatatacacatgcataccgctttcttttctttttcaattttttaatatattagaaaatatatccatgcgctgtaacgggtaaatacctttttttttcagtgatacaacaattattagaagctggataataaattgaaccgttaggaccactatacattataattaaaaaagttaatgaaaattctttgcaggttttgggctgaaaacccattgttttcttctattcttttgttgaactgctagctggtacagcacgacagaacagaattattgcaacaaacgactgtactgcattagcacgcaactaaagcagggaacaccttatctcttccctcacatctctccccccactagaaacgtcgctttcttcccatctcctctcccaagctggctgcacgccgcctccactataagctgca

SEQ ID NO: 102005 - DNA, 661 bp, Oryza sativa
ctgggacagtgacaacccctttctctgaatttctttatttctttctctgatccttcctcctggattccttccatccaactagatgcaggccaccacaccacacacccaaaccgccttccagtcggcttcgatcccggtcaggtgagctttccggtttccggtagcttccggcggcggcggcggccggacgacggcgaccgtcttcaatgtctccggtcaccatcggtgattgaggcagcaacttgtgcaagaaaacgagagagaaagtctggcattggagagtgaggccgtgtggcgtttgcaaggtggtgatagattgacagggcacctaactggggttaataaactgataagtgtggctaattgcagagaaaagaaacattggttgttggttgcaagtgcacgtggtgtggttgtggcttttgtgtgcacattcctctgctcttgcgtgtgtggtgcctagaaggatacatatataattactatgaaattgaaggctatggattggagtactatggtggattgattattaatcaaatctgtgatggaagatgatcgtaagttgtatttcacatggatgcttgttggcatatgtttagttgatggaggaaacatggtgtgcttgtgctgttgtatgtgaagcatttcggaagatggattt

SEQ ID NO: 102006 - DNA, 1835 bp, Oryza sativa
attatcatttgctttgctctgcaaaaacaattcgatgtgtcaacataagtgcaaagagcgataaatcaagtgcatgtatactgatgcacgttaatcgttagactcaatggttcagatgaggattactagaattactttgtatgcatagatgcaaaatatcatctgttggaaaatagttcaagatttatgaatgctttcatcttttatgcttaacaaactatgatgcatttctttgcaaaatgctgctgtacttcatcaaagtaacgaaaatatttgccaactcatgtaagaaaatgtgtaagaaaaggatcaagaaataatttagtattgtgaaatatgggaggtgcaaaacagcttatataaggacccacccattctgaatcttcgtccttttccctccaaaatatatccggttgctcaattgggagtggaaagttcactgggacaggcacaacatggtcagctatgtatcccaacagaatagcaagctcaatgagcatacacacaaaaatggagtggagtaagcatcattagaaataagaacatatgaaatattattgtatcatgatttttcagtcagtacacattcacaaacagttagtgaagtttcagcacctcaagttggtaaatacacaccactgaccttcttcatttagtaggttgctacttttctgtgaaacacatatctgcaatgggactcgagcttcctgcaataaccatgttgattttagtcttactccaaggtagagtatttacacaattgcacttatatgaaatgccagaaacacggataggcaaattcagattgagttcatgattataaaaataaaatgaagaggtggcatcaggtggtttccaatacaatagtaaattgtaatcatacacaagcactgataacctcaaatgtagcttaaaaaaacactgacgcaacactttaagaggtggttgcaaagagctagaagaaccaactctaaacgtgtgtattttatcatgctctaagcctctaaacttgtctgataagaaaacttaacaagaacaagaatgaagactgaacgcatgaaactgaaacaaatgtcttaagcacagacaacacaaaaatcatattgatccttggtagtccacataaatactaacgtaatgacattactaccaagatatgggtttgatactgagctaaaatcgagcatttagggcctgcaaagccaacacagacaatcgcaccaaccaaaacctactcaaaagaaatttaatgcaagcattgagcacatgcatctatttttaacatatcaaatgagggctgcaggcacaatttgatgacaacccacgtattcagcgcttaggctgatacgagaaatacatagaattgtaatctcattctagattgagaaagaacaaggcactaaaagagacaaatgatatcctagtagttttgaatggtatttataccaaacaaggtactgctaattctctacctagaatacttagattgaggatccaacttgatgtctaactagcacatctactaagtatgtcctcagacaagttcttcaacacaagtcacagcttcaatagttgatagtaacttcggcaaagaacacacaaattgatcactagatcaaaatttccacaattaagcagagataatgaaagcttaaggagaacaattttaaggctggaatggacgtacagaaaacgagcatggaactcaccaattgaactgcggtatttacaggggcaatattttgatctccattacccaatacaatcgatcttccaaacaatatacttttaacataataaatatagcggacacttatacccctatatgatggtgg

SEQ ID NO: 102007 - DNA, 1155 bp, Oryza sativa
attgataagaggagtatatctagacatgttgttttagttaatttgcccctgctgttgctacccctgtgtcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaaccagccctccccaacacctgcgaggatccaggaagaagcaaacccagccacagaggcagttgccgaaggtcatcccgcgacaatggcggtccaacaacccgaaattcatggtaatttataggataaattttcaccatatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagaggttgacgctagtggtaggcccacggcgcctaggactgtcattggaagatggtctaactgctgcgggctagcggcacgtgagaacttcgggatcctccataaagatatcggcaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacaccgttcgatgaataccctcaaataaccgaagcggtgtgggaggaattctgctctctcaagaccacccaagagtttagggaatcaagcgaggcacatcgcgtactgcaacagcggaatgagcacccgcatcggctgggc

SEQ ID NO: 102008 - DNA, 517 bp, Oryza sativa
aacattgtcctaaacgactttctttacgaatatgaatggagtatctctgtaaactcccaatacctccttaggaactgtccttcagtcagtgtcgtctgtcgtgtcgtccccttccttgatcctctgctctctttcccatccagcctccgggactccggtctcgcgtcaaacgcggattgatcgacaaggagattggagttctgatcctgccaatcaggtatggcgtttgtttcccctgtaacctagcttcattaagttatcctaggactcgtcgcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctgggcagcatgggccatggaaagatactccagttgatggttatttggatttcggagagggatctgctatcattaggaatg

SEQ ID NO: 102009 - DNA, 1388 bp, Oryza sativa
cccaaaatgcatggggagttttggtggattggttagtgtagtccatggacggaaccgacctagtcaccaaaatttttcatgcattttgttttctgtcattctttgataattaaggaactttattaggtttagggtttgaaatttagttcaaatggaagaattgattgattggccgcagatttaatgttgttctgaggttatcaaaccatcacagagtacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcctttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccatgtggagtatctttgcccctgttgctgctgcccaatgtgttccttgttaaatggccagtgatgaattgctcaataagaacaaattatctacacttgttctttttttatgcataagaacagattttctgcacttgctcttttttctggattaataagaggagactatatacacttgttttctgtcattctttgatgatttatatacccttgctgctgctgcccaatgtgttccttattaaatggccagtgatgaattgctcaataagaatagattatctacacttgttcatttttttgcccctacacttgttcatttatatacccctgttgttgctacacctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaa

SEQ ID NO: 102010 - DNA, 1970 bp, Oryza sativa
cacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgccggtacgaatcaagaaactactcggtaaatcaaaatcttgttttactaaaaagtatatgagtttcacctgttttttggtacatacatgtgcttctacacaaagtcgcttaggcagtgtttgtcaaatggaaaagggaaatgatttcccacctatctttatatcctaaccattcattcttcctctttcatttaattctaaccctttatttattttctaatccgaatccaaccctccattttccattatctaaacacacccttaagagttgtattcggtgaccgtatggttttcaaactgtaagcatgtggttcttttaaaccgtaagattagcctctaaactggggatgcaggtccctctacagtgattgcaaacaactctatatgtacacaatgatctaactcttgtgctatagctatttaaattagcacattagctagacactgtaacaatagtgttctaacaacaattaatttaccaccgaacacttctttaccatagcattatgatttgtaccgttcaatgaagatccaacgcattaaaacatgagctaatgcaaggtactttagcacctctgaattttcttcttcaatgtagaaggatcccgatccctaaactggacagttagttaaaagagcttgccaaattcagatgcatgcacaagcattaacggcggttagtttaatttggagtacacactggcagtacgagtacgaatcttttttttccatttgccaaattggcgtcaatacagaatacactgtacatctatcattttttcctggggtgtactggtgaacagttgaacactgaccagtagagttgtgtcgtatggacgaattcagtggcggctgcagtgatattgtactgtagatgcatacgagagagggagagagagagagacactgtttcgatctggtcgtgtcaacccctgcagaaacgacgcaaactggtaatcgatttttaaattgtctgtcattttccagagatttatgatctgtggttgtacttgacctgtttgctggttgtttgtggatggacttgctgttaagtttgagactgaaattattgaaatcttggccgtgtttggttgcaggatgttttctcgtatgttgcatgttgcacaacttcgctttccatcgggttgttgttagcaactttttttgacaagttgacaagcacgatcgcagcaccttaagccttgcggtgatcctagagtcgccaaccacctcgatctagcaaagagctaaacctagatgggttttgataactaaaccggctagcagagccgatttctagataactacccgtctcgtgggcaaaacagaaagttttcaggacaaacctacaaagaggtgtcgcactctcgcagcggcggcggacggtttacggcgcaaaccgacaaagatggacaaactaagagaaaactaaaagcaatatgaaaagaacgattcgattgattgatagtagattgatttttacaatgaaccggccttgtcccttatataggggttggtcttgccctctacaggcctttctccacgtccaactcggggtagaaaccaaaggaaacccgaaacatgccttcccgagcaaggaaacctcgaaacccgacgcaacagaatcggactcgggcctgccggtcagaccggccacacaccgccg

SEQ ID NO: 102011 - DNA, 2541 bp, Oryza sativa
taggccatgtcagcaagacaccggtgtcccagatgacataaatcttttgatagtaagaaactaccccttttctaaatcatggcgccgtgcaaagtaactttggctatcggtgtatgtagctttggcaacatctttgccctgtcctaaaatactagagataccaatcatgtagaataactgatcagtatcaacaatatacatacgcctatgaacaacaataataataataatttgatcacctagtgaccattgatattttttgccaaaaaaaaggaatatcaaagaggagctccttgaattaagatagaatagggcacaagaactccataaaaatagacgccagtttcagattcaaatttaggtggtctggacctgagagctatgctcagttctcgaccattgatattttgaccacaccggcgcattaaatgaacctaaattaagcgctcgaactacacaaattaatcccagtttaaagggagataattgggacaagtactgaaatttaaagagatatatataccgaggttgacattaggaatgcgacatgcttgcctgattggtggcagcttaatccgcagttatttctttatcaagccacttgtgttgaggggggttacataatgtgattattgtttaggactcagttcgttctttcttgtcccttcatcgcctcacgagttattggaaaaggtgacgccaagattaattggaattgggatatgggatcgacatgaggaagatgccaaaatcaatatatttgttttctgattatgagaagatgaaagattagtcggcgagcacactgcattcagagcataaacatatatataccaattgcgtgcctgagaatattatttcgctaagattaccattttgaaattgacaatgtttatatcttattagcacgtgtcgtgttaacttagggcatgtttggtacagctccaacctctaaatttagcttcaggagttgggtttggagtggagttgtggagctgcctaaacccagctccacatctctagttcattttgtgagagagctccacccaactccactcccatttttaatggagctgaaactgtttggctgagctccagctccaggagctagagttgtgacaaatatgcccttattctagctataagcagtaaaagtgatgaggctataataatgcaacaactagacatgggtccttgtattaagggatagttatttttcagtgattgacgatatacccgttgttataaaataaaatgggaccaatctagaaatgactaattgattttgaattaaggagggggtgaggctcgaacccggaccggctagccgggaagaccctaggcctttctcaagatgttatcgagaagctcgtgataacttcatcaatctgaagatgtgttgactttccaaggtactcataggagaggatatacaggtacgggtgttgcgagtaactgcatttgtaatgtattctaatactaatagtagtagtaataataataaataataataacaataatcataatgcaaaaaagatcaaatggaaatttcaactttcaagcgatttttttttaaaaaaaagcagctgccttgccatctgaattttcgaagctgtgattgatttcagcccaattagagttggactaggccaagaaaagttgctcgttttcgcacaacccaaaagggcctctagaggggtcacaaggcctagtgttttactgggctattaaggatggcggcccatacaattttaactcctcttctcaaaaaacaattttcctcttatttctcctctcttttgttctttttttttttggacttctttctcgcggaggtctttctgcggataaggcgaagcgcgtttgatcgtcgctttcagatttttggtcgtgggaacttgacaatccagatcgcttttgttcctatagcatcttctatattttttcccgaatttgaaattctatccttttttttttctcccgtcgttttacgtgaattctgcccttacttttgttgggtttttgcttttggattgacttttggtgcgttccataaacagtacgctctgatagatccatgaaccgtgtgttctctgactcctacatcgagggggaaatttagttgggagaaggaaaggaagttctacttggatcaataagttgcgcaccaagtgttcggcgttttgtgtctaagaagttggttgggctttgcagtgcttcttcagtaactctggatgcaatttcttttagttttggttcatgtcttactaggtttcttgttctccttctttatctatagtagtatgtgaaatctaacaggatcgaaatgtattaatgggaattggggatatgtaatgctgaaaatggtggaaaggtagctacagatctaaagaatcaatttatcagtcctatggctgatggtttctagcaaatcggtcctgcattcaatatcctatggaaaatttgtaaaccttgaatatttaatttagactcacacgaattgcagagctgcatgctatgacagtagtagtttttattttt

SEQ ID NO: 102012 - DNA, 704 bp, Oryza sativa
gatctggaagatgaagtttgggttagcacaattgcatctctgccaagtttcatagcaccagtctacaaaatacgcaccaagaaaacagtaaactcaacaagaataagaacaatttttcacataaacaaacatctgcaagtataaatctaggtcgaacaagaatgcaatacggtaactgttttgaacactagcacatgaagagtatggatttgcctcttaaaatcaataaaagggctaaaggagcatgaacagagggtgtgtttactgaatagatattcctaacttctaattgacataactaacatttattcaagttcattggttgagcagttaaatactgtacagtccaagacttttaagtcatgctagcttacagacagaaaaaagaaatgaaaggacgtcagctttgagatgctgtatcactgcatagcaaaatgttacactctgcctccaaaatccgtgttagcgcacttcttatgtggagcaggcctatgttagcatagcactgcgcttacactttcatcccggctcgtacaatggttggagaaccaaggctataagccgctgaccctcacccacctaaacttccaagatggtactaaaccacctcctacaaccacaattgggccatgggcctcaactacaccacactacaggtggcaaacgggctacagtgttacacaaaacctacctaactagcaccc

SEQ ID NO: 102013 - DNA, 606 bp, Oryza sativa
ttattttttaaattattaaatatcagaaatgttaagaaactgataaccggagaggaggatgacgccaacaggttaccttaaatccaattccaaacctcccaatttgatcctggcgttgcttatccggtcttttgtgaccgaatgagatcattctcatcatttcagcacaagtcattccatgcccatcatcaattacagacaagacagggatttttttgtctgctttcttcgaaaacaatgatttgactgaaatattcaaccttcaagaaaggtaggagaacaaataagaagtcagctcaatcaaaataacacaaatgcacccccccccaaaaaaaaagggggggtaatcttcaaaatacgctaacaacacagtcaaattagcaaaagcctcaaatagtctttaaattatgtatacaacactaccctcagagaggaaatgcttcctacacaactacacatattactgagattacattctgtaaatactacaacaaaagcagtaaatatgtaaagtttgtatactaatagaatgggcatgtgcatattcatctggaagagatgtaaaacaagacaataaagaaaacttagtttggcatattggaagat

SEQ ID NO: 102014 - DNA, 602 bp, Oryza sativa
aggcttctggcattgctccaccaccactctttcggaatatgcatgcttatcagaatacagcaggtggcaatgctccttccaaaccaaaggttaatgctccgaacctgacactccgaagaaaatacatcgatgaagcaggcctaaagaaggttgttgtttcctcaactgaaagatactgtcttgcaacttctataatttctactgatctcttgagcttctaggtttctctcggtcgactgtcctctttcaataatttaaattgttagattaaacctctcggaaaatgatacgtgtttggagtaaaccacatacttgctgatcctctccagttgtgcatactagcattgcttgttaatgcattagtattcattggctcattgcatttacagcctaatacttcctggttgtatgagtctgtagagtttcagtcatggctgttctatcaggattcaggatgttgatcccttgcttctacctaactgcgtctgcattgcaaagtttgtgattgcggtcttctttttatttgttagtttgtattgcccattaattaagattcattgactatggatagctctgtttgacagtaccagactacccatcaa

SEQ ID NO: 102015 - DNA, 3868 bp, Oryza sativa
caccacctcccccgccaccaccaccgcctcctccacctccaccgctccataccccccatccccgcaagctcgtatggcgcttaacatcgtccacgtccccgcgcaccgcattctcccccttcttgagaaccacctcatcttcgcactcctcgacgccgccgttggagttgccacggcggaggtcgccgcttgcagctcctcctccgccagcgcgagccgcaggagcaacgcgccggcggcgaggaagagcaggccgagccacggagctctcctcctctggcccatattgcctcacgtacacactagctagctcgctagttccccttgccttcttggcagctgtgtgatgagctaggctgccattttggggtggctggctcgcgtatttatagccttcagggcgactttggtgagcagagcactatagagtatagagatccatgcactttgtatcggtaagaacatgtcggcgaagtggaggagtccgtgtaaatcgcttatgctacaagcgatgatggatgtgtgcgtccgtcctactacagaaatgattttcacggaccataggtttttcttttcggaatcaggaactgaacaacacagtgacagtgtatgattggttaattatctgacgtatctcagatcgacagatgatttatagatggtgatcactgagctcataaccaatttggagatttttataggttatgaaacggatgtataaaaaatgtgccagaccattgtcttacaatatatatatcctttgctttcttggaaaaaggctgcaaaattccagcatgggtcatcgatcaatcagtgcctctttgctttagcaacaaatcaaatacatgcatatatactcttacataggctacggtagtagccattcttcaacatcaaggatgaccacatagcgtaaaaggaatcaattggaatccatctcccaatcttaacgaaattggtcgaccgaacttttggccaacccggcaaaatcaataggaatccatgactctctaagtatgcccgtaaccataacaggttaacaaaatcggtcggttttcatgaaactgtcagcggttggtttgtaaaaaccgattaatttgtatggagttgactaacagtcaaacaacttttggcatgttttcgtttagttcttggcaaacggcggtggggactgattttcactttaaaatatctgaaggtaaacactaccttatatcaaggcttagtaccatgagaagttaaaaccagtgggtcaccatgctaagcacaaatgaacaacactgcacggtttaatcaatttcatatacacattatatgattgatacaaggggagaagcaccgataatatgttggtgaagttgtaatgtatgagtctacccaccaagatttaaatattggtgtccataaatattacgtgcatatatgtacacgcttttagtaagatttttaaataaggtggaggatttatcgttggtcttcatctcttgcagacacgttcgcagggacgtggcgctgggttgtttatctatggactattaattttgtggagagccaatacaaattttagcaagataagggatttatagctagtctccatatcttgagacattcgccggggtgtatggctaggctgttcatttgtgaactatttattttgagagccaatgagctaatccactagccgttgagttgttcttctaatcttgggcttaagattgctcgatttggttttagtcggttcgaaatggaactaggtattagcaccccaattatgtgatgtatagtggtgagtgcacatattgatacatgtttttccatatctttctttactagtttaaaaccatagttggtcttctttctctgtaaaaaaccgcgccctcttcttcctttaaaaaactccctagaaaaccactcccctttttctgaaaaaccacccatcaaatccgtaagtagtaataaaaaataacactcagatttgatactttcactatgcaattaagcatggcaaaaaccatgcaacacagcacccgttgatcttttagataatgaaagcttaaatacaccaagatgatatatttcaatcgagtctatccccggcctctgcatagaatgtacacagccaaaaaactagatctaagaagacttctctatcacaaaagacagaaactagtggctattaatccgtaaactagacctccacccatgcttctgggtaaaatccagtaaaaaaaaagagcaagaaacctcacgtacgtgagaacgaggcaactagcagatcgaatcactgtgatcacggcgggcgccgacgaggccagctagcggcggcggcggcgacgacgacgacgtggttaatttgatttctgttcgatcggagtcgcagctgtttgttagatcgctaattgttttgtcgacgacaacgctttctgcctgacttcctgccaatgggaagcccacgtacgattgaattgcttgtacagataaaaagaggaagcatatatatacatcgatctggatgtgattaattagtgagtgccagcacggcatgcacactaattacttaatttaatcggttttgctgcatgcataatatgcatcagtgcgtcgtgttggtaggtcaattatattagtcatttgagttcgaatgaaattatgaactcctttgcaatgccaatgcatatatagtcagttagtaacacaaatacactagctagtagcaagtacatgagcaataattgcgagccggccgccatcgtgatgattgctctggccttttagctaagaaacaagaagaaaatgaaagaaatgtttacagcaacaacctgttggtctctcgtctcttgatgaaagcaaatgtaatatcaggagagtgtttcgagtataacccagtgttttccctgtttaggtaagagaaaagggagagaactaatggtactcaactcaccattacgtgaaagcattgggcaagatctaccatctcaaatgacaacgaacgaaacaattcgtctggaaatagcttcaaatgatacagacacctcgtgttttgtgcacctgatcagccgccatatttggggggaccaaaagaatagatctcaccagatcattttaaacaggtactaccaattttaaataagtactccacacactacagattcacagcatctaaaagtaaactcacctttgccagtaattgcttatccctattactttttttctttaatcatttcctaatcataatgggctagcagcaatcacaaggctactgccaagataagagaacgaaggctagactttgcttgaaaataaaggctttcatatttcataactttatctatgcaccacttacagtggaacaaagctgactcactgaagcaatccatccttgtgccttctccatttcttttgacttgagcagaaatgctaacaaccttgaatatgacaccaggtaaaacagttcatgcgatacgcgatctgcttcagtcagcagatcgctccgataattaccattatttgtcaatgatttctttcagtaatctgacaattctacaatgatacagatcacattgccaacgctcttaacttacacatctaaactaatgccctggtgtgccttgtgtgatctaggctcttacatgttacatctactgctacaaaactggaaggttaatggtacatggtcgcgccccaaagagagttagtccacaggagaagcagattacgaacagcacacggtgcgcattcttccttgaatctccaggttccctcgggaagcagtgaagcacacgcagccacgctggctacaaactcgggaagcacaggcatgccaatcaatgttggttcctcccctctgttcttcggagtgagcttaaat

SEQ ID NO: 102016 - DNA, 941 bp, Oryza sativa
cttcagaagtagatgagaaataacaaccagcatgtacttgagaaataacaatccggcattcctggcattatttgaacgcggcaagtgttttgtttgaagaatgtgaaaagaaaaaaaaagctccttttttagtcttattgtaactgtaacagcaagttgtaggttcagatgaacatctataagaaggtgggaagtgacatttgtaactgtatgcttaagtgtctgttaccctgcgactaaccgtaaattcgaaatatcactaaaaaggttgccaatggtttgtttgcctctccagaacgctacatttcctatttctaccatgccctcggaaatatttgcatccacttcacagccagtaattttgtacataatagtaaattttataagcctatgaataatttagttttgtgtgatcaagatcttcatttttttttgacaaaaaactctcaattttggtttcgtttctatatgatctttccatgtcctatatagattgatatatagacaactcttacaataggttttgcatttgcataattaataatatgactctatagcggttccattttgcttgtagcaattataagggcattataattagaggacatatccagtgaaaatgagccaagtgttgaaaactcgtgaaaatcatacctaaaagtttcgtaaatttatgaaaaaaatactagagataggtgtagatataaaatacattctcaccaaatctcaactccaaactcaagttagtttatgagaaaaaaaaagacaaatttcaggtgaattgtaaccctgttactataattatactacaagggctaattcacaagttcatattgtagcaccttaattacgtagtacgatcttaactaacggattttgattagataagcagctaggattgttcatccactatattaggacctctatgggggagaatccca

SEQ ID NO: 102017 - DNA, 1400 bp, Oryza sativa
tgcttcctgatcattaagtgaatgaaatcaaccacataacaggatagtaggttagcatttccaacacaaacatcgtgaacatacctgacacttaaacaagcaagaaagcctatacccttcccctagtgtccgcaagagtgccattagctccctgataccaatagctaatttggagtcctgtgacagaactcgttcagatttctcttgctcgggatatcttccatcaactatacttgtagaagacgaagttgaagttacattatctgtccacatttcatcaacaacgtggtacctgtttcctatggttcagaaggggaaataaaaccatcgtgaatattaatgcaccattcatatagagaaagctgatgcgattattatgataattataatttcacaaaccacgtaattatgatatcgaaaaggataagttgatggattggatgatcctgcatccagtgaaggagaaggatgtgtgatcattttaaaagtcttaagtgttagggctcttgaaacaggattcatggtgcaagaagttcctttcgatttttttttatcacaataatcaggaaaccttatccataggagtgaaaagttcaaacaagcaatgatacagtaaaaatgtatgaatctggatgtaaatatttatgtattttaggaataatgatctaacatgaggcgccaaagaaaaggataagcaattctgcagttcatatgctacatgaagaagaaactaaaaacaatatgataacggagacacttcaagggttgaatgatagctgataatgttctggtggtattatagatgcttaaaatttcagctcaataatagagatatttaaaaggtatatggattaacatgaacagccaataaattcggtgagtagttgcatgatgtttcttagcatcctaaatgccttgtgagttgtggcttggtgtcattattgtacttttcaagtacaatcaatacaatattgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgagagatatttgagtttgagtttattgttgtatctctagaaagtcttgcacttcttcgaggaactgaatcactactctgattaaacagccttccagaa

SEQ ID NO: 102018 - DNA, 1421 bp, Oryza sativa
cagtgaagggacttgaagcggcagcacagtggggtatagcgcatattcacttggagacggactcgctgttgcttgtccaagccctgaaggagagcaacatccatcttgcagcgttaggtggcttcgtcctgcaaatgaagaagtttattgctttggcttttctttctttccgtgttggttattgcccacgtgaatgtaataaggtggccgacgctttagccgcatttggatgtaatagcccagacaatactgttctcagctgggatggaactccacctggcgttgaggatttggttatcgacggttctgtcgagacaatgggttaatggaaacagttagttttcctctcaaaaaaaatcaaaatattaatttaaaatttatgactcttcaacgcttaaacatcagtcatatgctagtcaattttctgcttgcctcaatcgtaataataaattggtccttacacatcctacagccttgcaaaatattaaaaaagaataaatacattttaaaagcacattagataaagtgcacccaagcaaaacaaaaaccactttttttattattattttgcggattaacatacctcttccgtccacctcacttaatttaagagcaacacttttagctcccttttactctttacttcaaaaaaggatggtgtacatattgcaactcacaaaatactactaaccttttatttctcacattttttaaaaaagtaataatatatgcttcggggctctggccatcaatttgtctccattgttcaatacgtgacttgctaactgggaagaggctcctctcacgtagaaaccatctttggtcggtctaccaaatttcacaatagtcccgattgtattaaaaaccgggactaaaaatatttttagtcccggtttgaaagctttgaggaattttttgatctttagtcccggttagtgttgaaaaccgggactaaagatctatttatagtcctagttggtgttaccaatcgggaaaaaagatcaatataagctttactcccggttgatgtaccaaccgggactaaagatctatgtttagtcccggttggtgttaccaaccgggaaaaaagtcgacataagcaggctagttgcacgcggatcggatcaatacaatctcctcctctccttttttaactcatctcctcacaaagtcacccactcacccttatctcttcctctccctcctccctttctctcctcctctccctcctccccatcacccttatctcttcctctccctcctccccacctccctttgcaacggcggggtgcagaggcccgcccctcgcggcggcgcggcgcgcggagggctggctgtagcgcccgttccgtcgtggcgcctagcgggaaaattatctcggaaaaaccctaattgcgaaatttgtttctttgattgttgtt

SEQ ID NO: 102019 - DNA, 1961 bp, Oryza sativa
ggggcggcggaggaggaggggaaaggctgcagctctggcgtcctcctcgcctcgcgtcgtcctcgtcgcctccctcgccgcgcctccttctccggctgctgctgctcaggcggctccaccgcggcgacctcaccgagggacgcctccacctcgagcagccgccgccgccgcgaggaggaggagcgggtgggccgggccgccggcggcggcacggaggaggtgcgggtgcaggtgcggcgggggcttgacctgcgcctgcttcttcttgtcgtcgtcggcggcttccgcggcttcacgttggatctggccggggtcggcgggagtgaatggctcgaagccgacggcggccggcggcgggagcggacggcttctcctcctcgccgatttcccctttcttttctctaccaaattactcgagaaattttgtttgtttggtctacatctgtggtggttttcttcctttcctctaccaaaggattttgtgttctctttctcagattttaatgaagaataattgtgattcaatctgtttctgttcttgattgttctttcggagatggatgtttttttgatctaaaattgctagcatgtctgatatgtctgatgtcgtggggattttggagggtgatttggggatttacccctccacaggcgcgcgagggcacagggcagcgaagaaacgttgcccacagcgcgcgtgcctcgcttttccccgtccgctcgagccctcgccagaacgaagtttcgcgtcgctcaactaggaggcgagaaacctagctaggacgcggtcgtccactccacgtcgacacttttcctccgtggcactactaaggaacgctccagctaggagcactgtgagaggcctaagatatgcgtaagctcggttcccggtgtctcctaagcctatgagctcacaaaaacaacttgctctccagttggttctagttgttgtatgtgagacaactgaatgtgttctgaacataggatggctacatgtttacactgtgatgtccatatatatggacatggacacctttaagttccttgtatgtctttaatgtgagcttcactatgtaagactttagttgctccgttgggagtatatcataagatgtgatgacggtttggtggcgacccctaacttgtaaattcaatgtacgccaaaacagtaatcaacttcagtttttgatggtaagagtctaagacaacaattgtccagggagctgacatggactactatcgttatgagatattaccaacacacactaactgaaagtagtcaaagccatatgaaaattctgtttcagaaatttatatgctcaagcaagtgcataacgcacatatggggcccacatagggatgcaagtaggtagtaccgctacgtacctgcataaaaacccacttgctagttaatttctcatatggtagtacaaaatttagaagaaaaaatgaactagaagtgaaataagggggctaaaaaagcccacttgctagccctgcttgcatcgctaggtccacatgttagtgaggcattagtgtcctaaaaaaggatcgggtgaagtactccacggaaaaagagtttccatttctctcttttttaagagtcaatcaagtgttgcaatcgcattactataaaggcaaattttgctacaggacatcgcgactttgtggttttagctgtaggacaccgcacaaagtcacttttggggaaagacactctcaaaatatggttatttgccaggggacactccattcattaaattaatatttttgtgctgactaagcgacaaggggcctacttttttacatggcatgaccaaattgccctcctctctctttctcttcctctctcttcctcctttaatagcgaggccgctactgaggcgttgcaacggcgcctggggacgggcatgggcggcggcgcgtgggcgatgggcgcggcggtgcaacgacgggtgggg

SEQ ID NO: 102020 - DNA, 813 bp, Oryza sativa
attcctgcagcccatattcagtgcctaaatttaatttcttggtgatgaaatctaactaagttcatgcaaaaatctgttgtaaacctatgccaaatgttatggttaggatgcatcgggagtgaagctcccattccattgtttggtcatcaagctgggtactgatttctgctatgtttgaacgaggtgtactgaagtatgttgtttgttcatcactcctgctggttggaggttaggagcaggggtggtgagtggtgagcgaggatctagtgagcattattggttaagtcaattggcagaatacactgatgtggaaacactactagctacttggtagttggtactaactactaaatagatggattgtggttttgctacaagaacttggcagtagttagaatattcaagattcacagcacatttaacaaaatcgatcttcgggtttttctcgtatttcactactattttaaatcttcattgtatacattgagaaggaggtaggtgatatcttttaaagaagatatgcacattggagtgtattgaaagagctagcatctcaaattgaggcagcatttttctgattgtggttggtaaaaagtatcatcttcctcccaaattttccaataccttaatgttttttaatgggacaaatgattaaataacagttaatttggttgcataaaagtttcttgatatgatttgtatgaaaatataataacaagggttgattattgtcaaccaaggctagacacagtaaaaatctgggtgggcctcgctcgggtaattggccaagttggccgatgtgatccggtctaa

SEQ ID NO: 102021 - DNA, 561 bp, Oryza sativa
ctttcataaaagtatatatatatatcacttttcaataaatatttttatagaaataagaagtcaaagttgtgttttggagaccgtgtcgctgtcctaaacgactttctttacgagtatggagggagtctagtagtatggttaatttcgatgtcggtgtgtattcctgcaatgaacttcaccaactgtcctccagacaggtgtggacaagcacctctcctcgatccacacatatgtcacgcagtagagaacaacaccaagcttgctcgatggccaaacactgtaatggaagcttcattcccgatgcatcctacccctaacaagttcatgttagtgatatatatgtttgcaacatatttttgaataatcaacttaataagatttcatcattgaagaaattaaatttagctactgagcatgcatataagacaaatggtaagtccttatacatattgtgtctgtggacatatgataatggatggataaatggatgcagttcactaccttccatatatagtctttagaactatatatggccaaataggccacccgggctgcacacat

SEQ ID NO: 102022 - DNA, 555 bp, Oryza sativa
attttgctgaaagtatgaatgtaataatagtaaaaaaaaagtaaatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccaaggatagaacgactcccagaagtcggcggcggccagacctggacc

SEQ ID NO: 102023 - DNA, 783 bp, Oryza sativa
aggcgcagcggcggaccggcgcggtggcggaccggcgcggcggcggaccgggaggggagcggcgtgggaggcgaggaggcgaggagcggtgtgggaggcgaggagacgccgggaggggagcggcgtgagaggcgaggagacgggagcaggggttttccttcactcacccgtgtctttaaaactgggtcacgagcgttgtggggtttgttcccttacagtacctccatccaattaggtcacgtaaaataggatacttgcactgtaggaatgagtgtctttagagccttttttcgaactaagctacggggaccggtgcttgcactgtgaatggccttaagtgggtgccaggtgctattgcttctttctctaccgatgagtgctgatccacgacggttgtgtgtcacaccttttcttttttttttttttgaactagggcttgaaagcccccatttctattatcagaaatgcaacagtagaagtctgctaactgctaagacaaaagaggaagaaaaaaagaaattacagcacgcaggctgtgaagttttttacagaccatagcactgtgattcataaacaaaatgagaggagctcccacaccctcaacccagatctggtgataccttcctaagagactgctaactatatatgagagcttatactataccaagcaggaaacaaaagatcacagggatgattctccagcagcatcacgcatcagttggttgtgtgtcacactggcattgccatcggatatactccctccatccctaaatgtttgacgcc

SEQ ID NO: 102024 - DNA, 1541 bp, Oryza sativa
ctatcaatatggatggaacctgggtcagcatgagatctagataaccaaaggccatgtctatgactgaggcgcataagcttggttcccagtactcctaaccctacaagaactcaaaccaactccactgttgtatggtacccgtatctatgtgttctgaaaagaggacgcggtttcgaaacacttaaggtccttgactgcccttaatgtgcacttcagtatatgagaatttagttgctcctttaggagtagttcctcccatgtgttttggtttggtggcaacccttcatcatccgcacacgcaatctttttgcaccctttatattattagggtatattgctacatttagggatgaaactggttcggatagtttccgtccgtccggaccatttttcggattcggatagtttcgatcagaactatccggaaattctcgaatttggaaacaaattcggatttttttttctcggaaacgaaaacgaatacagtaagggtactatccgtcggaatcagaaaacggtcggaaactatccggaatttttttcggatatctgcagacattgataaaattttagaaaaaacatgtatatatacataactttttcatacggaattagataaagacaaactttatatcaatattgtagagctcgatgagatctacaactttcttattgactattttattatttgagatcatttaagggtttaaatatttattataatataccatattaatttttacaaatctcagatttacaattcaaacgacatctgatggagatgtgttctatatcaaagttgtagaactcgacgggatctaccactttgtagtttataacatttgtatttgaaagcatttaaagcataaaacaaatattgcaagtttcaaagatgtaaagtaaaataaatagcatcttcaatttatacaatggcaagtaagttatacatctagtaaaaggtcttgagaattgaaaatgataatcatatttgcatatggaggaacaaccattaaaattgatttttcacatacggttgtgagaccatctacaaaatgacgatataaatgttagagatgttaaacaaaaataataagtgatatctctttcttgatcaagaaactcaatttgaggggctttttatataccggtaaatattcgctgccgtattcattctgtctcgtattcgccccgtatctgtattcgataatattcgatttcatttccgtatctgagtttttgattctgattccgattccgaaaaaaaatatgaaaacgaatatgataaagctagtttccgtccgtttccgatccgttttcatccctagctacattctctttatagggaaagccctcttctaagaaactaatagaaaaggctgacaatcagcgtgaagatctgttcccttgttattattttcatacaaattgtatcaagcaacttttacggaacaaatattaggttttttaattcttttgttcaataaaaacatcaaggtattgaatggttttggagggagttcttttatttgaggggggtgggg

SEQ ID NO: 102025 - DNA, 809 bp, Oryza sativa
gtaatctccctatatataaagagaccttaagatcaatgagaatatgggcaaattcatgattcactatctctacttttagttttctaacacgttatcagcagctctatgataccgagcaagaaaggtgaagaactcaccggtaactcgaagggtaagatggctcgtcgtttgcccattcctcttgacgccggatctcctcttcctcgcaaccttcgtgctcaccatctacgttgtctcatgcatcaacagctcaacaagcttctcgggtcctgtgtgccgtcctcgacgtggtaggggctgtggtgctagctttgctagccgtggcccccggtctcctccctctggcttcgccagacgtggaggacgacgccgcgacgacgatgccactgcccgcaaaaccaccaaagctgatagcactaactccagcaccctcacgactcgtcgcgggcctctagtgatgcccgaaaactacacggcgccacaatgcattctagtggagtcaccgcaccactgcaagtcccatggatggatggcaagggtgcggctgcaacccggcgggctgccgcaggaggtgccatacgtggtgacattgtactgtccttaccacggctggacgaaccatgctcgctgtgtcatatcaccatcaccttcaccagagtactcaccagcaacaccgctgtacactccaacaccgactgaaccgccgttgttccttctcagtggcaccatcgtgatgtgccgtggagccccgcccttctacatggcagtaggtggctccaacggctccgtgctctcccctccatctccac

SEQ ID NO: 102026 - DNA, 537 bp, Oryza sativa
aattaatgtgggaagcacatgtatagggaaagtaactttgatatgtgccctctctctcaagaaaaagaaaaactttgatgtggtgccatagttagcaggattcaaattctgatatcacgattatacatatgtgagtgttcttgctagaaagttagcaaaatcaggtcacaagagtgaggtcgttcgtcggtcagcgaatatggtggcatatatagcaaaggagtgttgctccaagaaatgtgttacgacttattgtcggtgcctcccaatttttcttaggttttttttcttgatgaggattgtatccaacataacctgattgtataatttggctttaggtttatcctcaaaaagtaaaaaaaaagttagcaaaaataaccaatttaatcgttggtctctgtttttttagcgagtagagtatatacctagaatttacgacatcgattcctcataaggacttgaagaacttttaggtactaatgatgacaaagaaactaagctcatcacatcaacataataccattgttttttagatgt

SEQ ID NO: 102027 - DNA, 520 bp, Oryza sativa
aggcctcgttcgggtatgctccttggctctacccattgcaactaaacatgtttcttttgctcctgccgtcgtcgtctgcgaggatcttgccatcgcctatgtggttgttgcaaggatttgattgctttttattttatctttgtaggtctttttttcgtatatgttattcttgaagtgtatttacccatcacttaggggcttttatgtaaaactagctattctctcaactttacccactagaaaatgtaactcatgtaattgtccttgattaataaacacagttttttttctgaaaagaaaagaatagtagcactttactccacagaataagtatatttttgctccctaaactctgtgggttatgcacatatagttggaaataagtctatttgtattcctcatgtctttgggcctcgcttatatggttaattaagtctattttacgttcctctactatttttttcgatcagtgacgtgccgggccagcccaccgtgccaagggagcggggctgcaggaatt

SEQ ID NO: 102028 - DNA, 821 bp, Oryza sativa
ggtagcagcgaagaatcaagagagtgcttaaggtgaaaaaaaaaaggaaaggagaagtgatccgtaccagaaattgatcagttcggagcagttggccttgatgcagcggagtcccctacggacgggaggccttgatcttgccctccactgagtatgccttgtagctcaccacgcgccgtcccctcctctttgggtcactgaagatctgggggatcacatgccaccatcaccgtcaccaaccttggccactactatattctccttcaaagcaacagatcaagtggtcaacaaggtattcactgcagcttcatgaaaattacaagcagagaagcagtagaacctgaattttatctgtggatccttccataccagaacagcaccaaagaagcattctcttcactctcttaaatgctcgcacaacaaaacatggtcaaaggagcttccactagcattcaaacttcatagatacaatcatttaatcagaatatttgcattaacccttctttataagactagcaaaatgcatttgcgttgttacggaattaaaaatcataacagcacaatgcagagaggaaatctattttgaatcctagagcttaattttagaattaatttgagttttttgcttgccaagtttacgctccatttgttattaactcgcaaggatgattatggttgagagctccatggtctgtccgtgatttccactgttctatcatacaattggtttggagaagggattgacagtgatcccacatgtcttggagaagggattgacagtgatcccacatgtcagaattttgagagttggtggtggggtg

SEQ ID NO: 102029 - DNA, 661 bp, Oryza sativa
tgcacagaaaaaatagaacagcaacatcatttcagtggttcctaaaaagaaaatgtgttgaaccaacagtggtaatgacattagaaaatatgtgactaacacacctttgtcttagtcacaagttccatcagatcctccatcttggatgctgctttttcatgggaatactcctgagttatgggaccatactccaatctgcgcagtgacaagaggcacacaaatgaacactcagatagaataaaatatgattgagccatgaattatacaagaacagtaatgtggtggcagctaaaattttacccagagaaatgcccttcaagattgtgccatttgggatccctgcacatgttcccaagcctagcaacagatgccgcaaaatctttgaactgttgtctgcataaaccaagcccaatgaatgtaagaaatcttgaaaaacacatataagtaataatttatataaatagtaaaagcattgaaatttatagaaaaagtcattaattacctaatttcatccccaacaagagcaagcaactggctctgatcatctgagatcagactttggacgccttggttctgaagcacaacacgtttcaggtaccttatgttttcctcggagaagaagttcatcaggggggaacccatggcaattgtgttggctacc

SEQ ID NO: 102030 - DNA, 993 bp, Oryza sativa
tttaattgaagtaggaaccccttcctttttttaattaattataagtagttgttactaattaattgtggaaaaggatctaatgggtagctaggggttaaaaatgtttagtgggagtcagggacatcaatagttaagcacaatacaacatcttatttaatttaatttcatggtatttctttcgtttcaaaatataagtattttcgaaatatatttaggagtagtagattagtacgtaggatagataattaactgattttgtacatgtgatccatgaagagagcaatatgggatgcttataaattaattaaccatcaaatttatcgaatcaagccacagcagaactagctaacctatgtaactactgaccgggcaaattaagccatatagtaccaatttgcttgatattattagcaaagctagctagttaagcttggaggtatagttctattagtgtatgaaatatcttatgggcataactaagtatattaattaattagttggtgtgtgatttggatcgatctcttgtacatatatgcatgtgcatttgggtagtctttgattcaaaggatatagtaattaatgtaaacgtagattacaattgatttgggggtgcaacgggatgcatggttaattaattagtcagttaattactgtaattaatccaatttgggagagaggttggtcgacacagttgctgcagtgtcttgaccattagctttggatgtgaatgggctgtacatgtgactgttaatctgttaaatatacggtccaattggaacaaactgtgtcggcctgtacataatcaattaatggaataattaagttggtgatgcatattttagtttttgttacacccacaaaaaaaggctcaattaaacaatcaacacgttggttggatgaaaacattgataatatatatatgtcaatttggacaaatatatacgtcgccccatagcgacttttcatggatgtcggctctcaaaacactcgcag

SEQ ID NO: 102031 - DNA, 964 bp, Oryza sativa
tccactccagacttaactactggagttatatttagaagttgaagctgggtttaaataggccttgttggctcaaaaccaggagacgttggctcaaccgggagaaagccttaccacacctcaaaagcttgctcatgaaacacaaaatagtaataacgcacacacaggcttcggcaacgaatgcctttatattttctctgtgactcacacacaactcaaacaaacgagtacctggcttatataacctgtttacatgctgtatatgggagcaaccactacccgggtcttcatgcgcacatacgcacgatctacatctacatgcgtgagcccctaactcttgcatggctactgaccacgagtcacgccgaacgtgcacaactaacaagcatgcatgcagctaactaattactaacttgccgcgctcactaaccacacaagctaattactcagtcagctaattactcagtcaactaatctccaacacatggctgttaactgagctaatctcctacacgcatgcaacatatatgcagtacttcactacgcgcatgacacacatacacaactaactaatgctgataatttaaaacatgcgcaagtcatgattaatgctaacaggccctatattccgagtgatctggactctggagcagtacattttatactaatcccacggtcacaccatgctcgatattctcttatattatggctagttcctaaattttttttttccaaaaaacatcacatcaacaacaacaacgtactcctataaaaaaaactactggtgtcagagattataaagccaaaattcttttttttctctcatggacggatggcgtacggagaaaaactgtgttagggttgctttatctacagctctatctctattttatcttttttttaaggttggagtccaataaaatagttttgaaaaaggaacggaaccttcagagtgatttgaaaaaat

SEQ ID NO: 102032 - DNA, 693 bp, Oryza sativa
gtatctttgtttattacaaaactacagatactttacacaatatatcacaaaactacagatttaagaacttgtttcacaaaactatatatttagtgtcttcatttattacaaaatacagagttagtgttttcatttatcacagaactacacatttagtatcttcatttatcacaaaactatagatttagtgtctccattatcacaaaactataggtttcaacaatgctaaaatatgtagtttgtgataataaagacattaaacctttagttttgtgataaatgaagatattaaatctatagttttataaaacaagtttttaaatatgtagttttgtgacaaattgtacaaaccaggaattgaagaggagtgtgcacatgtgtacgtttgtactatatttctaaaaagaagaaatatgccaggttttttacgtaatgtcgtgatatcttttgtatgggggtgtataatcgggcaatcactcgtctggaaaaatgttttatttatcagtgtgaaacacgcaatcctcgctccgatgatgctccccaagtgcatctgaaatcctataatatttaagtttttcatcggtgcctttctatttatcacaaatactgtagtaatttgaggacctatttgtccattaaacagcaaacaattaattacaggtgctccaagcaaacaacttttggctgcaggaa

SEQ ID NO: 102033 - DNA, 1178 bp, Oryza sativa
cgtactagcattgcttgggccaatatatggaaaatctgttcattataatgagccacatcatgttgggccgacacagtgaatgagaaaatcccaaacatgaattctaacacattgagggtgtcccctcatatacttttttctctttaaaatttaatgcagatggttatgaaaaaaaaatcaatatagagcatagtagcatctatcccttgattgttatcattatgtcaaaatggagttgctagaaatatgacgccatatgctatttcagccactttgcacagtagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaaacggaagccaggacttggaccattcatcacaggcgcgacttgggaactaggccgaaaccctaaaactcatcgtagccgacttgctcctggaagaactcttcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaattctaagtgagtgcttctcaaacgacacggatgagacagtgcgtctcgtccggtcggagtatgtgcaatgtatcagtctttaggattgcaacaaggttggcacccggccaacagcttttcaaacggccacccgggccaacaacttttcaaacggccacccgggccaacaacttttcaaacggccacccgggcctagctgatcccatcagctacagatttttcaaacatcgaaccccttttcacaacagcaatttcacaagcagtagtcagacaaaactacgctaggaatcacctcacatccgcccttgaccgtgggcacgactattcgaacagttcaatgacctctgcagagggggtacactttacccacacgacattactaacccggatcacccagcccgtggggatcagccacgt

SEQ ID NO: 102034 - DNA, 1892 bp, Oryza sativa
aatctcgtcaaattcgaggagcacggccgcgttgcgggtttgcggttgcagcgctctcggagtctctccgtcccaagtcataataacttctaaggagcttctagcaaaatttatctaagatctttaatcatctagattctaaaattacgtagttaaaaaactaaaaactgaaagatatagatttttttatgttcttaaaagttggctactaaccagcggcttttcagaatcttaatcccccaattcttcatatgcttatgtaagctttggaacaaaatatttgataaaagttaaagtctccaatatgtgagcttgtaggttatgaggtattccatgttaacgaccacgacatgttgtataaagtacagttatattcgatgagttattttgttattatgagaaaaacttatcggtgtgagggagtgtgtagtcttcggttgtttgattttggattgaatggttaggtgtatactcaatgactcctacttctctctctctctaacattcatagcaatataactatgatgaatgcttgctatagaagtgaacatacgtaggcatagaaaattcagcgataaggaattcgttatgagaaatatatatgattgtgaccacaactcttgtttatttataatgcaagaaggggaaaaaacgtgaccagtggttggctcaaagaatagaatagagctcatatagatttctcatggaaaattgtaaatacctgtgaaagtttattgttcatccatttggaacaaatgaactaagcgtaaaggaaccaaggaattggcgccttcgattctataggaattttcacgtccatcttgggccctttttctttcctttgccatgtacataaatcaagctttatagcaccaaatatatataaccatgatttgagcacatgtaggtaccaattataatatacacttatatggcaatatttgtatatgtgttcaaaacactttacccttttatgtttcctacattttaaaatcatctatctcggatatgcattcctatgtttttttcccctaatttcccatatattacatttatgcattccacataaacctaacaattggtggattttaagatataaatcgaacaaaaaccctaaggaagattattagtttctcatgtccatgatcaaatcaataccaatcgttgctccacgcctaaataagaactaaaaaagatggtagatcaaagctagcaccgctataaaaaaagggggaaaggggatgatgcacttgaatgccatgcatatgcctagagtctattattttgtttaagaaaagtataacatatgagattccaagtattctatctggtcggagattgctgcagttgacgcttttggtcatcttgcttggtgcctatttggtacccattcatcatcactatcagacccactttccgtcatttgaatcggatatccttctcttttggatatctggtcgcgtcgcttgccccttcctaactctttaacaataatatatgttcctttactacttgttttcatcgtatcccgggctcgactttggccccgtagatgggagcctccacgcctaggcatgtttgctaccattcccttcccccttactataggttgccttcgccgtaacctggtggggatagagaagagaataaaacatgagcgattagaataataaggagagatgtttaatatattgagaaccaccgaagttgttgaatgtgataaccattgtattaatgaagagataaatatgtagaccaattatgcaccttttcttgatataaatgctacctccaagactttaaaaaaaattgtcaaataccaactctataattaatactgctaacttaatacatcctgcaactataatgatataatggtattttggaagcgt

SEQ ID NO: 102035 - DNA, 548 bp, Oryza sativa
catcctcaaatcttcctctgaagtatatcttcaagcagcataattttgctgagaaatcaacctgagataacagcttggttgagcatatttcgttggacattatcctataatagagaacttttacggtgtttgcattccaaaaagggtaaagatccaacgctcctcaatcacaggtactatgttaaaggtatttaagtattgatataggtatttaggtactaagggtaaaaatataattttgctagtagagtgaaaagggtagaattgtcctccaaattataataggtaccgcataggtacgctctacacggtatcagcgtatcttacacagtatcagcgtatcttttacgtggtttcttgaagatttacgttgtattcgagttaagccaccgtagtgttctttgatgttctcttttgcgtagatttctctagatttacattgtattgttataatacattagtagcctaattatgtgaattttttctacatttacattttgttccaacgaacacatgaaaactcataccttaattatgataaaaattat

SEQ ID NO: 102036 - DNA, 712 bp, Oryza sativa
aacatacgtaaaatcaatctagggtttgtctcctactctgtactgtgccgtctatcgtagactactccatcccgctcgctggcgtgcaccggcaatcgggagagcaggtctccagaacctctgcattcgacgtccttcaccgggagaaggcggcaataaggtttttgggaagcgcttcgcgcgactgctccctgttcatccgcgacggctcgccttcctctccgctcgcgtgctgcgcgccttcgtcgacgcccgcaaccgcaagtagttcctgccgagcaatcggtctttccgccacctcggtatgtgttcgacatgttgcgcatatttgatctgttcatgttttactgcttagtttacatgtgtagatctaatgatgcgttcaatctagtttacgtctgcaatgacatgatttatttatggaataaattaaatcattatgtgcttataatttcaacacctgaatcactgtcaaaagaagcatcaacattaatcttgagtaagggcaacaatagctacatatgatcttgacggggtctgaacactttcaccattaaccatctgcctcctttcccaccaaatataccatcctcttgtcgaaacaatttcagaaaagcccaagtcattaagcatagaagtgattcaattgctatgattaaaaatagaagtgactagttgataccccgcgctttactccggggtatatggatga

SEQ ID NO: 102037 - DNA, 1135 bp, Oryza sativa
catcacatatctgattttgcggttggaggacgattttataatttgatgtcaagtcgagtgacattcgatgtactttttccctcacatggcgcctcgatcggtgggcccaccaccgctcgcccaaatagcaggatatgtagtttgccttagggttaacagcgagtgtaaataacaaacgtgactggcagcatgtgtcaattaatggtgatgactaggatcatctgaaattgtccaattacaagagagaccaaattagttgtatttaatcgagcatcgaatatatttttataatatatttattttgtatcagaaatgctgatatatttttatcaaacttaaataagtttgactagctagaaaaaaaattaaatgatttataatataaaatagaggaagcgctatattttagaaaggaggaagtatagtctatggttaaatcactcatcgtcttaatttttcgttgctgcaactatcagaaaccatcgcattttcagacccatttgctctagtggttttcacacacgtcataaaaattatcttaatttgataattacatattatgagagcacactcatgtgaagttagaaaccgtgtctaagccgacagtaactgttatttaaagaaattgaccgtccccatccaatatccaatattttcatcggtctccatgtatgtgtcacatcattgtagctagtacgccaaacagcacgcaagttaaaatcttgaccctaccgtatcactagctgatgaacagatattgagaccctagatacaaaatataatatactaaacaatgcgtacatggatagaatgtcctattcaacacatatgcacaaatcacacgattaattacaaaagagaaaacaaataccagttcaatctcaccctaagcaacgacgacgacgacgacccatggatatgatgaacccaaagtaaaccttcgaagcaacgacttgttcgtgtgtacttcacctactcacaaaagagctattctcccatagataaactcacaagtaacaacaaccatcctagctagactccatccttgcactccaagcaacactaatctctccctagctacaccatctctttataagcatacatatatatacataaacataaacgttagtgtgtg

SEQ ID NO: 102038 - DNA, 533 bp, Oryza sativa
tattggcagtaacattgatataaaattatcttttttgtgtcgagattatatactactcacgttggctcccttggaacctctgaattctgcaacaatttcgtaggaaatgaaacatccacccttactagttactaggatagttacaagcagtggtgttccaaacaaaatttgtgcgagaattcatgagttccaaatggagcctctcagcattatagattgtaaatcctttcatttgggtattaacaaaaagaatagggcggttgccgccatattattcatagatcaaccaaaggaggatatataaagaaaaacaaaaggtgggaagagcactgaacatctacctagatggagtatcaccctcttggattggaatggaatttgcaggcgaaagtaacaaaactcaactactgaaatggtagtagtatcatcgagttggtgcttctggtttccgcggtaaaaaaaaaaaaaactcgtgtgatcgtgtgtctggtccggtcgacgccatgtatcgatccgattttaacactcttgtc

SEQ ID NO: 102039 - DNA, 1008 bp, Oryza sativa
aaacctagagtctaaataatcaagtaaacaattacttttcaggatggtagatgtcttaactaatctaatctagtaggaagatttaccaataccagcaagagccctaagtgagaaccaatcgatagagataaatctagatactaagactagattagctaagacatatgatagcatatgaccatgataaaagaactaaaacatctaaagcgacataatagccccaatagcacaagccatcgagacgtgttacctcttgcaaagcgaactcgttgaaaagtaaaaacaaaaagggtggcaatgcgctgaagttgtattggattgtctcccgtattacaatactagggggggttcatatttataccccgagtcaaacctttctaaagataaaatacaaacaagaccatatacggcggtctctttgtaacatacccgaaattctaggacttaaaatttcttgtcaaaatagttagaggttaacttctccaatttttgagagccaaaaatttccgttttaatttaggtgatgaccaacttaaaccattgcatgattaaaatttgagaacaaaataaaaccttttcattcccaacattagactagaaatgtcatcaagcatttgagcatacatgtgcataatacatgcctaggctcgagtcccttgtgcatttggattatggtctcgcttttcataaaagggttaaaattactaaacaaacctatagttaatcttgggtgataacatgtggacttaatattaaactcaaatatcatcttctcagctcaaaagaagtttaatgtaatccctgtaacaatattaggtgcaattatgaagtgggaacacatatacaaagtaaagtaatcctaattctctaaaatattatgtgcaagttaaaaaccatggaaaaaaattagatagacaatgtttagcacaagcaattcactataatattggtacaagttaataactaagcttaataccacaaattaatcagtcaaagcaggaaactaaa

SEQ ID NO: 102040 - DNA, 666 bp, Oryza sativa
ctgcaagtcggtcatcattaggcttttacattaattgagcacaaaaaagaaagattacaaagcttggctaaaagtccacagccctaaaattttagctggcattttcttggtagaaattcaggtgggccctaacctattttcttaacccatggtggcgcagtaccaaactggactattgattggccttttacccttaaaaccaccggctggttaccaaccttgccaaatttgtaaaatcttatttaaaacaaaaacttccgattttcttggccattcccttttaccttatagcctgaatcttatcaattagtgggggattaattaaattaagcccataattctggatcgcatcaaacattcggccctaaaggcttagaaccaagggaacacttaaagcttttttattaggaagttaacgaaatatggtctgaatatatttcattcattaaattagataagaaattaactttttcaccaacacttttggttaaggaaaaattaacttggaccatcaaagccactaccagttggggacagaagatagaaattgaaatgtacaggttatcttatttaagatgtcagcgctttttaacccactagctatttggccatgttgttaaggaaaaattaacttggccaacccaaacccctaaaagtttgaggaca

SEQ ID NO: 102041 - DNA, 732 bp, Oryza sativa
aacctaattaagtcatctggagtatatgctaggaaagaactcaagaagagacacttattagtcagccactattccctggatttggccaccaaagtacagagactaactcgaatttgtgaagcaagtgtacattgaggcgcaaattatctaaaaaaattcggcacagacgtacaaaatttcacatttaaaacggggtcaaccaagtcttgatcaaactgcagaacagcacaaattaatgtaaccaccatatcgacgatgatgtctgcatatatgtacggcaatataattgagctgatcgaagtctagctagcttgcttgcattcctggtctccgattcatcgccatgcatgcttagagcaggtacaatagcaggattttaagaagataataaggagagagaagagcatcgggctatagatttgtagccagctgtagcacgaactccaagacgcagtgtgtgtataacaggtgggatcagatattaatagtgtagtatgtacctattatacgaatgagctattagactggctatagatgaattggagttagtagatggctatactattaaacttgctcttatgtcctcatcaatatcttgcaaagatactgcaagatctgtttaagttgggagaagagaggatctaggacactgtgcccttctagctagtgtacacttgtaggccccgtccgtatacgccacacactgttttcaacatttcgttacgtaactgc

SEQ ID NO: 102042 - DNA, 565 bp, Oryza sativa
agtaaatttgtggatgcagtatataggcaacgaccaagcctctccatcctcagagaacaaatcaacatggaacccggattcagagcttaaccactacctcgccaccaatcatactgagcatgatccgacgcttgatggccacgatgtcgatctccttgggtggtggaaagagaaagagcgaactcttcctgtgttagctcactttgctcgagatattcttctggttccagcctcctccgtctcttccgagcaagcattcaacgttactggaagaattattgaagaacaatggtcatgcctgacacccgagacggttaagtcaatattttgtcttaaagactggatggaagcagacgaactaacgcaacactgtctacatgatcaagagtttgccgatgcaatggaagacgcattggcggaaatttgccttaccaaagatgatggtggtgttgatctggagtaattgatggtataatgtaaaatagttgttgtactcttttttccttacggggaaccctactttagggcgtaaggtttttaacgaggcaacaactatatattcaaa

SEQ ID NO: 102043 - DNA, 549 bp, Oryza sativa
cacacgtacgtatatatacgtgtgtgtatatatataaatacgtgtgtatatatatatatatatacgcgcgtgcatatttattgcatttaaattctgatgcacacaattatgtatgtgcgggtctacttttattagaaatttagtcaggttacggctttattatctattttcgtctctcgatagtatgtatgtgtgcatcttccatgtgattaaaaacaaaagacgatacatgcatcatgtcgtgtatttatcatatatgattactatataattaaaaaggagatggagaaacgtgctacatgtgtcatctcatgtatttgtgtatatatatataattaaaaaaagagagggagagacgcgctacgtgcgtcacccccatgtattttttgggtatatatatatatatatatatatatatatatatatgatcaccaagcctcttattgtgcattttggtagtttgcagtagcgggcagatcgagtgcatggcgctcgggctagtcgtcgagaagctggcgctatggctgctcgcgtcatgcgcggatgcgg

SEQ ID NO: 102044 - DNA, 522 bp, Oryza sativa
taacttcggtatctaatgtgaaattagaaacggaatttagcgtttacacccacagtttgagtgtcaagtacatcagcgtcttcttctgctgtttagctgcttcgaagtttgcatttacatagcttgcacctactgaaaccgcaggagtgatgaagtagtttacgttcgcgccccaagctttatttggagaatcgttgtagcttgattccatgtatgaagcaccaacgctaagtgctggtgttaaataaagatcagtttttaagttataagcagtgctttcaccgtaaactatacctgcttcaaaaccaacagccatatttgtaccgtcaattgcgcctacatattttgtacgtgcagtgattgcgtcttggtcttgagcaattgtgcctgactcaagcgctgctttagcaacaccattagcaaggatattgaaagcatctaaagaatattgatcggcaacgcttgtataacctacagcaaccaagaagttaggcgctacaactgcaccaagttctaaggcat

SEQ ID NO: 102045 - DNA, 867 bp, Oryza sativa
gcgttttgatctccggcgaagccctgctgctcctcccgtcatcgccaagcttcgccgctgcctccattggattcacagctgcgaagtgaagcccggccacccctccgttgtcgccgcacatcgccggaaagtcgtcgcctccgtggacagtacctcgccgcccttcgaagctcgtcgccggccatcttccgttgccgttcgtcgtcgcataagtggtggtaagggtcactttgatcccctctcgctcccggtgccctccgtttgcgttattgtgccgtgattcgccggcaaccgccgctcccatgccgttcccagtgtagtttatccctagggtcttaatcccatctaatctaatctaatcttgtttggccctagtgtcgtcatctccatgtgttgccgccggttcaccgtcgtcatctatctctccccgattggttcggtgggacgtctatccgtgtctccttggtttagatttcaacccatcggccgcacttgccaagccgctttgtcacagccgcagccgtgcctgttgcattgttgttcgccgcgctgctgccctagcccgtgcaccgtcgctaccggagtgccgctgttgtttgctgtcaccgctgcgctagtcgtctagctgcccgttgtgccgctccctgccacagtcgtgttgctgctgctgtgcgtaactgcttgccgctagctgctgtctggccgctgtgctgtgacgtgccattgctgctgtactggtcgcagccgtgcgtcgcttaaacctagccgccgctttagcccgttgctcggtagttgagttgtctagctgtaggtgcatccctaaatcctgccggcctatagtttgccggaccccggctttaccgtgaa

SEQ ID NO: 102046 - DNA, 566 bp, Oryza sativa
ccttaattgaagccacaaattccagtccaaatccatctcttcctccgccggagacgacgaagaccagggtttaacttctcgatttgtaaaaacagcttcttatcggtttatcgaaatacgacaaaaaacgatgaatttgatcaacgccgtaaaaaagcggctactacctatcggttttcacaaatcgatacctaacagtttcacgaaaatagatcgattttttgaaattccatcggttcggcgtgctggggggcaaacgttctcacgaggaagaaaggtcggacagacacgggaaaatgcgcgatttccagccgttcgatgggttgacggcgtgatctatttcacctgggccggaaacaggtgcgcgagggattgcggcccgttatagttgggctgaaacgggagcgcgactaatgtgcgggccgtcatggtcggccttatcacctgctcgggagattgatcaaactgtccagcttcccaaaactggaagaagatagtgcaccgtggaaacctgccaacagcagcagcgaatggatctgtgcagtgctggtgcatggttgcttcat

SEQ ID NO: 102047 - DNA, 566 bp, Oryza sativa
cttatacaagaccgagcactgtatcggcgagctcgataatcagtacaagcggctcacggccattcatggagatttgaaggggattataacactggtgagtgcctcccattctgctgcattcccacctcccacctaacgacgtctacagtttaacgggatacttcaacactacaacacgcgcatcgcagactcttatgcgcgcgccgccaaaacctcgacagacagcatgggttggctggcactcaagacgaagcaggagaccgtgtcaatccacgtcattaccatccttacccttttcttcctcccggccacttttgttgcagtaagcgccggcctttttactttgtatctgtacctgtaccactatgattttcaacctcgagtctgggccctgactggatatcagaccttcttcgggagcggagtaatcgactttgagagggaaggggaggaggatgtcatggaaggtaagtggggatactgggaggtcagatggggagcgctcaagctgttcggtgcattcatcgggccactgacgggtctggtgctggcaacatgggcagtaa

SEQ ID NO: 102048 - DNA, 648 bp, Oryza sativa
gagtcttctgtactactttttcccgtcatgtgttgacaaacttaacccagagattgggcttgtatatggagaagcacctgtgctgcttgaatctggtaatgatgagaacgcaattatgactatctttggagaaagcaagagtgaccctggtaacttgcaagggtttggtgccgaacaagttatattagttcgtgatgatgcaaccaagaaacaggttgttgaccttgttggtaaacaagctcttgttttgacaattgttgaatgtaagggccttgagttccaggtatgagccttaccacttaaatttcaattgtggttgttgataagcatttttcctgtttactgtaagaagccttttaggactgaattatgttgtattaaataaatttctaggatacttatttatttttaaaatatcattttgtgtaggacgtgctgctgtacaatttctttagctcatcacctttaagaaataaatggagagttgtgtatgactacatgaaaggcaaaaatgttatagaatcatctgaagagatgtcccactcttttttcgacaaaaacaagcattatcttctctgttcagagttgaagcagctctatgttgcaattacacgaactaggcaaaggctgtggatatgtgagaatgca

SEQ ID NO: 102049 - DNA, 790 bp, Oryza sativa
aaaaacgaaaagttgtgcttaaagtactttggataataaagtaagtcaaaaaaataaataataattctaaatttttttaataagacgagtggtcaaatagcgtaagtaaaaactataaatcccttatattatgggacggagggagtacgtgtttttaatgtccagtaacaaataccacaaattttaaatgtactatagtaaattttgccaaactaataaatatacatgtcatatagtgatttgcatcgtcgggacttctttcttatgaagctaccttatgattttcagttctgacgagcaggagcttgggacacggagacaagcttttgacagctaaaacttaattaattacttgagatttagggttatctcctaaatttctgttagattctgacaagatacagtgaatattttgaagtacaaaatgtataagcaagttcactatagtattgaacagcccattgtttcgttaatttggggaataagcgaaacggcttatttgtaaataaaaaataatttataaataaaatttttatatcgtgttcttagcgatttaaaaataaaggttgaaaaataaacttcgatgaaaaaaatctcaaaattaactctaaatttaaattttagccgataagtataagcataatctgctcctgcttgggaggatcatgatgtactactttgattgcgtcaattttactccttccgcttgagcaaacggcgatgataaatttatttcacagccctcgcagccatgcatcaacacgtaattaagtactagttgacagtgaaa

SEQ ID NO: 102050 - DNA, 739 bp, Oryza sativa
cagcacatgatgccatttgttaagtctttcagctctatggatcacattcgtgtattcttaaattctaagaatcttgtggatgaactgctgagtgtagagatggatatgggtaattttgttgaagctgctgggatagcaaagcatacaggaaacatcttattggaggccgatctgcttgaaaaggcaggttttcttgaaaatgctacacaacttatcctccttcaattatttgtgaattctctctgggcttcgcacagtacaggatggcctccaaaaaggtttgcggagaaggagcaattgcttgcaaaagccaaagaaatgtcaaggaatgtatcggagtcattctactgccttgtttgctcagaagcagatgccctttcagatgaacataagtctcttgccagcataacttataacttgattgagggcaataaatgtggaaacttgttagtcgaacttatagcttctcgcttgattcttgatgttcatcttcaggctgaagcctctggatactgttttgaatcagagccagggtctcatgatggacggcattgcaaagatatgctagttcttaatcagatatcacttgaaactctagtatacgattggaattactggagttcaattatagtcaaagtgctcaggcatcttgatcaccctaaggacgcaaaatcaaatgatttggcagcaatctgtgaagatctttgtgctaaatactttggatggagaaaagatggtg

SEQ ID NO: 102051 - DNA, 1221 bp, Oryza sativa
gccctcgttttataaagtttttcacaatgggacgagtagaaacaaacttataagctaaaccaaaactatgcttaacagattgcaagccacttcaaaatctttcttaatgtgcactctttgaatttactctgttctttttttctttttgggaatacacaagaattgtacataagagaaaaagggaaattcaccacaaacaacagatttactgcacacacaaaagggcatctagcagaacacttgggttataactatttcatgttccagctttagctctaactatgctgtcagactactagccgatgcattcttgcgccagcagcagaccactgctttgcttctgttatttatccttctgaatttttggttatggtccttctaaatgattccctccttttaagtactcttttaaagtaaaagtgatatttttaagcaaattacatctacaaatgataggttatactgtattctccaaaagaaatgaaggtgctccctttagttaagatattgaaaggaaataccagtgaaagcatagaagccatataacttttttatttttgtcctgcaatcttgatcggttttcttgcatctagcctaaccactgtggagcaagcgatcatgggtagatctggatgcgttttcttcgttaggaaaaaaaatgcagcaagctattagtgctagacttgaacttcagatggtcaaaaattctaaccatttttttgtgatgtgcacccccatcaggattttaggaaggatgtcaaaagagtaagaatctagaccgcttccaaaatttgagaacagaatatattggatcactaaaaaaattctctgaattaattaaaacctataaaatttgtctgctttagaacctataaaattttcttttaaaggtatacttctgcaaattcccttttcttctgtttatttagagtgcattgtactccctccattccataatataaggcacaactactttttaaagttgtttcataatgtttcataatataaggcgagacatgcatgcatgtcattaactagcacatcttttccactaaatgttattatttaaatcctctaccattaagatctctaattttattggatgcatgtattctatttattaggataatccaaactatgaggtgataataattatttcttggtctttgggttaagggtggttgtgccttatatttgggaatggagaaaaaatttttttta

SEQ ID NO: 102052 - DNA, 662 bp, Oryza sativa
taggagggaagtacttcaaaagcttatcaaacttggtgttggctggaggacaacaatgaagaatttgaatttcaatgtaattgatcctttccagcttgcaaaagtatacaaagtcagggacctttatcttgtttggagtaccgatatagagaaaagcgaaaggtatgttcagattataagaatttgggacctgttgtctcaccagaatgttgcaagaactgttcaacgtcttgaaaatctgttttccatgtacacggatgagtacctcgataagtgcagaagagtaaagactgaggggtatgtgcttttttgttctgccagtgtttatattcaggctctgtggatatcttttccttttgatgctctataaacagtgtaatctggtatcctcagaaaaaaatcactaatcttattgacttaatatatttaatgaatgaaatgtgcctgtacatgtcaaggattcttgatgcttgcaaatgaactaaatataatgtgtcttattttgtgcttcatttttattgtggatactaggaaactggaagtgcctgttatttgggatgccgagcatgatattattcgctatcggaaggttctggaagttgatgctcaggaagaccatgatcatgtggacatatcatatgctatggagaattcgggagtca

SEQ ID NO: 102053 - DNA, 598 bp, Oryza sativa
tttctgtttgcctttttattaaccttttaattttactaattacccttatttttggtccccatttagttcccccgttgggtcaccaggatcccccccagggttgtttttggccctgattccaataacaagtccaacaataattataataagtttaataaggactacaataattacggggaaaccggccacagggacaactttcaccaccccgtgaaggaggaaaaaggttttatgtcaaaggttgaacctagtcctaaacagtgtacacctaacttggaaaaattgggaaaatacttttaaaagtcgtttcatgatgcacacttaacatatctactcgtgtaggtaattaacgggggggtaggtaacaaggaccgttcacccggtatcataatttgctcagtggtggtaaatggtggtaatgacattacattggttccattctgcattcgtacttgctatcgcattctttattggctgaatatgccaattaaaacacggtatgcttaattactctaaaacttccaatagcattgcttgttcaaccaatgcagtgatcgtgtagcttatgtctgccgattacctggccttgctctaaatt

SEQ ID NO: 102054 - DNA, 1511 bp, Oryza sativa
agaacgagctcagccatggctagctctgtttcagctcaaaccagggacctctgtggagaagaagcaaaactctaggtactacgttctaaaaactacctcacacatagagcagtcataggactgcggattgattgcctgaaaatccagggacctttttgcatattgatatctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagtaggatgaactttaatatggaaacataaaacttggcacttgcagtataaatttcacctctaaaatttatctaagaaaaaactatacataaagcatgcacaaacttacaaattgcatagagaattcatttcaacttaaattgaagcaaactcaacttctacagattcaccaacttactctctaaggtaaaataaaataacaagatacacttgcttttcaccaaatgccactaaatgtatgttcaactaaataacttgttttagataagctgaactctaaaacattttataaaattcatattacttcctttttgagtaaactcaagttctgtagaatcatcaagtctaggacttcaaagatataaaataaaaatatacacttacagtgcaataaaatcccctaaatatttataaaaggaataaacaacttagagcacccttcaacttgtaaaatttctagagaattcatctttagtctaaatgtaatgaaccaagtttctatagaaccagcaagtaatgaacattaattaggtaaaataaaatgtggaaccttctatactaaatatgtcactaaactttaaatagataacttaagtgctagtcacatggtatatattggctaagcaatacatatgtataaataggcaatccatatgtataaatgtatatataaatgcactctagctctaactaaccaaaataaaacttgatggaccagagaggtcatagttccatccctaaccaccaaaaacttagcacacttagctcatatatcaatttctaggttggtatgttaagtaactaacatagaacgctcccctagcttataaaatgtgtagtagcgtaatataatctctaaaattgtgaactaagattatattggttaataaaattagtcattttatacatctcaaacaatatgaaacatgtcctggacataaaactccgaaaccatgtacacatagaagctatatacctacaacacattataacttgtaaaacacataagaaattcataataactccaaaagttgtgaaaccaaatgttttagtcttagaaaacacatctctacatccctgatatgttaaacctaataagaatggggatcctctaaagtagacctgcaggcatgcaagtgaataccaccctataccgagtaaacttctgaaattcataactcacaa

SEQ ID NO: 102055 - DNA, 645 bp, Oryza sativa
aagaaagaagaagagaagaagaagaaatagaggaggaagaaggagcatctgatagtgggtcccacataaacagtatcttttatttgattttatttcaatttcaaactttagacacccatatctcttcaaccacaaacccaatcccagaaattctttgatctaaattcatctaattccaaactctttattttgataccaaattacctattttaaacattttatttaaattgctttatttatttaaataccttttatttatttacattctgaatttaaaattgttttaaataaccttgttaaattattatattttattcaaatacctttttaatttattttatttatcttaaatacctttaaatttaaatctcttgttctatttaaaaaccccttttaaattaaattttcctataattcatctaaatacattctcgtcatttaaatatctttatgattcaaaataccatttcaaaattctttattaccctttttgaatattcaaatttctttaattaaaaacctttttgaattcaaattcctttgatttatttaaataccctctttatttctaaaccatacctataccattccatagccactaaacagccgccgtgagaactttacgctttccatggagacattcac

SEQ ID NO: 102056 - DNA, 635 bp, Oryza sativa
cccacactattcattaataataatgtggtaattgatgctaattaatttagctcctggtttggaatggtatattcttggtttggagatagatctgtgcagccgggtatggttgttcaggatggttgggcctgtgcagcatgggtatgttgtacagtgttgattaatattgatgattaattgctctactgttttacaattctcaaatgtttgctaaatgctgcttttgcaaataagccctatactatgccattctttagtatccttgtgcacttgcatatttgctgtgtggcttgctgagtatgtcatatgctcaccttgcaataatcaatcaaacctcaagttgaagacaagttgcgaaggagaagatatttggcttataccccaattgagctggctgtgggagtgggagccgggaagctttcgctagaccgtatttccgctacagttttctttttccttttggaaagtatgtatcgttattattttgatggattttgattattaaattgtcagttggggtaccttggctgatttctgggacgagggtttttatgcacaaattagttccagaaaattacttagtgaattcctgggctgtgacaccaccctactccctttccgacttcaccctcttt

SEQ ID NO: 102057 - DNA, 864 bp, Oryza sativa
agcttcgaggagagagatcgagctattcttctcaaactccggccgccgagctccatctttaattcctctttcaccggtgagccccaagtcgattccgtgaacacatagatttcctaggacctctttaacatgggagacatgcatgcatggcagttcttgtagtaagtcaagccgacgccgttcatccgagaaggagcgccgtcgccgagccgttccgaacgccgtcgtcggcgacaaagcttcgccaacctcgtacaatactactgtgagcaccctggagcttctagagttgcatgcatgcattttatccacctagatccggcctctaacgtgacatgcatcactaccccgagacccaccgccgctcgtgccgccgtcgccattgattccggtaaccacagatcaccataagacaatcattggattcgaaaagaacccctcttccttttctcttttggtttcatgccgagatcttccaccgttcgctgccggcaagctcgagaacgagctcagccatggctagctctgtttcagctcaaaccagggacctctgtggagaagaaacaaaactctaggtactacgttctaaaaactacctcacacatagaacagtcataggactgcggattgattgcctgaaaatccagggacctttttgcatattgatatctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagtaggatgaactttaatatggaaacataaaacttggc

SEQ ID NO: 102058 - DNA, 1261 bp, Oryza sativa
agatcgccagaagattgtttgcgccaacaacgtcttgcggacgcacaggcgaaacgtgggagcctgccccacacttcggccgagtcggactgggggtatagccgtgtgacccgtcatcctcgtcagacctggtgtaacatacccgaattctaggtcttaaaaatttcttgtcaaaatagttagaaactaacttttccaatgttgagagacaaaaattttccctttaacctaggtgaggtcaacttaacttgtacttagataaaatttgaggacaaactaaaaacttttcattttcagcctaggacaaaaatgcaaacaaaaatgtgtgcatgcatatgcatttagcattagtttgatttgagtcttttatgcgcgtttggattttggtttgcatatcatgttaggttcatgaacataaataaaaggataacttcactagacaaacccatggtcattattgtgaaataattataagtacatgaaagtgaagtcaaataataacaactcagttcaagtcaagtcctaatataagtctttacaaacatttagatgcatttatataatgagaacacttatataaataaacgtcttgcgaattattgaaaataattcgtgcaaggtaaaatcatggaaaaattcatgtagtctgtaatcaacacgtacaattcactgtaattttggtcaaattttaatacttaggatgatacctcaaataaatcagtcaaaccaattaaatgatagactaattataatccttaatcggctaaaacctactctcaccataatgtgcatgaaactgcatagaagtgtataggggaaacaatttattcaaatactaggttatttataatgaataaatatattttttcagaatttatatactctatttaaatctcctaaaaattcaaacaaagttctaacgagcccattttctccaattttctgagggcaaaccacataaaatttttgagagcaactacagaaaatggaaactaggtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccccctgagtacatgatgccctatgttaggtactctaacgatttctccctcaaatttactggacaattg

SEQ ID NO: 102059 - DNA, 1262 bp, Oryza sativa
cagattgggcaggatcacgatcagacaataacaagtccagcagcaaagtcattcgggaagacgtcaaagcatgtcaagggggataaattggttctcttgggaagcataacttatagttaaagtggttgacccttgcatcgaatagcagaagtacctagcaccggagaccaggaaagctaatatgagatagttaatggcaagttgtcaatcatggtatccttagtaagcgggatatcatagtctaaagcatatggtggtaagctggaaggaaacgccaagcatggtattctcatgatgacaagcatggtatcctagtaatgacaagctagtgttgacgcatgagatgaagtggtaacttgtatgaggttgactccgaagatatgaatcatgagaagttctggaacggaagcatcattaaactaccgcaacctagtctgagtcagctaaaaggtgcaccctggttcaagtcaggagaagagaagattccatccgcaacaggagatcgagccaagcagtccagagtggagaagttttgctaggcaagttcgttatagaagacgcgacggaagaagtcagacaagaggagaagaccgcccaacctatcttcatgctagcctcctcgaatctcggggacgagattcttgtaaggggggtggatttgtcacgtcctgataaattcaacccgaaataaaaatcattttccaaaaggaataatagaattaattaaaattcggaaagaaattggcaaacactaaaatacgtacaagaaaaattcaaatgtggcccggagaatttttattaaattctccttggtctaaaaggagccctcaaattttagtggaattttcagagcacaaataataattgagaagaaataaacaaagttaaaaaggttttataaaaagaaaatctctaaaagtcttcttttcccccttttcccctcttgggccggctcggaccaactccctccctctctctcctctcctccgcggcccatcggcctcctcccgcgcgcgcgccgctgacaggcgggcccgcccgccaccctcgctgacgggtggggcccacctgtcatcgccttcctcgcgccgcgcccgtcgcccgcccgtgccctagcgccgccgccgccaccgaatccgccgcatcccgccgttcccgcgcgccataatgagggggaaatcactccccgtgattccctcccccttttcccccgctttcccctctctctctccctcggattcgctcggaatctttcccctaaa

SEQ ID NO: 102060 - DNA, 542 bp, Oryza sativa
ccatcggcaattaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattagagaataccacctgttagagataagccgaaagatgattgataaaagagattggcaaagatgttctctagcatgaaagaagtaggccgaaaggtgattgataaacagaaacatgctctgcatcgctcaaggaagccccctgatagtaattgcccccccccccacaacagtcaccttgtcattaaataagcaagatgacctaggtaaaagtgtttctatgaaggcaaggagtgaaatcttcaactcggtatcagatgctacacggagtgaaaagtgcaagccccggttaccaggcaacgccatgtcttgggagatgatccaatgggaaagaacacatcaaggctgaaggtgcacaggaatacgttgaatgctaaatgatgaca

SEQ ID NO: 102061 - DNA, 516 bp, Oryza sativa
cagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtcaattactttgttacagtttcatggcggtggtgttccaatattattgtcgatgcgatagacacgaacaccacaacacggggccggcttaggccttgtttagttggggaaaaaatttaggtaagttgtcacatcggatatacggacacacatttga

SEQ ID NO: 102062 - DNA, 663 bp, Oryza sativa
acgagttgccttgaagctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtggctcgaggcgaatcgagaaaaatacccgcgaaaatggcctattagtcaactagacatacgcgttatctgtcctaatgtcagggcatgtcctaagtgtgtgtgtcctgtcatgctattatcaccgacaaagaatatatgcacaaatataatactgattatctacattcctgagatgtaccaataagagctgacttttattactcccttcgcacaagattgttgcaacctaagattgtcctatgatgggtctagtctgattataccctacatcgcagcatgttatgacgaacgacgaatcattattttgtggcagtgctgcgtgaacaaatctaacgtatacacgaatgaaatttgtgcctgtctctagccgttgccatgcagcaatgcattgtttaaggaaagtcgcgttatatattc

SEQ ID NO: 102063 - DNA, 522 bp, Oryza sativa
gtttataataattaaaactcaatcaattatactttaataccacctcgttttacgtaaaaaacttaatcttcatcttcatgtttttggagaaaagaacaccactgctgctctgctacatcttcattctttgaccggttcaagggaaccgaccatgccatcggctccttccaactcctcttgatggacgacgccttcgacctcatcttcgtcgacaacagcacaggatccctggcaccctcttcccgtcacagatcgtccaggaagtcgagaaagcaattcgtaggctgagttcgattgtgagggtacagagcgatggttagtacatgatttattagtgtagctaaaatgaatttgaaagagtaaaaccagcggttcttaaacttgccgtgaggtttcagttaggtccataaatttataaaacgcacattgagatctctaaacttggtttattgtatcaacccgatccaaagtcttgcttggctgtggtcttacgtggcacgccacgtggataatgacataaaa

SEQ ID NO: 102064 - DNA, 578 bp, Oryza sativa
ttcctgcagcccataaatgcgatatataatattatgactcattttatatttaaaggaactttaagcgcatcttctacttgtttatatttgaattatacattttaattacgatgaatggataaaagtacatagactcaagtagtgcgtatatacaaagaacggagcaatactgagtgtgtagagcgctgacacacccatgcatattagactatgtattataaacactatgagactctctcataacaatctcaagccatcactcggcaatctagtaaatgtaaagaaaaacatatatacaaactctgagaaaaaaacaaaacatatacccatcgatacagacttaaatttatggctctaatattatctactatattagattacatacgttagaaaaagaccggaccaaactgcttccttacatagtctcatatgtccttatgacaagcacgaactaatgtccaaagattgacctacctctatgttcacgtaatctgtaatgctattatcagcgcatcgatttatacttacatatgtattacagcatatgatctatctttagtagcactacaaagactaga

SEQ ID NO: 102065 - DNA, 576 bp, Oryza sativa
gcaccatttacagcttgaaaagtacacacattcctccaccataccattctaatcatccctttggatattcattctcacagctggagcatgccacaccaatatattctccaatgcctgctactgctagatgaacaaatgaggaactgaatagataaactagaactcactgtcacaaacgtggagaactctgtctatttaacacagacaagcagtggagcctggaatgatattgctaacatgaacaggcgaagcatcacatagagtggtacacgcatggtattcattagagaccgcgagcgcgatatgatcagaagtatgcttggtgaggatgattctctaccacgctgcaagagccacatacgttattctgccatcagtatatatcgcattccagactctggtaagactacactgttactagacgtttgcgagtctgaaacggagcataaagatagatcctatgacacactcatgctgaatcatgcttatgagacttacagactgctagatatatcacgtgatatgctctaggagatcacgcagagtcggcattctgaaccagtgactgcagaggtt

SEQ ID NO: 102066 - DNA, 610 bp, Oryza sativa
tacgagatgcatattttgttttcctcgaatctcccaagagtattacatactgatagcaaacataaaattctctcaccaacatgttctatatataatacactagctagtagagcaagattgttgtgtaagagaagctagtagagcaagattgttgtgtaagaggtttcgatttagacatcaaattaagtagcatctctccatcatgcaattctgtcacggtaagttttgcgccttgagaacaagtttcctaacattgtaatcgtgtgtttgtgtatcacgcgagctggtcgcaaaggttgatttgcatgcgtattcagaaaagattcaaaataagaaaagaaaacagtgcaaaacagggatgatatagctgaaatcacattcaggatctgcatcgattttgtctcttccatttactctgaacagaactgcaacgaatatcaaaattttcttctcttcctcttttattacttccttcggagagaacacaaaaaaaagggttaattaaatggagaattggtttgcaaatctcgtttcgacccaatgcaactcataatgagccgtacgactacaggcccaaccagatcagccggactttcatgcggcctctgtg

SEQ ID NO: 102067 - DNA, 650 bp, Oryza sativa
atatatagctaggagtgatgtactctcacattgttcacatgcttgtgtttgtaatgggcagaggcattgttatcgctgtagtgattgcgatgtgttttctacataaaaattggatgaccacatcagtgggctaagggggatggatgtaacaatggataggaaaattgccttattgaatcaaaggaaaggaagtcttcgaagctatcgaatctcgggaaattggtcgtccatattaaatttatgacattcgtatttctacatagtttatagatctagttgataaacatagagtgttcattgggcttttctatccgacttgtcaaactttttttttccagatagaaattacttttcaaactttattccacttagggtgaatataaatatatgctgattaaatcattcaaaatgtgctgacatttgatgatcatcaccactataaccccccacaaaaaaaaactagaaatgagtttatatttgcaacaatcagggcagtcgaattaatttcgtgtatctaatagtctccacaaattaaaggactaaaattcttgaagaaaaaaatatgtatgaagctcaacaatgaattttgtagtgcaaattaagcaggtcaattaggtggtactgtgatggttcacagggctgcaggaatt

SEQ ID NO: 102068 - DNA, 613 bp, Oryza sativa
atgtttacagaaatagtgctagtacgagatcgagaagcatctaaatttttgaaacatttttatgaaaatgaaacaaatttgactgaccaaataatcagaaattgatccactagcttgtaccctctagtgctgaaattgtaaaccaagagtgcagaataagatcaatgtgtgcaattaattgatgccaagtgctctgcacatgaatgattctgaagttgatgcattggctacatacatatttgcagtctggctacatgcagggtcaagagacacacagaaattaaaaccacatatatatatatatatatatatatatatatataattcagtttaatttctcatgggtcaatcgtcaaagagaaacgaagcacgtaatttgcacgcctatttttgccggcgcacgaggggaaacgatgagcagattaacttgttccaaacgaactctcataaattgttcttcttcgccctttctctaataaaataacaacaaaattgctcatctcgccaaaacgaaaacagttttgttcaaatcctcaagcgctgattcccgatcagacggctagtagttggctgagattctttttaaaaaaatttcttatagcatatggaagaa

SEQ ID NO: 102069 - DNA, 652 bp, Oryza sativa
gacagttatatgtccgaccaacattttactgatgtactaggcgtgctacaaagagttgtggctgatcatgtagttaattgatggcttaatatttggctttaatatgaaggagaaatggaacaataattcttcgtccgaaacatatatcaaatgaaatttgctgagcagagattaaatcaatacttacatggcatgttttactgcattattatcatacttcttccttttctaatttttatattagaagtcgtttgattttttttcttagtcaagctataagtttatagaaaaatatactaataattttaataaaaagtatattattaaaatattcaacattaacttaataaaactaatttggtgctgtaaatattattaaattttttaataaatttaatcaaatctaaaaatttgaataagaaaaaaaatcaaatgatttataatataaaacagagagtacttaattattcttttttacaggaaacacagcaggagatactcctaccgtgatgcattgcaaaagacagagagtgtttacgagagactgtagggtacttaattatgtccaacagccacctaccaacacgaggggggttaaatcactgacgcatacgcaacgtactgtttgcatttcttagagggctgcaggaat

SEQ ID NO: 102070 - DNA, 638 bp, Oryza sativa
tatccctagggtcttacttgagtctaatccatggtctgtctagcatcgccgtcttctccatgtgttgccgccggttcaccgtctgcatctatctccgatcgctttggttcggtgagacttctatccgcgtcccctcgggttagcggtcaatccctcaggccatgcatgccgccgctgctgctctaaccgtagcgcagccgctgccgcgtcacttgccggctgccctgtgcaccgtcactaccggttgtgccgttgttgcttgatgccgacgttgtgctagccgactagccaaaccaagtcgccctagtgccgccatgtggcagctgagtgccgctttaacctaaccgactgtctagccgatgctcggtagccaagttgtctagccagaggtgtatccctaaattcctaccggtctatcgttagtcgtaccggggctctaccgcgactcgtttatagccgaccggtttagttgcagccgtggctgtatcggtcgctcgctcgttcgaataaggtgattcccgagcttcgacagttcgtacgtgttgagtgcttctttagagcacagccgccggcttcgatcgccggcttaggttgatcattcgagtgatcccgtgtagcgaacaatcgactcgttgagt

SEQ ID NO: 102071 - DNA, 1414 bp, Oryza sativa
cagggcagtcgaattaatttcgtgtatctaatagtctccacaaattaaaggactaaaattcttgaagaaaaaaatatgtatgaagctcaacaatgaattttgtagtgcaaattaagcaggtcaattaggtggtactgtgatggttcacatgggcaggttgatactaactcccatcgccctataatctttctgttgtacatattattgttacgaatttcgttccataatggttggaaaaatgacacatgcttccatggccacgctactaatccttctgcaattaaaccagcagggtacacatggtgtgataatctcaattaaagctagtggttcgtacagaacatgcttgcatgttgctgcagtagctagctagtgagaagaaacgtgtgcttataaggaacctgattgatatttgattatttactgttgattgagatttatttatccatgtgaaataataaaggcatgcaggttcattagtccgatgtatacaactgtgatgttttgattagtggaggaactactgtagctagctagctatgaaaggattgtcgacaaaaccaaaaagtggtatggacaaaggatttaatcaaaatcatatgtacactacgagatgttaatacggagaagactgtaaaattatccattcatccattttcgccactgcctgtcaatctacagcttaagtttgcacaattatccccattaaaaaatgtttatttcatatgtcaatattaattccagcacctgaaaattgtgactgaaccaggaataagatgttttgttctcttccgttaaacagtttcattgaatattctttatattttgtttatcatcgaccaatcgttgccgatcgacttcagttaaatagttctctcaaatcattaaatggcaatattccctatattttcttcgttattatcgactaatatgtttgaatagctctattgaaatggttaaatcctcatattctctatcatttcctttatcatcaatcaattggtgccgatcgacttcagttaaatagtcctctcaaaacattaaattgcaatactctctatattgtgttcgttattatagatcaatcagtgccgatttttatgacatcatcaatcagtgctaactcattatgacatcatcaccattaattgatcggcagagctcgatccttacctttgtccttagaaagaaaagtatggcgccgcccgtggcgacacaaagttgagttggactacatcatgctacattaacacgtgccacagaagatcctgatgatgccctctttgagcaagagagacccctctctgcatctatctatctatctcacatactcacacactgatcacaaagcaaagcaaaagcctagtcgttcatactcttcccgttcagttcttctcctcccaaatctttctgc

SEQ ID NO: 102072 - DNA, 1047 bp, Oryza sativa
tattttgctgtgaaactgcatatgtagaagtccagatacactggaagacgtgacgtcgttgtctacttggcataccggccgcctgtctgtccttgtcgatttcactgccattttgcgcgtgaaatacgcattccaattgtctgtgtaaaatacggcaagctgagtctttttctctgttcctgtatcaggagaacgcactcgaatttgttgccacgcagaagaatcatatcacttcatctctataatgtttttcttatggcaagttgcatttgtgcatgagcttagaggaagaaattgacagcctcattgatcttttcgtttatacttatgtttattaactaaaatttaaatttttaacgccttgaatttgaagttgattttgagttttttatccatcgtagtttatttttcagcttttgcttttagatcgttaataacatgtatataaaaattttattcacaaattatttttcatttgtaaatatgtcatttcgcttttttccttcaatatgccaaacgataaggctgtgagttcctttctgcacttgataattacatggaaattaatttgagtcatgtagttattttacacacagggatggaagtaatgccacatgccttgaattttccatggcttctttaatttgcaactcaaaaccttcaagaaaccgtccatactttgtatttttgcggagaaaaaacgtccatacttgttgatgaagaacttttcaattagacggtttagattactacaatcgtatgtgcgtgcgccttttttcgattcgatccacacgccactttaacacgaggatagcaactcatccctttatccatacatcaaattccattgctgagagcatccatgtaaaatcgtggtcactgttgatgatcatgtcaccaaggacatatcagccatcagcaagccatctaagctcagtggcgtgtgatcccaactttgaggataaatggcacaactcaagcctagcttttgctccatcatgctgatgtccattttggaatgccaatcttggcaactgagggcaaggg

SEQ ID NO: 102073 - DNA, 837 bp, Oryza sativa
cgtcatcgggatgagttaatatgcttcatatggactgccagacatggattgagtcctgagaaggcaattgtatctattaattaggatattttacgtaatttccttggagataagtctgggcaaaagtctgccccaaagacttatggtatcttagagtttgttagagataagagtcgtgtccgagaaggacatgttttgtaatctcgggtataaatagatctcgagccccatgtgtcacgcccggaatttctatccaaaattccaaacgcttacatgtgtgtgaaccctcgtctaggaatcagccgaggcacacaataacaaattgataatagagtacaattattactctaattaataagcgtataaaatgtcattacagaggtagatagttcctctcaatcaataaagatcttaagcagcggaaaataagataaacggcgcagacgactccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaacatttgagaattttaataaaacagttaagtaataattaaacaatattaaaccaacgctatacaacataccctgttgcataggcccaaccattctgaacaaccatacccggctgtacagatcaatctccaaaccaggaatataccattccaaaccaggagctaatcaaattattaccaattatagcatctt

SEQ ID NO: 102074 - DNA, 2015 bp, Oryza sativa
tgagctagtgtgttcatgcctatcgatcgtaggaatggcacatgaaactttgaagtgaaaattgtttcctttttctcttagagatgaagtgaagcaatggtacactatgtctgtcaagaaattccacggtcaatgggaggagctaaagtgcaaattttgccttgctttctttccattaactcgtataattaatcttcgattagacatcatttctttccgatagaacaagaaggaatctctcagtgcagcctgggccaggttgtcattgttaacttagtctagcccagacttgtctttgcctgaccatttgttgttacaacattttcagtatggattagacaaggagtctgttgcaaatctcgatatttccgctggaggatcgttcgcacacaagacaactgcagaacaaagagaactcttagatctcatcttagagaacgattctttctgccgaagcgaagccatccgggaggtctagattatctgtgagaaacctctgcacgtggagtcgaaacccgactcaactgccgaatcctcattctaggtgctggagccggaggaagaaaaaaattcatcctccagaaattccattccaattcagggataatcgttatgaagataatggaaacaccctgaattatttcaacaaaaagaagcctcatcccaagtatgagccgttcgagcaggcgatgtttgttttttcattcatttcttccgaatctattgtccatcttcatgaaactgaacgactctcatcatcgtcgatcaagcgtaagccttgtccttctagcctacagaacattgttcttgtttatcatcaagaaacaactatgttcttgcatgatgcatctcttgaggaggaggatcttcaggcccacagacaagcttgatgcctgcatcgactctagaggatgagagaaaacattccacaaatgaacatgaaagtttttctttcaaaattccccaggattcattctcacataaggaattcctagagtcctgtctgattagtgacgtttctctgtgcgaggaccacaaccaccttacggtcctcatttctaacatgtttagaagtgtggttctggatgcttatatttatcataaatactacaaatcttgtatttgtttgtggcactaatcttgcagcatgatgtccctatggtcgagcttgagaccataatcaaagcactgccaggagatagtccagattactacggtaagtttcttttctaataaaagcaagaacctatgtttaggattgtatacatcttcgggtattcttggtcgctaagcatttcaggttgagattaagaatgagggtcagacgatgcctaagtacacggttagctacatcaactttacactttggcgatcctcggtatgggaacactctataggagactccgacatcacacacttggtttttgatgtcttgcgacacaaaagtccaagtgtggggggaaaggccgacgagcttgtgatgacgagttccatcaatcaaggccatcttggtttaaagttggtgttagtcccaccttactaaaaaaagagataaaaaaagataaaaagaggagaaaagagagacgaaaaaaaagaaaaaaaagatgggagaagaggaagagagcaagagagctgacatgctgtgtaatgccctagaaaaaaaaagaatagcgtatagtatatattggaattccctacatttttttttggtgtttgcaattagaagaaaaacaatagttatacgctagttgggctagctttcggccagcccaaggcccagctgccccctccacacccccaagaccctaggaggtcccccccacctccccctagccgtcatttggtaccctggggcgcccacctccccctctggtcgacctcccccatgcctgccctactgcagacctgggaagaagaagaagggaaggagaagaaagggagagaaggaagcggacggaatcgaggtgaagaaggaaatgaggggtttgattgccgcttcccaaggaggcctaggt

SEQ ID NO: 102075 - DNA, 888 bp, Oryza sativa
aaatatatttatctggtattttagagcaacttccatataaaaagttttctcatgaaacccaccgttaagcagtttgaaaaacttgctactatgtgtctttgtatgtgtctttgtgtggacaaagagaagtactttagcccctgtgtacttgtgaccatacacatgcactttttagcacatgtactttgcacgagattaagacttaaaattttatctatgcacaagtactgtagcaataccgttactactgcatgctttacgttactataatttcctcggtatgttgctgccgaaagtgtagtaccaacccataagttttgcatgttatgagtttcgcaataaaataactgaattgttctatagcggaagagaagaaattataaatcggtcaccatattcctttcccactaagtttaaaattctgttttgcatgtagcccgctaatcatgaagttggaaaaaccatttcccaattacgtgacttggttaattgcattaaccaaacaatttaataaactgacaaactatgttctaaatttatttagttggatgaccgggtctgcatgctaaccggtcattgtatcgtgattacctacgctttactgcaggaattactaaacaatttttaatatatttttttcgagaatcaagctattagtaaaaagaaaaaaaaacaaaacatcaggatttatcagcacttattataaaacaaataaatgatacttacgctttaatataaagcatattgataagtatatgttaaatatcataaaaataaaaatgatagatagatttgtgaaaatattgtgcaaataatgtgaggggtgatgattggatatacttacatatcgatttgtagaattaaataaggacaattgcatctacgatt

SEQ ID NO: 102076 - DNA, 752 bp, Oryza sativa
aacggggcagggacattcgctgctgcagcggctgcatcttcttgggcccatattgcctacttgccgatgtaccatgcagtgcctagccgatgcgggtgctcattccgctgttgcagtaggcgatgtgcctcgcttgattccctaaactcttgggtgttcttgagagagcagaattcctcccacaccgcttcggttatttgagggtattcatcgaatggcgtatgattgccgggcgggttgacaaactcggtgaagagcttcgacttccaattcttccaacctttgcccatcttatggaatgccttccacttgagataatctatgtgtaaaaaaatgaatatggggcacaggggtagcagcagcaacagtaattcatcaaaaaagaacaagtgtacataaaaaaaagaacaagtgtagataatctgttcttatgcattaaaaaaagaacaagtttagaggtatttctgttctcgagcattcatcactggccatttaacataaggcaaccataggcagcagcatgagcaaacatagacagcaaggcatccaaaaaaaagcaaacatagacagcaaggcatctgaggtatttctaaaacagcagcagcaagggtatataaatcatgtatataaacaacaattcatgcaattcacctattcatagacaacaagggtatataaagaacaatttatgcaattcacctattcatagacagcgagggtatataaagaacaatttatgcaattcacctatt

SEQ ID NO: 102077 - DNA, 653 bp, Oryza sativa
actagtaaggacaatttatattcatctaataagtttctgactttcacccatttatatcatactctacaatctgtttacctgcaggctacaagcctacaccctatgggagaaagggagtgtgggactatgagggaaagggagctgccaggctatttgtgtttgtgtttatgtgcaattgtgttggatgaaaatgatgaaccttgcaggctgcagctttactagttacgcacttatgctaaatattggtgtattgaactattgaacttgaagtatggattattgtacatttgtactggactaaacctatgtttaattacaatcttttgttgaactatttcaaagttaattgcgagtttggactgtgtgcatgtggctgcctatgtcttgtaacttgtgagtgtggactgtggactatgaatatgtgataatgtgatgtcaatatgtgatgaactgatgatgtatgtcagtaactcagtatgtgttattgcgactgtggtttatgtacttgtgaaatgtgtttaatcctagacttttggtagattacttatatgtgaatgtgatttgttgctttgatattttcatgtaacaatttatcatactatcattatgcatgcttgatgttggttgttcctgagagctaggggcaataatgg

SEQ ID NO: 102078 - DNA, 645 bp, Oryza sativa
aattgccagcatatattatatcattataagtcactctataaacatatatagctaaactaaatcaatagtaaccaaacaaatcatagaagcatgtaatacattacattccaatataatgatgcatgcacagttagatatatttagttgtacgattgtgtttacgatcggtgcgtgaagccccgcatactctacatgatacattcatagatgtgtttcacagcacggaatcttattgaagaaatccataccatccaattcatgtgtttattgttaataaagaatgaggacccacatcagtcttaactacttaatatatcaccaagggtgattgaaattttctcaaagttgagatgaaaggtgtaatgctctatcattattcataatatcacaaattttgaacttatatttgcagttgtattaaataaaatagaaaaatattattagagagtaaatctaaccaattggagaaaaaagttagaaaattttgcttcttacatttcacttagattgaaaaggctactgccataacaattgcgttagataattgaaacaactaactaataggttagaaattttacctaagcaatgctgagaagaaaatttatggagaaattatacttttgaagcatgccagatattctttga

SEQ ID NO: 102079 - DNA, 806 bp, Oryza sativa
tgcattttagagcattttggatttttacctatttccgtgcataaacggtgaagaagtgaattaggtgctaacatttcccaggaacaaggcaagttttctcctcccaatctttgatcacattgaatcccatgttttgaggaatgaaaatatttgtttgcaaagttgcatatgaatttagactataacggtatttgaaacttggttatggtagctatgacctaattgctgcatttacttccttgaataattgtgatcctcactgattgtaaccttagaaatggttagagtactttcaaagtgcttaaatgggtttatacatgcttacttaatagccatacgcttagccatgcctagtagttgctaaataacttcatgatcactttttaaatgagaatttggggaatattttcactgctggatagaggtgaatatctctgatatttgtgagctaaaatgtgtaaaaatgtgatgttagacctgggcggcaagtggtatgcatatggtgttagttgcataccgatagggggagtgctcgccctagtcaattaaggaccgaactttgtgtcaccatctaaagtataccgtgcaaccacatgtgctaggaatgggacggcattagcttattaaattgtttaatgtctaaccttgcattgggaggcggtagtagtatgaactagtcggaatgatggtttataggagctacctagtgcggttgtgcctaggcgtctaagcgtgtccaatataacggttaagtgcctcgtggaagaacggatgtgttcgctgccatggcgctagggatggcgagg

SEQ ID NO: 102080 - DNA, 823 bp, Oryza sativa
cggcgacgggatggcgacggcgacggcccggcaaaggtggcgcgcggcacaggcggcgatgggatgcacgcgcagcgcggggcgggacgcgacggcgacggcgcggccgcggcgatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaatt

SEQ ID NO: 102081 - DNA, 597 bp, Oryza sativa
cttctgtgtgttttaatcaaattaatgattgtatagaaaccacaaagaagctggcaccatcaagaagcttgtagagaaagtactactacgtgtgtgaattaattagtgcatttaatttgttaggtatgctcgaccattgttgcaatttgcttgttttaaaaaaaatctatgtatattttcttagggcatattcaaagatagagtctgatatagtcttttagtttatttgtagactatgattttataaccattgagataacaaaggctataataattagtgaactaagataagtttttattatctttcttttctcttccccaagcaaagtttctttttataaatgctaagaattgatgttaagtcattgttaagcttagagcaagtttaatagtatagccagctactagctccaaatcatctatagtcaatttaatagttaattcatacaatagttacctatgaatatatatactatattattaatacctggtcccacctgtcatacaaacattgccatcttgaagttagtgctacagctggctataaatctgtagtctgctgctcacctctctcctcatttatctcctcgaaatatg

SEQ ID NO: 102082 - DNA, 544 bp, Oryza sativa
agttatctagactgagttgaaggtaatttccaatctattgcttcaggcaccgacccctgctggtctgccagcgtggttctggctatagctctatgatgtatctgaatgtggaagattactaggacgcgattcagggctgtcaccacctgtcgcctacctctgacaaatccatgggatacacaacaaacaaaggtaatatctaaactagacaccacgtctaagttataataaaataaagtccactattgcttggtttactaacctcttgcagagaatgagcaataaatggagaagaatcggcatcaaaaccatcgatcaatcaatcggacgatgccgagaaatagacttatagaaagatgggccatgaaaccataattgacacgatcaaattggaccaaaattcataagtctgggtgaaggagagcaagaggaggccactgaccgagtttgggctgggttcggcagaaccaaccgaagcaccattggatccaggttttggatagacggtgtggatggcttccctatggcggttggaggatattac

SEQ ID NO: 102083 - DNA, 995 bp, Oryza sativa
gcaggtcgactctagaggatccccctcttcatcgggaacgaccaccgacatatcgatggaagacaccgacataccgacaagccttttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtaccaaccgtactcagcaagccatcatagcaatgatgcacatgacagaggaattcaaaggatg

SEQ ID NO: 102084 - DNA, 2227 bp, Oryza sativa
cccctctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatatagggcacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcataaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaagaatttccaaaaataatctatgattaaccccgaccatttttatttcctaaatcctcctaatttctcccccaatttcccttctattttctccttttcttcttttctattttcccaatttttctctcctctttttcttttactctcttttctctccctctctttctttttctctcttttctctccctctctttctttttccctgccggcctctcttttctttttcttttctttttttttccttctcttctctcctcccggctcctttctttcttcccttctcttcctctatcctctttcggctccttctcctcctctctctcgtcctgccttccgcgcccggctgaggaaaggaaaaaggcggcggcggcatggcttaccggcggcaacggcaatggcggcggcgcacggtggctgcgacggcggcggcgctcggcgactgcgacggcggcggggaacgcggctcggcccaggcgcggcgcggcagctctatgcgacgactcggcgg

SEQ ID NO: 102085 - DNA, 814 bp, Oryza sativa
agaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaag

SEQ ID NO: 102086 - DNA, 1484 bp, Oryza sativa
tcggtcgtccatcccatgatgaggacaggcggccgcatactcctgcagacgttcctacgcttccggaatagactcgtccctcgtttgctggaaacttgaaattcgtccacgaagggcgttggttttgctcattggaagaatttcgaaaggaatgccgtagagcatttgtcccaggtgttgacagcagcacggttggcatagaatcactgcttcgctctcccgagaagggagaacggaaacagccttagcctgacggcgtcgggactgacgcccttgatggtgtacgtgctacaaatctccaggaactgttgcagatgagcattggcatcctcattaggcttgccacagaacgggctagcctgcgccatcgtgatgaggctagacttcaagtccacgtctcccatgttgatccgcggcccaatggccacattgtcagcagagggagcagtgaactcgcggtgagtcttgctagccatagtcttgaagattggtggcactgatacggctggtttatctgtcggtagagttttctgcggagcaacgactcgcggtcggacgctccggaagaaagcttctggattttctttgaagttttccggcaggttgaaaccagtcatgcactaccctgtttccacaacaaaagtgaaaacaaccaaggttagcctgcaaaggaaaatgattatatagaggcaaatataaaatattagttcaagtaatctctattatgaatcttccccggcacgggcgccaaaaatgcttgttggtatttcttaacgatattactacaaatataattcccagcaatggcacataaatagttctggtatattatggttacagagttcatccataagtgcacagatataccattgtagcatttcacccgagagtattccaagggtatcgtatttattttattccgtgggaagatcatgtagagagaactagactaataatttatacattgcttgtgataatcatattctaagtaggggttaagataattcaagggtagagtgacacacaagcattaatactcaatctcataatatattatctaagctaggtgggaagaaaagagaaagataatctattcctatacttctaatatacatagtatacatacatcctagttaaccgatatactagctaataccctctttccaatgccctcccgtgttgatgtagaaacacgaggcctgggagatctgcttaactccagtgcaggtccaaaaagcttgcctttaggttcgcaggcgtgccagttgatttgatactgcaatcaacaagaaataaagacaaagaaaacgcagttaaaccgtaaatgatagccgatctgccagccgccgatgacgtatcatttatctttgagccgatgtcatctttgcatctttgcatcgatccgcagtcatgaataaataaggaaggactaaatctattcgatcggctgtaattattaacaatatataatctttatgtcgata

SEQ ID NO: 102087 - DNA, 637 bp, Oryza sativa
tcatttatctttgagccgatgtcatctttgcatttttgcatcgatccgcagtcatgaataaataaggaaggactaaatctattcgatcggctgtaattattaacaatatataatctttatgtcgatatatacataaatcaagtgattgggatagatcggtcgccatgccgagatagtataaatcacttagatcgaaatatatattaacaacgaaattatatatgttcatagcatagccgatcagatagatatagcgtgtatcggctaatactccgataccactctatattaagacattaaagcgagtaaaatatatcaaacaagaagcttaacatatctaaaaagcaataagatctcaacataaagggcagatctagcatatcaattaagcacatgaaatataaggctaaaccaggtaagatcagctgaaaccccgatgctactctaatcaacaaccaagaagcaggctagaaaccatagttctaaacacgacttatgaggtcaaacacaactgatgcagccataagtatgaaaagaaagacaatatctagacaatcaagctattggaagcttcatagagtggtagatatcctatataatctaagccaacgtcgatatgtaacataatcggctgctc

SEQ ID NO: 102088 - DNA, 616 bp, Oryza sativa
gtcgtcgtcgccaatggagtgccagctgaagaagtacctggtgctgctggccaccctggtggcgacggtgacctacgcggcggggctgaacccgccgggtggctcgtggctggaggacgccggcggcggcggccggtggcagctggccggcgacgccatcctacaggacaccaactactggcgctacatcgtcttctactggttcaacgccatctccttcgcggcgtcgctggtggtggtcagcctcctcttcctcctcctgcacaagggccggccaccaccagcaccaggggaccaagctgctcacgctcacccgggcggtgatggtggtcgacctgctcgccctcatgggcgcctacgccgccgggaccagccatgacaagttcaccaccatcggcgccgccgcgctcgtctccgccaccgccgcctatgtcatcgtcttcatcgtcccaaccctcacggcgaaaacgacaccgccgccgccgtcgggatcctgatgttgatcgccatcttcgtggcgaccgacgcctatgtagctgggctcaacccacccggcggcttctggcggagcaccgaggccgccggcgacccggtgctgccgggcctccatccaatc

SEQ ID NO: 102089 - DNA, 577 bp, Oryza sativa
atatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgtggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatgggaattacaagaacgacctcgcgatactttggaaacgtatagtcctgctgtgagaaagcttcagtcgt

SEQ ID NO: 102090 - DNA, 782 bp, Oryza sativa
atatccatttaaagaacatataaacttcaaatgggcataacttggccatttgaactcggaattggaccgttcaagtctctaatttttccttaagaagtcaagaacccatttttgtgctttgtttctgcttattatgtggaatttattagcgtaaaagccttttcttttccgttggtcgtgtagacgctgcagctttggaagatccgctctttgtggaagttgaagccggcgtttgggaaagtgagcaaggcaagtcacatcatccttgaacatattgaatcccagtttataaaattattttgatttaaattattgcattatcgctttatttaaattcccgcgttatcacggttttactaagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaatattaggtggttttataactttagacttggggaattctcatatcacttggacactttggaattgttggtttattgtggaattggattcacaccgccccctctattcaaaatccccaaaatggttttaggctgggctcagggtgcatggttttgatagtagcacctcggccatataaggcccggtcttcgggcctctgttgcaaagcacaaccgtactttcaaatgtctagtgggtaagccttagtttgtggctcaggggatcctc

SEQ ID NO: 102091 - DNA, 666 bp, Oryza sativa
atccacatgtattccggtggatggactatatccaggttcgaaataaaactttatttattttgtactatcatactttgttagtatcttttttcatactacctccgtgccataatataagcacatctagcatttgaaatttgttccaaaatataagcacgtctagagtactaattcactcaccaaccaccctaatttatgaggggcatcatagtcttttctgcttaaccttagtctttgctagaaaacctagatttgcttatattttggaatggaagtagtagtttgttgctatatgttgtcaacatgaagtacatgtgcccttcattctggataaaataaccaaacgcatatagtttttttaccgtttctcttgacagtcccctatgttgctttctgtggtataccagcactgaggtgaatgcacataccatgttttttttccttgtttgttgcctggtcttattaccagtttgttcatactttataccttaataatcagacccatattaccattttattttacatcttatgtgagtacttactgattgacgcagaacatcgttgattttggcacaacagtacaaaaggttaacttgaccaaatctgtcttcgatccaccttctgtaagtaaagatcctttcccaatgtgggctagaagtattacat

SEQ ID NO: 102092 - DNA, 986 bp, Oryza sativa
agagaaaaagaaagagaggagagaaaaagagggaaaatagaaaagaagaaacggagaaaatagaagggaaattgggggagaaattaggaggatttaggaaataaaaatggtcggggttaatcatagattattttcggaaattcctcgagcgtaatagtatttcggtcgaaattccgagttaattataaaaatatgtttcttaaacagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactgaattaaattgtataatatttctaggatttcgtccgatatttagctcgtaatagaaatttctaacctattatatggatataatgctcgggaagagtaaattaaaaacttatgacaacaaaataattatacccgcaaaatagtttaatcgaaaattgggtttgccgtagttgacagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctttgggaaggtaattgagatg

SEQ ID NO: 102093 - DNA, 715 bp, Oryza sativa
gttagattatttaggctataatttttatggtttttgttgaataattaactttgcaattttactatttctggtgttacaatgttaaaattttattttcgggtgctcagaacggcttggctatgtgcagcattgagaagaatatcttagagagcattgatctccaaactttcattaatgatttcgcttcgagaaatgcgcgaagaaactctttttataagggatataggatatctgtggtctcctattaagctattcatactactttgtttctatggtgttatttttgttgtcaattataccatcgatattatttatcgagaataaattgctatatcaaactgcttgatttattgtttaccatgttagaaatatttatttgtgtcactatatggtatatgcgttttatagaactccttatgggcctatagtgtcaagttcgcctagggcctcccaaatctccggaccggccctaggcggaggagtcatttacggaggatgaaaccgtccgcgcaatgcgcgatctctgtggagatggtgatgggtgcattacgcgatgggtttgtggtccagtccgttggatattacgcgtgcctgtcatatacgtttgttgtgccagaaaacaagagcaccattactgatttttttaaggacttgtttagttggggaaaaattttaggtttggttatcacatcggatatacagacacacatttgaa

SEQ ID NO: 102094 - DNA, 655 bp, Oryza sativa
  unsure (1)..(655): unsure at all n locations
tgcacggaaagatttttcataaatatacccgtcccncggggtaaggacgagagactaaatgttagttcacaaaaaacacgggaccgacgatcacacggtatggtcacgcggtactgtagaattgtcgcgcgacaccgcggcggtcccccggctcaaaaacgcgccaccgtggtggccaacggtagcgcacggcaccgagacggtcccgtggctcaaaaacgtgacaccaacacggtcccgcaattccattgcacggaaccagctctgtgaacagtagcaaagtcggtgtctctattgtgctaaacagtgtcaaacagcattatatatgcccaccttacgcatgccacggccggtgccgcgcgaccatcccgcgagaccgttggttccgcgattttgcgttgcggcatacattcggtctcgtgttttcaccctgtgggatagatatatttatgcaaagtcttaccgtgcaagtatatacgtaaagttattaaaaataataagtatattcgcaattctttttcttaggctgctagctacccttcatcctcattcctgcaactgcctttccgcttgtcgtcgtgccaagttcctggattaaccggtttaaccctatatatgattaatggcaaataaagaagggttaattggatccatg

SEQ ID NO: 102095 - DNA, 1064 bp, Oryza sativa
ggattatgcaggtcgagatacgtcggtccatcaaagcaagcgacgaacaagtcagtactccctccgtcaagttacttttcatgcactaatctcacacgtaacaataatacgaaaccaataaaatactgcaatactactattttatcaaatcataatacaactatttctcactttatctacttctattattattattattatttacttttacaaactccgatacaataattatctttaaaaaaattatttaggataaatgagaggagcctaaaaatatggccccattcaaaacaaagaaaaaaacataggaattccaaaggattttatatcctatgggatataatcctgcgtgaccttttgaaacgaagtattgattcataccaatttatttggaattcctatggaatggattattgtagaggaattttggaggaaaattagcatgaggcactactacaaaaaggacatgtagagacatcccgtaagagacggttaagcaagtcgtccctattaaagcccatctcctacattgcctcttacgtagatacactaattagagacaggataatagaccgtctctacgatcacattaatctatttggtaaattttgaagttgactgagagaaaaaataaatcctagacatggccgtctctacatcacataaaaaccgtctctaggggctgcttctactgcagtgaggtcttacctcatattttcttcttcctatgtcttgaattcctatattttccttgtgtgactatatgcaaacggtagttttgaaactttcccgtgttttcgaatcccgtatatgaatctaatgaatatggcattctattcttatatttcttctattcccatgttttgataatcgtatatttgaaagggacggaggaagtagctagctagcttaattaatttggtcacgtgtagggtaatacacttccaagagaacatccacttcacaagagatctcctactttcgttggccctagctagcttagctggaaatgttagaccatatattgcggaggttttaggattatacgatgttgatgtaggagt

SEQ ID NO: 102096 - DNA, 779 bp, Oryza sativa
aaaaaagattttaagtaaaatataatttaaaaataactgaaacccgaaattaaaaataagcaatattgaaagaaagagtccatatcaaaatctaaaataaaattaattaaaattcaaaataaacattcgctgtgccgacttgtattaaacattccagaaggattatgcaggtcgagactcgagatacgtcggcccgtcaaagcgagcgacggacaagtcagtactccgtccgtcaagtttacttttcatgcactactctcacacgtgacaatacgaaaccaatacaagtctgaaataccactattttatcaaatcgtaatacaactattttttactttatcttcttctgatacaattattctttactttcacaaactccgataccataattattttaaaataaatttattttggataaatgagaggagcctaaaaatatggcgcgctttgaaacaaagaaaaaacatagtatttccaatggatttatatcctatggaaaataatactataagacccttggaaacaaaatattgattcttatcaattcaagattcctatggaattttggaggaaaattagtacgacgtcttacctcatatcttcttcttcatgtgtcttgaattcctcatttttcccgcgtaactatcaaatggtagttttgaaactttcatatgttttcaaatcccataggaatccaatgaacattacattttaaacctacattttttctatttctgtttttgacaatctagcgtttcaaaggaacggagaaagtagct

SEQ ID NO: 102097 - DNA, 1002 bp, Oryza sativa
ggggccaccccacatggattcggcaacagcgtcaggtgccggcaaccaggagctgtctttagcggctcgcccctcgcggatctggcaccgacgacgacggcggcgaccgggaacgggcggcgacggcccgttctcggccgcgtggatctagcaccgggggtctttctcgtgtggatctagtgctggtgacacaacagagggaggtgggaccatcggatccgatggcactaacgacgatggcggcgggcggcggatccgaatgacgatggtggcgggcctaggttcacccggtttctatttttatttttattttttctcgccgaatttatttttgtatgcagccggtataggaaaccgcgtgaaaaaaatggaattttggcatgcggttggccacatgaaaaaaaaaatattttcgcagaccttttggttggttgggatggccgtatgcaaagatcgcttttgaccgtttgtagaaatggtttatgtactactgatatattcatcacaaatttgtattgacagttatgaaaatttgttttacagttgtcacaaatattaaaattttgtttcctaactctgtggagttgtaaaacgtaacacgactggaaaacgaagctggcatggcacacgtgtgaaataattagtgtacgtaaagctcacgacgagtcgatcaagaattgaattgactttgactttagtactccctcccaaaatatagcaatctaaaaccggatggaacgtattctagtactacgaatctggacatgtctcatgtctaaatttatagtactaggatatgtctaatccggttctaggttgctatattctgagacggagggagtacagtacagtagtacgttactccaggtctgttgtcgtgtcttctaactgactttgacttgatttctaactgactttgacttgatttctcttagagaaacagtacgttccatctggggcttgaaaagtagagtgctttaatacaactaggtggcccccgca

SEQ ID NO: 102098 - DNA, 505 bp, Oryza sativa
tttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctcccttcttcctaggctgcgcttgctcactgggctaggctgcccgcagggggaggggggaaggggtggtaatcacgccctgtcagccttaaccctaggcggtcgcacaaccgacctaggcccagggctggacctaccttcgcccactcgttgacgccacccgcaaccaccacca

SEQ ID NO: 102099 - DNA, 940 bp, Oryza sativa
aagtgtgcttgcgggtggccggcagcttcaggcacatcgacgactgtcagaaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacccaaatcacatatgtcgagcaagttcatgaatataaggtcatatatggaccaacacaa

SEQ ID NO: 102100 - DNA, 882 bp, Oryza sativa
  unsure (1)..(882): unsure at all n locations
gctaagggtgttggcaagacacaagaaggaagaacgcgccgaatatcaggcaagaaagttggctagggcgcagcgtgcaaaggatgcggggtcggaagcggcaaggaagggcaagtacccttggtgcacccagtagtgcaatggaagttgttaccgaaatttcaattccttaagacatgtaatagtgatactttgagacgttatcgcgttgaactatacgcgtgtaataatgatacttaatagccttttgcgttgacagtgttgcgattcatcggaatctttactctaagacattgtattcggtttgaattccctaaggcttgtgatagtgaaactttagaacatttcccgttgaaatattccggtgattcataagagtatcctatttgacatagtggacaagatcttttaattagagatttttagtgctagctagtaatatcatgtctttgtgtatatagatagggtattgtcacgcccagaaattcccgaatagaattccaaccagaatgtgcattaaaacccctgtccaggacaggccagaccagggtacacaaacgacaatattgacatacagatccacgtcttacaaacaaaaagttntacataaatacatcggaaattaaagggatgacttgaactaagtcttacttggatagcagcgggcaacaccattccacaggcatgctcgacggcacggacgaagtctactcctccgagtagccaccatctgacgcatactcgaactctggggttgggagatagagcaagactgagtactacccactgtactcagcaagtcataccggaacggagggatgatgcagaatataaccaaagacccgggtccattgcgccaggaccgatgactagcatatctat

SEQ ID NO: 102101 - DNA, 539 bp, Oryza sativa
tttggaaaatctagcacgaactaaattgcagtcatgcatatctaagtttctaaacacaagcggtacacattgaacttatgttagcacaattattgttgtttcaagaggtcctacatgtcatgtttcgcttaacatagattagacccaatgaatccattagatttttaggtatatactacttttgttttttcaaatagataacactgttgactttttatcacacatttgaccattcagtttatctaaaaaatttacgtaattatatattttttttgttgtgagttgttttatcacttaaagtactttaagcataatttatattttatacatttgtataaaatttttgaataagatgaatggtcgaccatgtattcaaaagttaacagcatcatctatttaaaaaatggagagagtgagtatatgggcctgtttggcacagctccaactccagagctggagctcaaccaaacagtttcagctccaccaaaattgggagtggagttgggtggagttctctcacaaaatgtactagagttgtg

SEQ ID NO: 102102 - DNA, 695 bp, Oryza sativa
aattcctgcagccccaatatttggtaatttaaatagtgtttagtgtctatttggtttaaagccaaattggcatgagtaagaaaataagccatttcaatagtgaacttaggctattttggctttaatccaaacacaactttgccttaccaaaattagtcatgccaaaacttaacaaaatttggcattgacaaaatttgataaggtctatttaggccacaaaccaaaccaacccaacatatagatgtttggtttgctaccaatttatatccacgctgctaaaagtactatactatcaatttgttagtgtcaaaaattaccaagattttagcgctaccaaaatattgattgggcaaaattggtaacaatccaaacaaacccgtctgcaacttgcgtagagtgtatatggagtactgttatacttgtgcaacttgtaattagactttggtgtgcgtattggaatatagggtcgctacttgtttggggtctatacgaattggtgagttcagcatttccggcacttgaagtgactatgatctaatccactgcaaccaagtcctcggtaggatttggtcgtcaatggcatcttgtgtgagaggttgagcttttgaagcaacccagtgtgtgtgaggaggaagcctagccacttaaaaggcataaacaacaaaatacatgtcaataatgaaatactggggaaa

SEQ ID NO: 102103 - DNA, 685 bp, Oryza sativa
cttgttattttggattaaaatatgccgaattatgaccaaattttcaacatcaactgagctcacatatctatgatccccacgattgttgcagtctcaaaacacaaagattacatgtgcccatgaaacaccaaccgaggtctacctctattttagcaaactgattgatcacatgtacaagaagttggcaaaagggaatccaaagcatttcacagctgctggacgcttggcactcatttcttcaatttaataatttccatgcagaacctggggggcaaagcaaaaggtaaaaaacctgaacatttctccatgattatacgtgggattcttctcagcatcccaaaatcgaaaccaattttgtggtgcttggtacacacggtttgggacttctttgagccacaaggttgaggcttaattcagagctgcccacagtttctccgtttcggtttattcagcggccatcccaaaaaggaacggtttcagttcatcacacactactcgacagccgacagtcactctcggagaagaaaggccgtgaacatgttggatagtactacttcgactaattgaccatttgctgctgccatgagaggaggacaaatcaaacggacagagtgtgacaagtcactctaaagataacagaattctaagtactagctttgctactgtatttgggcaacatggaaag

SEQ ID NO: 102104 - DNA, 556 bp, Oryza sativa
ccgtcaataaactctttggaccgccggtcagcgtacatccattgccgatccatctacggtgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttg

SEQ ID NO: 102105 - DNA, 711 bp, Oryza sativa
atttttacaaaggtaaatttattttcacataccaacttgtaccatccaagaatttcaccatggaaaatttttgtggaaaatttaaaactttgtgaattcaaaagtttttgttaccatagaagcatattaaagcatatactcccttaaataaaaaaaacacatagtttttttggccaaatcaaactaagtccaaaagtaaaagtttcaaatcttgtggtaaaaatttttaatccaaaaattttgctttgaccataaactaaaatcctaatcttctcgggtttggcattttcaacctaactaaaaaaatatatttaagttaaatataaaataaatggaaaggtaggtatcaaaatacacaaacctaaatagagataaaaagaacttgcttgtatatgcatattattcttttaagattgtttttggatattcttggtgcatctcataataggttgcatatgcatgctttgtctaaagaaaattcctaaaaataaatgaagcaacaataaatcccaaaaaaatctcataaatactaaacaacaccataagctcccagaaattttagttttaatttatcacatcaattggtaacacaaataaatccttgaactcagctaaaaaatctggaaacagcataccaattagcctaatttgcaccttcaccaaaattaaaccataactcgtcttgcaaaatctctaggttgcaaaatgtaa

SEQ ID NO: 102106 - DNA, 558 bp, Oryza sativa
gcatggctaagcaattatacctatatagcacttagctgaaccaaaccaatacataaggtccaagctattcaatttattacccataggaaaataaagtcattgtcggccattaattaactgggaatggctcaccacccgacgacattcgaaaataatgcataagttgaaatgaaacattagctttaaacctgttcaacatgctaaaagcattgtttgggatctgtgtgacttgccttgagcttcttcaaacacttgtgaaccttcctcaacgtaaacgctctccttcggaacgtcggaaactaaagcaaataaacaaaatcaacaaaacagtacaaaaacaagcataaacagtacatgtggatatttttaacatgcagatcttgattttagatgaatttagcaacttgaaccactcgaatccgagttacgatgatttagttatgaatttccgaagtttaatcgatttgcaactaatagaaaaaactaataaaaaggatttatgacgtcatcgatgacatcatcgctggccatggcacggcttcacgcgaccactggcga

SEQ ID NO: 102107 - DNA, 889 bp, Oryza sativa
gaccaaaataaaagttatagatattgatgagttgtacaacttttatgttgatgactttttcagttgaaatcatttagtatttgaaaataatattgtttgaagttgtcataatttgaaattcaaattcaaattagtgaaacagagtcatataccaaaatgaccaaaacaaaagttatagatattgatgatttatacaactttgttgttgatgactttttcagttgaaattatttagtatttgaaaatgttgtttcaagtagtcataatttgaaattcaaattcaaattactgaaacagagtcatatagcaaaatgaccaaaataaaagttgtagatattgatgatttatataactttgttgttgatgactttttcagttgaaatcatttagtatttgaaaatgttgtttgaacttgtcataatttgaaattcaaattcaaattcaaattattgaaacatagtcatatagcaaaatgaccaaaacaaaagttgtagatattgatgatttatacaactttgttattgatgactttttcagttcaaatcatttagtatttgaaaatgttgtttgaacttgccataattggaaattcaaattcaaattatttaaatagagtcatatagcaaaatgaccaaaagaaaagttgtagatattgatgatttatacatttttgttgttgatgactttttcagttgaaatcatttagtatttgaaaatgttgtttgaagttatcataatttgaaattcaaattttatataggttaattaaactcagatggagaaataaccgaaataaaattggtatatctcgataagttatacaactttgttttcataaaagttaatttagtatgataaaattcgattcgaatgtttaatattttgaaat

SEQ ID NO: 102108 - DNA, 659 bp, Oryza sativa
cagtaacacttttacttttgtgcagtaacaagtgtatgattagtatctgagacttttaaccgatatatttttgtttcaattcctgaattactgcaattcaccacaatattacggtcaaaagtgcaataacgtcatatacatgcagtaacgctatattggagggaggaaaccaattttcttaagaagagggaggaaaaatggttcttgaggaggggagtacgtagatgcattttgaagtttaatcctccacatgcagtaacacgataacatcatggtggaaacggttttaaaaaataatacatatcttgtgagatattgcttttcaaagattgacattttgaactttagccctccacatgcagtaacagaatgtgtaatttacagtaacaggggtatatacatgcagtaacatggttttaccaaatgtataaaattattcaaaacactcctacataattcagaccttgctcaaagccacctacaaactttacctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatacggttagcatgtgaggctttaaccca

SEQ ID NO: 102109 - DNA, 506 bp, Oryza sativa
cctcacaagtgaggggaggtgggtatttatacccacagcacaaatctgcccgttggagtgcaataaaagggattttcggaacttccgaaaattccagatctgaggaaaatcgaagtcaacgcaattttcggaacttccgaaaaatattttcggaactttcgaaaatttccagaacgcttctgtgtattttcggaacttccgaaaattattttcggaacttccgaaaatttccagaacgcccaaacacggttcggtgtattttcggaacttccgaaaatttccagaacgctccaaaagagaaatgcttcgaagtaaaattgattttgagcacacgcatcactccttatatgtctatgcatcatcccccttaatagtatggctttcctacgacacaatgcgaggaaaaagatacaatataccatttgatcattgccgcattgcatcacgatgtcgcattcacgggatatgcattgtattacaacacgttgaggacttaacaaccttca

SEQ ID NO: 102110 - DNA, 547 bp, Oryza sativa
aaagtttatgcattgatgatgtgaaatgcaaatattttggaattatacatgagaacatagggactatgcagacaacataatcaagcatgctgtcatgttgcctggctgcccattaagaaactagtgtttttacggtagtctttactgttactgatagtattctaccatcggtaaaaaaacctgccaccactaatattgtcggtaaaaaaattgcttattatgtaaggaaaggagcaagcctagatgcatgggtgagtcgtgatgcctaattctaccaggctccatcaaatattaaagtataatcgtcggacaaatcgacaaagataagaaagagtcatctgtcaaccaaacgagaaaaactgatcatctatctaccagacaaaccataaaaggagactgtctctgtgcttggcctcaaatttcaggcaaagcaaaacacctgctaatctgtcagtcaaatgcgaaaatgatatcaccattcgtcacaaaaagtgtggctgtaatcaagcccaaactctctgacagaaagctcgatcagaaatacaca

SEQ ID NO: 102111 - DNA, 741 bp, Oryza sativa
aatttttaagctagcatagctcactcattttagctcgaaattgaatgagacttgaacctaaatttatctaaaatcaagatctatctgatggtaccattttcttaatatgttttgtactgtgtgaattttggtgaatttatttgaattctaattgaattcaaatccgatctttcgcacgtatacttagattccgagggaattgttgagtcgattgaggagcagggacagcaagactgcgatcaaggcaagtcatcactaatctttgagcatgttgaacctattgcgaaaattatgttgatttgaataaaattgcatgctatatatgaatatgaatgtcctacttgttatatatgctatgccttgatattgattatctgtatgcccattgtaaaccctgctatcgtgtgtacttagtcaatattggacaaatgcttagtcatgctacactagaatcatgcattctcatatttatcaagtgctatatgcttaggcaactaccttagggaatgtagttgagatgcggtatgtggagacatgagcgccacattgccatgacattgatgacatgatttgtgaaaggagaaataaaactaaacaactgtttccgactggggcggctggatgacttgggtggagtccggtaaaggctagtgccgtccttggtcagttaaggactgagccatgaagttaagcatggaacgaccaccgtacaaccgtacttctcgtgtgggtatagaccta

SEQ ID NO: 102112 - DNA, 601 bp, Oryza sativa
cagattctcggcggttagcggtagtagaaatatggagggatattattgtcacagaaaaaatagatgcggagggtataatcgtcatttagctatgactaaactttttatcttttttggctttttttaatgaaatatgagcgatgtcagtgtaatggatgatcatatatcgatttagctgggaaaaacataaatgataatgtaactcctaaacattgtattattaaattactaatttacccctaataatactgatagcataatactaccagcagagagcaccagaatatcgtaaaaaaatggttgggagggtctagaaagataaatgtgttagtgcaatttgcagatagtttttcacagcaacatgtttctttctttgaagaaaacgtgacaaaactgctgagcagatcgtgtgcacgcaagtcaaactgacaagctgttattttttacatgaaaactgacatgaacgggttcacattctagagccaaaacctttttttcgttacccatgtgtccaaaccaccaatgcccctctctgattccttaaaaaaaaaaaagttctgagatccccttgaaaatactcgtggtccatccatcttcagcc

SEQ ID NO: 102113 - DNA, 951 bp, Oryza sativa
agagctcaacgtcgtctcatgcgccttcaccgtacgcggcagtagcggtagcggagcactgaaccgcgcgcggcctccttctcacggcggcggcggcggcggaagcaacgctgctacggcgatgatgtggaggcgcgaggtgggagacgaagagaggcgcgagggcgatgccggcgaagcggcatcgggcaccgggcgcaggaaagcgagggggctcaggtcagacgcggcgttccatggagcgtgccgccgtgtcgcggccaggcgccgacgcttcggtttggtctgcatggataaggctcggtcatcggttggtagatttaggtcggctgggccgctgggatgtgaggcggtgggcagcccgcagccgcagggtcgggtcggcctccatgtcacctggcctccataccacctgtctcaattatagccggagtccaaatttcgtccttcagttggtaaaagagattcattccctaacaatttatatcagtgctggttattttggctccctaacaatttcgacggtggtttcattccaacaccgtccatagaggtcgagacgattcacgattgtcccacactcccactcctattgaaacagtacatatactgtgggagtagtagtgcctcccaatacgccattctttacccatacaggcatactctcgtgtgcatgctatgccttgctactctggctagcactcgcgtgccgaagagtaacaccgagccgacacaccagtttgagttgaggtatgtgagttctgccgcggcagtatggcaacgccggcgccgagccgacgcgcacgcgcccgtgctgcttatccttttgcgggcgctgctgggttccgtgattggttgtctccgtggtctttcataaactgctacagttttctcatgtcctgatccagtgagctaaatattgggccttctgtacatcagtacgtccagttc

SEQ ID NO: 102114 - DNA, 598 bp, Oryza sativa
agacaggttccgtccgcaagaaagaaaaacgctgcagtcccaattaacacaaagtggtatagtggttttcaatcgtgcaatagtagccaattatttgacaagatgtttcagagatggcaaagggcaagaggagatccatctatagcctcaaatgtaccatcaccaaaaaaagctcagttcagcctcggatgatcagaaagaaaaaaaaatatcagtcgagatctcctgattttaagcacaaaaatttcggacatcttgctttgacaatgagtggctgcatctctcactttcagagaaacctatcaccctttttttttctttggccaaagaatggacagacaccccaagaaaccgaaagagaaagaaccaaaaaaaaaatcatcagaataacattgcacagcatcacatcttcatcttgagatacacacagggagaaatggtcaagggagccaatgagtttggtgaggaaggcttttcaccagctgcagagttttttactgtggatggatccccacttgggttggcatctactactcctactacctgtggactgctcgtcgcagcagcagcagctgcagctgggggggggggggggggg

SEQ ID NO: 102115 - DNA, 612 bp, Oryza sativa
tcaatgaacaatcctttcaaagctctaaaaggtatgctccaaacagtaaacactcgccaaatttgacattctttgtagctcttctccctattgtgatggtccaaatataaatgataggctaagaagaacaactttcctaccatttttggcgttatagtactatatgcatctctaaatatacgacacttttgactttattaaattccgatgtttatgaaactttaaccataaccatatgtttctgttagaaataatgataatattcaaatatatattacctttgtttatgtattaattacttcccgtatgtgttatatctcgttaccttctgaaatagcgtaaattaaaatttttgaatcagtatatttaatattttatttagtaacaaattctccttcttagtaacttctctagcaaggtaaatgtgtgaattccacctttatcaccagttaattcttttttatatagttacagcttactaaatgctctatccgtttcacaatgtaagtcattctaacattttccacatttatattgatgttaacgaatctagacatactccctccgtttcaaaatgtttgacaccgttgactttttagcacatgtttgacc

SEQ ID NO: 102116 - DNA, 587 bp, Oryza sativa
taattggggtggtagtataaatagatttgaacccttcgatcaaatgaaattaacggttcagattaatttctactatcagtagagagcattgtagtgaggctcacatattgcttcacttcaaataaaatcaatagtactatgactataatatgagtatcatgtacaaaactagttaatggcaaagtgtgagtgtggcaagtggtgaccaatgaaggagaaatgggaataagaatgagctattacatatatagatacaaattttaacctaaacttattaaaatattaaacacctatgtaaaatctaaacattttgtgggtccctaaattaaaggtagtccctcttcttgacccgctaggctagaaggtctgtccctgaacctctttggcctgagttcgtccttgtcaatccttagcaatgcccaatgatcttagctaggaagggacagcgactaggtatgggcaggatagaaagcagagaaagacatgagggtatttgcactctattgaaagtttgatggcattcaactttggaaattcggtggaatatacccactagtgcatgcctatgaataacgtggattaattaa

SEQ ID NO: 102117 - DNA, 737 bp, Oryza sativa
gtgctgttttgccatgttatacatgctggcgtgaaaaaaaaaagattctaaaaaaagttgggaagaatttgtttttaaaattaactaaaaaaattaaaaagataacgtctcgtcacctcgcccccaggcctcgccgccgggcgcgcccacactgcgctgcgctgcgccacacatgtgatgctgccgcttgcgtgcgtgcgcgccgtgcagcgcctcggttattccgcgcgtttctcctcccccttcccctctcccccgcgaggcgccggcgcatgcagtgcacctcgatcgttgcggtaatcgcgtgtgattgattgactgatttgctcgtcggatttgcggctcctttttgtgcgtgttagtttcggtttgtggcgtaaaccatgtgagggcttcgctttttcttgttttcgtttggtggagggtacatcgtgcgtatgcttggactggagcgttgatttgattaacttaacatggtttcctaggttataactttgtcgactagtccattagtgaagtggttatacgagcaggttaaatagcaggctatatgccaactatcgagaagaaagaagagagagatgagcagcgggttacaggtctgtagccagctgcagtacgagcttcaaaacgaaatgtatctatgataggtgtgactatatactaatagtttagtatacttttatatgttactattgtataaattggctattaaattgattacagatgatttggag

SEQ ID NO: 102118 - DNA, 709 bp, Oryza sativa
cttatcgctttaggattatcccaattcaagcattttaatctctttgaataatattttctgtaaactcatatagttttacaccataagatttatatttttaaattcaccatgagaaatacttttatgcgtataattcacatgttattgaatcacacgaataaaaattaatggttataaatatatttgatttaggataaattaaaatgataactataaataatttgaaacgtatggtgtagctaacttagacatgcatggcagcagctggatgttgttgctataacatgtttgaaggcatagccagaattttcttgcctaagagcatgttggtgcagtactggcttcatcttcatctctcttgaagttggggcctaaccaaacaatttcagttccatctaaaatagtagtggagctaggtttagactgttctataactttactacatacctaacttttggagttaaatttaggaattggagttctaccaaacggaacttaaattcaactagtgtaatttacatatttttatctttatctcatactatatttggaggttttgaaatatatggtatgttcagattgtactcaaaataaactttatcaaaatttgacaataccaaaattttgacaatttagcaatattgccaggttttggcaggacttcttatatatttatcagagtttgataaaaaagcagggctgcaggaat

SEQ ID NO: 102119 - DNA, 3929 bp, Oryza sativa
ggttgtggtacataaatagctaaataagtctatttaaggtccctattctttgggcagtgacatttatatgtctatttttagtccctatactttgtgtgccgggcctggcctatcggcccatcgtgccgggctggcccgaccgtgccgggccagcccagcgtgccgatagggagtcctaggtcgggccgggccgacccaaggccaaaaagccgtgccgtgggccgggccttcgggcctcgggccttatggccatctataggagcctgcatgatccgtgaaccaacctctctcccatcacccacatgttagtgcccccctcctgttgagcacatacactgaagcagaagatcagaccacacaaaaatgctggccatggcttccgatgactttttcgagggctgtcgccagacatatcgctcctacccgccggaggagagcgtgcggagttcccatcgccgcctccgcccccacggagtttgcctgccgagaccgtccaagatggcggcccttggtatcccgtcgaggacagcggcgggaagagcttgccatggagacgccgcttgaggagcccccgtgctcggtctcctcccacccttccgctcgtcttcatcgtaggggctaccatggccaagaaggccatggcgcaaccatccccatcgatctgctctgctctgccccttctatcaagttgggctcctagtgacaaaacaaaacgggaggaggtggtagtgtagccccatgcatatgcatgcttaatggcatgatggaacatgcaggatgcagcattcgctagtattttctgtgtgctgttgaggaagatagcaactcaactcatgaactgatggtgttaccagaggcaaggcaagcgtaaattaagtagtcaagtccagggagatactcctaattgctttgtatgatagatgaagaggtcaagttcagacttaagggtttttgcgaggtggtgatagcacagtcctatctatctgtaacagctcaagattgatatctgtaacggctcagccaaccgttactaagcatcagtaaaagatgtggctaatcatctgtaacggctggaggcccattacggatgaagacttgtctgtaatgggcaagattagtagccattacagatgagagaaacaccccttgagggtgccccctctcatatgtaacagctactaatagtcgttacaaatgtcaacatattttttttaaaaaaaaatcaaattcagctgtcccaggcaatgcaagcatcctaatgcaatgatttacaatcactttgcacgaagtctggatgaactcatgacacttcctgaacttaaacttgaacatgaaaagcatcacaaataaaaaatcacctaaaaaaccacaaacatttagaagtcagctgcctccacgaactcaagaagacaagaacgtgcgagccagcgcatcgtcaccacaccatcatgagccatcgtcccaccatccaccaccaccatgagctaggggaggcgccacgatctagagggaggagactcaccagcgtcagatccccgtggctatgtgctcgtcgtcatcgtccacctcccattcgccaccatcgccaaccctcctctcgtcgatcaggatcgaagttgatgctagagcattccgtcgaacacctagtgggcatcagggtcactgctctaatgccatgattagagcgcccttctgagcacttagcagccatcggagcacgcacctcaatgttttggacggatcaaccatctccattaatcgatcaacctactcatccattctacgctaagcatccttcattccccttgtaacatatatagtgcttcatcccagttgatcttctcctgactcatcacaagagaagaacgtcttcctcgaacatctccaatgggcttgacatttagtcaaacagttggcggaagctgctcggatgaacactttcccaacccgatccctcatccttttggcatggttgcctccccaacacctccatgataaaaatcccagtaaccgaatggctctgataccagtttgtttataaccctttgctccaattcaaaacacatcaatattcattacatctctcaagtgtttgggtgtggaattgaagaagaagctaggaatacagttcatgtagctctaaaagctattccctccatccctaatgtttgacgccgttgactttttaaaacatgtttggccgttcgtcttattcaaaaaaatttaagtaactattaattctttttctatcatttgattcattgttaaatatacttttatatatacatatagttttacatatttcacaaaagtttttgaataagacgaatggtcaaacatgtttaaaaaaaatcaacagcgtcaaacatttaggaaatgagggattaatatagaaagctggaggtaggaagaagatagggaggaagtacatcaacaagggtgcccaccggcagggagacgactgcacgtcggacgtccgacataataaaaaaaatcggacgtcgcgcccagctcagcatctgtcacacgcaagagcgtccatctcagtctctgtcacatgcgcaattatactggacgaagagatatggcgtagccagttacttgtagctacatgcatgcttagtagggtagtacaagctagtagggtaagtataagacttttttttgccaacttttaaaatagtttatcttttaaattatttctccaatttacgatccgattacatcctttaattcgttgcaattaaatctttaaaacaagaccacacatgcatatatttcgatgaaaaaaatattttaacttttttaatggttttctttgaaatgttgcacatgttatatttaaatgtttcagctagtatacatatgttgtttcattagttaatttgcaaattttgtacgttgttttccttaaatgtttcactgagtatttaataatgtttcaatagttatagtttaatactcattagtcatataaaaatatttgaacaatatcaagttttttgtaaatctcatatgacttttcttgttttgctctttaagactcaatgtttcatattggtggttaatggtgttgcagtcgatattttataatgttacatttctctagaatattttatacaactgaaacaatttttttaaggggtgaaacaacatttattttttttatgaaaatataatcgcgtgatatcttgttataaagatataattgtaatgaatacaatggtgtaatcggattaaagaacaaataattattttagatacaagttgtgatccaattgcaccgttgaatttgttgcagtgaaatctttacaaagagatctcttatgattatattttgtataaataaagcatatatatttgtattactaattgaaacatttctatattataaatagaacattgatttgtaaccgctaaaacattacaaaatacatgttgaaatatcgaaagaacaacacgtgcaacaacctaaatgacctagtgaaacatctgctaaaacatccaaataataccacatgcaacatttcaaatgaactagtaaaatactttgaggcattcaaataacaccacgtgcaatattttgaatgagctagtgaaatacgttctgaaacatcacaaaaataccttctgaaacatccaaagaacacgacatggaacattccaaatgcaatagggaaacatcacaaaatacctagttaaacatcacaaaataccaagaaaaacatcaaaataatacaatgcaacacttcaaaatgcctagtgaaacattagctacaatatcacaaaatacctcctgaaacattcaaagaacaccacgtgtaacattaaaaaaatgataccatgaaacatcagccgaagaaatcacaaaatacctcctggaacattaaaaaacaccctgtgcaacatttcaaaatgacctagcgaaa

SEQ ID NO: 102120 - DNA, 2641 bp, Oryza sativa
cagcccgattacatgaaagaaacgatatatgcagtaacaaactacctaacagaagcatatctataacaaaccaagtttgttactgcatggatgaggatcggcaaagcctgatctggatcggccaagcctgatccgagcttatctagctaactaacatagcaaaccctaggaatcgccttttttaacgaggaggacccatatgcatggattcgagctcctggtagcttcatattacgaatcacccctcaactttcgtatgccatgcacctcttctagccactaaatagctaggaagagcacgtcacagaacttttgcaaagaaagagagaatgaaaagaagaagaaaaaaaacagtaaagtttcctttccaaagccatggcctttccttttccttttggctctcatgtgtgatattataccatttcctctttttttttctctctctctttagccatggaaagagggagatggagacgagaaaaatgtaaaaggggaagggagcaaatgggaggcgttgggtgtgacgaattttgggaggaatttagcctgtcctgcgcgtgcgtgcgcatggagacgcggtacaactggacggtgctgcttgtgctggcctggggctaagctcctctcgtggttggctgcgagtggatccatccaaagcgacggaccactcgtgagcactgaaatgtatgggttttttgtggttactggctagtgagcaagtgatgagagatcgacctcgcgatccagttgtgattgtgcacttttgtgcacattcttcccgggttcaaacatgtgttcttgttttggtactttggcattggtttttaatttgtttggcttgaagacaaatcaagggaccaaatggggtttgatgttgtcgttttgtttgttatcgtggtgtgtgtaaatgggctgtgtattttttctttacctctagagaggaacaaagagagaaaaagtctcatttttccacgcgtttactttccgaactgttaaagaatgtttttttaaaaaattgataggaaaattattttaaaaaattatattaatccactttgatgtttaaaataattaatactcaattaattattttcttgtcaccttgataggctataatgtgtcaccttgttttgttttgtgtatcttgtcaatcttctcctttcctatcatctcaaacactctcaatagaggcgcattcatgcatgaggtttaaaaagttgctagtaagttaaaatgtttagttacttcaggaaaaatgttttactctattttttatgcatgaagcaaattattggttttggtcacactatcgaaaccagcttctagcctggctgggcagctgcctaggctcgatggccatatgcgccatatagctgttcctgtctgctagaaattattgtgaaaatagaaataagctagtaggtgatgtcccattgtctaggctggtcatggcacagaataattaagagtttgcaaggaagagaatagtgaactattattatcaatcccctatatatacgtcaccatcacgttatatacagggatatactcttgatcctcatacttcattgccaaatgtatgctaatttttatcaacaataacaacgaacacacgggttggcgtctagtgtgtgttaatagctggtcgtgatgtttttttttaactataccaatcctaaaaagtatggttgtttttatgtgaattacagtgatattgttctttttttaaaattctaaaatgagggtaggggtttcaccaatcctcagttcatacatttgcatattcaaaatgatatttatacgctaatactgacagtatccaattaccaaattaataaggtagtatattgcttaaaaagtttcttatttgaatagtgaactaggcatgggctttgttagtactttaaattttaggagacatgggtttgtctagtcaccttccattactccttcgaggctttttacttactcgttccgtttcatattaaaaatcattttgaattttttatgataattttttttcaagtttaataaagcttataaaaaagtgtagcaatatttttaacccaaaataaacatattatcaaaacatattaattgttcattttaatgaaactaatttgataggctaaactttttataattaaacttaaaaaatactagaaagaaagtcaaaacgacttaaaatataaatataaactaaggaaagaattaacaaaatgttgtcaactgcttttaccacaggggatcaaggatgcaagtacttcttgtgcgatcaataaaatatctgaattatcttaaaaagatatttgtaaaatttcactactatagaatctctttctatatgcggcaaaaagtgatttttgcatgtggtcagcgcaaacgcatgcgccaaaagatctatgaaaatcagatattgcattggcatgcggacagcgcaaccgcatgcagtcactataccggccacatgcaaaaataatttcggcaaaaaaataaaaataaaaacccaaatcgtcaaagctctagcccgccgctatcgttggccggatccccgccacccgccatcgtcgtcatcatcggatccaccacccctactgcccttcgtcattgtcgctagcattggatctacgtggggcggcgg

SEQ ID NO: 102121 - DNA, 539 bp, Oryza sativa
catatctcttatcttctaaaaccagtgtaaatattgagagtgattttgaatgattggcgctgatgtggcactaaataaaaactcatgtggaacccgcatgttagtgaaccaaccactctcccatcacccacatcacatgtcagtggcccctcccattgagcacaacaatgttgcccatggcttacgaatatcagggtttacattaccggttgacaattaaatttcgagccccatcggtatcacggttttcgataaatttcgaccaaatctattgtttaacctttgaaattccaatcaaaacttaattttgagccgtgtagaaacgtcgaaattttgcggaattcgaccggttttcgtcggaattataaaccctgcttacgatgacttcttcaagggctgccgctagtcgtcgctcctgcccaccgaagcagagcgtgcagagttcccatcgctgcctctgcccccgcagagtttgcctgccgagaccgtccaagatggcggcccttggtatcccgtcgaggacagcggcgggaagagct

SEQ ID NO: 102122 - DNA, 694 bp, Oryza sativa
cctaggcaacctagatcaacatattggcagtgatacacaacaagcacacaatagatcctagatttacagtgttaaaattatcacatcatcaatacagtcaaatataatcattatcctgcatagcatgcaatctaacacaaagcatcaaccaaatctaacagtttgaactttaaccatcagtgagaacttaaacatggctaagttatataaggttatcagaatttttcaataaccatcaaagaaatatttaatatttttatatgcattcatgatctgtactgaaaacaaatcctacataaactatgaacatatctcaaaggtggaaaatagtctaatacccaggtaatgtacctaggccatgaaagattttcccataactggtggttctttcaaaaaaaaaagaattgttcctgcgatcagtattttttagtagaaacatgtaaggatgaaactactctgcaggtgtcctctaagttatcatggcaaattgcagcatgaatgcacacaaatacatgagaacattgcagaacaaaaatgtggaaaagaaacataaaaataatgcaaactgaaagacaggaaagacttacgtcggtaagagatacttgatgaactgaattaaatctgttttggggatttccaagtcagcagattttagttgatccttcagctcgtccatgagcaaatttgcatccct

SEQ ID NO: 102123 - DNA, 513 bp, Oryza sativa
ttggaagaaaatagaaggaaaaacgcatctggtaaagaaacaatgaaaaaaaagtggcaaccgggactgccgcttttcttctttttagtaccgggactaaagatcaacttttgtcccggttattttacccgggaataaagatatctatctttagtctcgaatttggactcccggttgtataaccgggagaacaggcacttacgaaccagaggtaaagatgacttgtgcagcggtgcatcatcttaaggatttgtaccgcctttttctaattttattttgcagcacttttttaaagtacaaggaggtaatgcaaatcaatattagaaagaatggtgtactttctcaagaattgtgaaaatacttattgtatagaagtaagactaaagttttcatatcctataagttcgtttagaaagggatcgcataataggaatacaattcccttagaagggagcatcccacaacaatagcatctctttttaatcaacggtaatgtggcatctgtaggaagaa

SEQ ID NO: 102124 - DNA, 541 bp, Oryza sativa
ccccccccccctttttatctgtttcgacgcctgatgttttgacacgttttgttttcgcagtgctgactcttgctcaggccgacaccgaagcccgtaggatgatcggcgatgtgtcggtcactgagtacagccaactgctcacgcggcaggtggccggttgggcgaatcgggtgtatgatggtgatcttccaccccgggcaaaacccttcaaggccgatggcgacgaggggacgtccaggaagcatatgcgcgggcaagtgaagctggcccccgcctcctccgactttgatgccgatgaggaagataatgtcgaagaccatgacggcgaagaggaaggggaggacgaaggggaggcggaagttgcggccgaaaaggctgtggacgaggacaagctttatctaaatcacgagcgatcctaaccgttcaatcgaattcgatgactcttagcacacctgtaccgacttgggccgtggcctgccacatgggcccaacgcacttaacaggccagccacaacgtccttctaattatgggcctaattgg

SEQ ID NO: 102125 - DNA, 704 bp, Oryza sativa
taatataatctatgcgaataattgcattcatagatttacaataaatatacttgtgttgttttatttaaatattttttatgaatatattattataaacatgaatggcaacaaacctatatggattggagactttgtctgacaagttaaaaaaatcacaaatagtttatagtttattttgcaatagttaagatcgtaaatggatatatatggtaaaaccaacatttcaaagtaaatgcatttctgaaagacattaaattaactcgctctccaagctaacaaatccggcctcgtttttccttcaggaatgaacaaacctaccccgcttaagacatttttttaatctcctttactctttacttataaaataagggaagggctggtgcaacactactagaaatctcattttcggcgtcgtaggggataaatttcgcaggcgtgcacgtaattcggagccaaaaccccgccggcaaaaatggtacctggggtggagggggcggtccgcctgcaaagatggatctatgtaggcttcttcctccccgagccctgttcattctccccgacgtttctctctcctaaagtgacttaaatataggggggaggttttgaacttcaaatcttggggggatttttctacggtacttagatctactcatttccacactaggaatgcattttttttaagcttttaaacctttaatttgcga

SEQ ID NO: 102126 - DNA, 2013 bp, Oryza sativa
ggtttctttggttctttctttaggttagggatataggatttgaggtcctattccaagagcttgtatagcaataggagctactgctctcttaaacattttaattttattttttattagatagattgtgtagtaatcataagatctaaaaaaataaactagtatattagctaaaaactaaaaacataacataacttgttcaaattctcactatatagatactctatattattcgtgtaaaaagaactcttgaactataaattaagtgcttactccctccatttaaaaaaaaacttaactttggaggagatgtgacccttatgacaacaaatttatactaccatttatctagattcgttgtcataggaggggaccttctaggttaagttttttttagacggaggaagtatatgataaggttttgactccatctctcttaaaattgtagcccaaccaaatgtttaagcaatatctgaaggagataaagtgggctgaagtgatatgaaaaataaattataggggaaaaatagggtttggattgctccatactttactctagacttcactgttagagttagatttagaagttaaaatcatgtcaaacatgtctaaaagtattcaccgcttccaacaaagacattagatcacagaccaaatggcctctatgtgaggaccgagaaagtgactttcggagacagataacccagtttcaatagagttcatcggcagtgatgtgtattaggggacattctttttttctctgagtgtagataaagtactatcgctcgtacttcctaatttaggattcataatttcgactaaattaaagggtgtgcatatcaataaaataaactgcgattgaatttgactaataatatttcttataaaattattgtaaactccacatgttaaaaggagcctaaaagccatcaacgtaacaataggggggtaaagatactgctcgcaccgaccgttgcttagttcaactggtgcgacgaccatcatttattacccagtgtgcaggctacagagttatttttttccgaatcacttgctcgctagattatccgttagagcaagtttaatagtaccgctatcaactgacgataaaaatgtacatgtcatccggagatagaaaataaagatgatatgtataatagtaggctgctaatctacctacacacttctctaggtagttaactttttctattttttaatctaacttgctactctctatcctatcccgtgtgttctgctaatggggccatagctatactattggagaaaaacaaccacaatattgaatatgcataatttcttgtgctatagctcggcgtttgcagaagcgcccgttgccctctccctctagctttctctctcctccacgaatgaatttggatgacgtggcactcttatcgcccgctgagtgtgccttattagagcacccgcaatggtaaagtaaggtgctatctataaaacatgtacatctcagcaatagactagattaatagtaaaccatctcaatagtatgtctacatggggatctatagctctctaatacattgtctcatttttctctatagactatctccaggttagtagatagctttattctctctcttcatttaatctcttccaagtaggaaaatatgctgatatgaatctcttatagagagcttatagataataattatgggtgtccttaaacttgctcttaaccatgcatggttaacgctccctcattccacggcttgacatgattcatgtcagcaccccatcaaatattgaatgcaagcgaaaagttccgcgcattttttattagttattagtacttggttgtctaaaatttttctaaaatatttcattcctcacggatccgcattgataattaattgatggataagaatttttttaaaataaagcacaaaacagtatgaaatttcatattgatatgttcaggaaaaagtaaaaggctataattagaaaaaaaaaaagaagccacccaccacatgctag

SEQ ID NO: 102127 - DNA, 611 bp, Oryza sativa
aaaggggatggttttatgatgtcggtatggttagtgatgttgtttttgttatggtttaacagagcagcgtcggctcatgcagatcaggtccaaaacgtgctatctgaggttttgagaggcataggcgcaaatgaggcacgatacagttgccgtgctgtagcagatggctatgttgggtttgctgaggcaactgtttatggtgcaagaggagttggagagccttttgttgttcgtgcacagggtatttcagctataagaccatgcgatgcggaagaaagcgctgcacatgctttaatttctgttatcaagaaagaatgtagtgtggagttcgatgatacaaactggtttgacatgaatcactatcatgttgagacagagcgactgaagagagctcttgggtgagctaggaagaaatgcaatactcttgcaaagaaggcacggttgctggaaatcggctgggatagagctttagattcattgggttctgtctaccaaatatgtgatgacatatgttcttctgttctaggaggtcctgatgctgatgatcttagccatcctgaggttggagtattataccatgtgcaccgtcttagtgaatatgctgaatcttt

SEQ ID NO: 102128 - DNA, 675 bp, Oryza sativa
aggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaacaatttataaatcctgaaacgaaaatcaggatgtgacaatctatgtaaccgcaatgcaaatagttgtatcatgttcaaattgtactactatttcttcatgttacataattctcctagtttaagtccatataatgtttctacgacccagactgcgataagcctatataaattatccgagtactaatacgtcgaataaggtacaaaataatacctcactt

SEQ ID NO: 102129 - DNA, 637 bp, Oryza sativa
tagtagaataacttcgtagccatttcttcaatgaggctcctttctgttgcattttggtttactagactattgcacgttgagtagcatcaccatctaccacatgctcctactccctcatgtcaatatatttaaagtttgagacaacaaaatcatattaaatcactcactaattttatgtcctaaaagctatgtaaaagtgaccatagggagcatctgttaggcggagctgtgtggcacattgattctaggcttctagcatatctattgtcgtcagattatgctaagtgccccaaccactgattaggaggaaaaaaatatgcggaagttttaaaattttgattgggataacaaccgtcacaaaagataaacaagtctcttgaattgataatggggaatacccactgaaaaaacatcaaatatgtgaatacccgtgaaaaccggatttaaaagttctctaaattcatgaaaaaaaattactagaaatagttgtaggcgtaaaatacattcacaccaaatcaaagttcaaactcaactttgttagaagtaacaaaagagacaaaatttggatgaatgacaatgtagaaaagattaagacaaatgaatttgcttgagaaaagaaataaatgaattgccaatg

SEQ ID NO: 102130 - DNA, 1265 bp, Oryza sativa
  unsure (1)..(1265): unsure at all n locations
aaaagttttacaagttttacacatgcgttgcatgatagattgatcgatatgcgtgggggcgactgggcgacgagtacatagcatgtcaccttgcatcggcagttcggcacggcatgcaatgcccaacatctgctcttatgttctgtactcgtgtgggcataccttgcagagcaggtgtgtaatgagatagatcaatcgtccatgatcagcgttgttgtgtctctaatgttttctctgatcactgcgaacatttggcacagctctattgcaaatttggaaagtggaaaatgcaagttccgtaagttgcaagtcatataattcagtgcaatgagaaagaacggtttgtaagttgcaagtcatataagtcatatataagttgcaagtcatatagttccggtttctatctgatctgtttgtgctcaacattcagagcgcacggtttcgtcgacgtgttacatgcatgttccgatgttctgtgatggtcaaatttgcagctaaagttgagcgcattgttgatgttcctgcttgattcatttcttgtttccgtctgcggccatggaggcatgcatgcatagacgcgaagcacaactggtacatacatgaccatgcattctatcaagagagctccagaaatacacattccattgcaatctttctcatggngagaatagatggagaagggaagatggncctaaagttatatattgaacatcagaagtgatagagctgcatgttcagcaatacatcttctagatctcaaaatgcacataagccccaggctcgctcaaccatacgagctggctggcaataacttgcgctaaatttcatgagctcatacatattgtttgtcgagacctaagggaatcgaaatgtgatgcatattgacatattgtcaggcaagagctaaagataatctgttgctatcctaggaccatcagttatgatcaactgatgctgatggtgaggccggtctgagagcgttactgccattctccattgtagaatcatccacaaactggctcgtgccatgtagttgctgctcgccaatttgaatgacgatatgatgtgttctccttgctacgctgggtattctggtactgacctcctgtttgcctccctgcagcatacacctgttgattgttctggttctggtgatgaactgttgtttgccgctgcgtgttatatgcctggggatgattattgttctggtaatgcactgcaatttgccggttggtagtatacccatgtggactctgacctgacct

SEQ ID NO: 102131 - DNA, 709 bp, Oryza sativa
ggcaccgcagcggcggcgcaagttggcggctcggctgggtgttgggccggcttggactgaggaaaggaaaagaaggaaagggagaattcggcccaaacgtagaaggaagaaagtctaatttttcctggggctgaataatttgatttagaggagaatttttatttggaaggaatttgaatagaagattttgaaaggaaaatatatttggagataatttgaatagggaaggttgaaaggaaattatatttggatctaatttccaaaagagatatttctaatttgagtgcaatatttttggaagtggaatatggtggaatttaatgcactcaaatgagaggggaattaacaatataattcctcaatatatatatatgtttggaggagaatggttggaggtaaaataaataggatttgaatcctaaatttgatagtagaagtatttgaagaattatttgtggctaatagggaaagttgagtgaagaatataaattggtattttcttagcacaagagcaattattcacaatatttgcaataatactattcttgtgccgaagaggaaatcaagcccaggaattaaatcagtggctagatcaaaaggaagaatttggatcaagaatcaaaggatgggtttaagatcaaaggatgggttaataattaattccaataaaattggaattactttggttaatttaggtgggctgcaggaa

SEQ ID NO: 102132 - DNA, 630 bp, Oryza sativa
ctcataactgatgttgtaaattttttttcaatttttttcaaataagacggacgattagagttggatgaaaaaacatggttgcacttaaaatggaacggagggagtattaattggtttctcttggaccgataattagaatacatatcgtagtgactctaacttgtgacttgtatgctgcaacttagggctgtttggttgagtgccaacctttgccaaacttgtggcaatgaagcttgaccaattaggtctgtgtttggttcatgccacaagtgagttatgctacaattttttagcaagttggtccacttgtcattgagcgttttttttttgccataacttgccacaattgtggccaacaaatttttagccataaaatgtgtggcatgccacactttgctaaatattttgtggtatactatggaattcatccaaacaacctctttttactatcggagtcgatcgatctgatgatagctataatatgtgcgtaataagatgagagagatgatccagtcaataagtcagggctcatggcctgtcaactgcatgagccgcatgtcagcaatgactccacggaatgcgctgcctgagcttgacgaggaagtgctcgtagtcctccttggcggcacg

SEQ ID NO: 102133 - DNA, 694 bp, Oryza sativa
cgcggagcggaagcgcgggcagtgacaccacggggcggccggcggcggatgctgagagtgtgtccccatgcgttcggcatctcgcgctgcgcggggcggcgggggtcaaaactacaccgtgtgcgatgtggacaaaaaaggtttctccgttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgatcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttt

SEQ ID NO: 102134 - DNA, 681 bp, Oryza sativa
ttcctgcagccctaagaaaattggtggagaaaccggttaacttgggcggtttttatataaaccgaggattaaaatctcgagaagattgaccgattaacttgggcagtttttatataaaccagggattaaaatcggagaaaccggttaacttgagcggtttttatataaaccggagattaaaatcccaagaaaattggtggagatgaggattcaacctcaagtcataggattgagagcaccacacggtagccatgccaccatcgtaccgcttgtgctattatataaacatttattctatattactaatcaaaccgtggttggaccggacaaaccagtggtccgaccactaaaccagtgaaccgagagctcaatcggttcatttatcggtccggtcttaataactatggtcccaacgcctcccaccgctcaccgctcgctacccctagtagccaatttggatgagaatcagagggagaagagagagggtgagggagagaatatgacaggtggtcccacctttttttagaaaaaaaatgccaactaaactaccatgtataaccaaaaccactccggattgaattagacagtagttcgcccggtatatattaatagttgaggatgaaagatatctgtttttcgagtctaagggggtaattcgtactcacccaatattttatgggg

SEQ ID NO: 102135 - DNA, 601 bp, Oryza sativa
gtgaagagagacaattggtatatacaaaactcatagctatagagaggaaagaagaaaaaaaatcattttttttgccaatgtacttgaactcaccctccgtcgagcaaagaatgtaattctaaaatttgtccaacaaagagtgcagaaactcatatgagaaaatttgtcagttttgccaacgtacaaaactcacgaaaaaacaattacaaaactcagcaaaaaaaagttatcaattttgcccgtgcacaaaactcaatcagtaaaatatttatcagttttgccaataaactcgccctatgtccaacaaagaatgtaattctaaaatttaaaatttgtcctacaaagcagtggcgaagccaccgcccagataccacaggcagccgccccgctcgctgtcaaacgttccattgaatttttagctcttgaaaggattgaccatagaactggatatagtttgagttttgctcagggttaaaaatctttctggctcagctatactatagagactgcagaaacttataggagaattttaactcagcaataaattttgaaagagtgcaaaaactcatacaaaatttcaacttagcaaaaaaaaaaaaga

SEQ ID NO: 102136 - DNA, 581 bp, Oryza sativa
tcgcacgtgtgacaaagcgtagtgtctaagacatctaaggtgatcacaaccgctgtagcgctaccgctttgccacatatcaaatcatatatgaagatgattaattttgttaataacataaaaataaaattaaaggtgatgcagcgagagaataattaagcaccatgggttgtgtttttctcaacactaattagctctgtttaagttgaaaccgagagttgattacataataattataatgtatttgtgttatgtcgtatttggattttgtactatttatccgtacaggtgaaaggaatcattatgttataaatgtgagtgcaatattgacgaatatcaatagaactcttagtacgacaagggtgataaagggagtttaaggccctctctttttttcccgattccatattttggattttttttgcacgctttccaagtttctaaatggtgtcttctttaaacaacattataactttttagaagtcaattcattcgtttataccctcaaatagctatcacataaattatataattcatcaatttcagctatcctaaaccttaagtactacatatttttttcat

SEQ ID NO: 102137 - DNA, 650 bp, Oryza sativa
ggggatagagaagattgggaagatacgtaaaacgaggtgagctattagcgtatgattaattgattattaattattttaaattttaaaaatggattaatatgattttttaaagcaactttcctataaaaaatttttacaaaaatacaccgtttagtagtttaggaagcgtgcgcatagaatacgatgtccctttctcacccaatccatcccctagaacgaacgcaccctaagttttactccgacaatctgatcgatggtttgtcagtagattaaaacaatataattatggtcttgttatcaaattatttttagggcatctgacggcgaagagcgacgtgtacggcttcggcgtggtgctgctggagctgctgtcggggaggaagtcggtggacaagagccggccggcgcgggattaatgtgggggaatcagtactcaaattcatcaataccaggtttccagcactgccatctcctaattcacttaacatctcatagtgacttggatcaggaaccatgatctcatcataactagccttgcaaaccttattccaacaattcccataaaccatcctatcccatatcactgtcctccaaccaacaaagcttttaaaccagatatcaagatcaggagcattttctttggagggtgg

SEQ ID NO: 102138 - DNA, 1092 bp, Oryza sativa
tatgataacgagaatgatacagacaaaattaatggtttgatcagcaatttctggcaatggccttcaactacttccagcctgctttaaattggcgcagcaaatgttaagccatgatggccgtgctgtcacacagtctctacggagagaagaattgacttgatgatagatcaaaaggctaaggttgcggcattaagcaaaagccaaatgctaagctaagaaaatggtttgaaaaataaatgccaaacctgatatttgttttaatgaaaaagaatactggaccttttggcctgtatgcacgaggatgcagaaactagagatataaaacacttcttcatcatcttgataatataaccatgcgaagatgatcattcatatgagtgatggccaccatagcatgatgtatcgaatctgaacgatgagagaatatatggatcgtgccgatgatgtcccactggcaaatctgataaacctgcaatagtatgggagtggattctaatccctcaaggggatatcgggatatcccctcgtatacctttttctttcaaatttgatgcaaatagttgtgaaaaattctgaaaaaaaatgataatatagagtataatgatagtcataatgcatggccgtgttaagccttaaataaggaacatggctccgtccaaatgagcatcccatatttttcgaccaaaaaatgagagagaatctcgtatggccggttggctgtatgggagatctctagtgcagtaagaacattcatggttgcaaccatccaggaaataaatgtgacaccatgcccccatgtggtagcattaagcccttcctctgatagccatgtgagcttgtttgtagcagaggtgatggatctcccaatagactggtcacttttggtcactgaacgctcaagtgaaatattaagattgtgtttagttcacactaaaattggaagtttggttgaaattggaacgatgtgacggaaaagttgaaaatttgtgtgtgtaggaaagttttgatgtgatggaaaagttggaagtttgaagaaatattttggaactaaacacggcgtaactgtttgtgaacaggaatgaatttttcatg

SEQ ID NO: 102139 - DNA, 633 bp, Oryza sativa
tttacgatgaaaggacagatgctgctttgttagtatcggatcgaacagaaagttgtgctggttactgttgcggatcgatgtcaattaagcttgataaggattggcatggcccgcggatgacgccttacgaaagctctccctctataaaaacttttaggacagtcccaacccataacactagatatggtttcaactctacatcatcaagaaactagtactagacactactcttctaatgcaaacaccactattccgtacttcaatttaatgctacttatctcacatgatgtcttggatgttgtgtaaaaatcatgtctcatacaagatatggtttccttctctttcctcatttattcacttgccacattattttttgttctacgtggcaacttatttaattatatggacaccatactagttattgggttgaaaatccctaatattaggaacagtcttatcctgaaactgataggtgcttaaggtcccgtgaagcaaaccactttgatttgtctgcgaattttgaagtcaatgattcccttttgtatactacctccgtcccacaataagtacaatcatgagttttcgcgcccaactttaatcgcccgtcttatttaaaattttttataattagca

SEQ ID NO: 102140 - DNA, 708 bp, Oryza sativa
ttacaaccaatccacacacacaccaacaaacaaaacaaagctatgcaacatgccgacgaccatggacaaatcttatatccgataccggaccagcgggtccttgaactgaagccgcccattatacaccctccacgcaaggtcctcgagtaaaaacgagtgaaatctccacccatccccatcatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacgggctgcag

SEQ ID NO: 102141 - DNA, 782 bp, Oryza sativa
aattcctgcagcccatgtggcgcaaactgctaagctacttctgaacacattatgggtatgttcagctgccggggctgcggctgcactgcagccaaccggaacattccggtaagcacaaacacagcagcagccgcagctgcagtcctggcctgccaagttaaggatcctcatggattaaaatatacattgacttgcaattaatttgccatttcccttcttttgttaccaaagtagtatatatgagtacaaatatacaatggcatttactttatcgctatacgcctaaactttgcctttattttttcctttctgcttttacagctgtttacctgttattctttccctgtatggatttctctaactagtgctatgtgatgatgtacttatgcagtgcttgttcaatgaatggagaggcatctttgggtggacctttgatctgcatgctctctttttcaaatcaattaaggagcagattataacatcatttagatgggtataccatctgtactttgtaagctggttattgtttgaataatcttggcctcaaatgttaaccatacctttccttttgcaaggttccatttgttcttgtagatcctgaaaacatgactggaatggtccatgtgaagttagacagggcaatgcaaccattacctcttacaactgtgtatcataaacttaccccagtcgactcaactccttacacattgtttcagactattattggcaatggttacccagtaagttcctggctgtatattggaccttttttttgtatggaa

SEQ ID NO: 102142 - DNA, 707 bp, Oryza sativa
aaaattacatatgtaatttagggacttacaatgtaaatacatgccaactactttttgatgaaaaatatggcgccataaatatagctacacccctaaaaaattgatatgcacgctgttctctctcgttctctctcaattgaaactaaaataaaaataaaatacaaaattacagtcctatataactaaaattacatttgtaaattcagttgatatgacatgtaagtgcactgtaattttgataacaatgttgtgtaagtaaatatttatttgttatttttttaatatataaaattacaatcctatataactaaaattacatttgtaaattcagttgatatggcatgtaagtgcattgtaattttgataaaagtattgtgtaactaaatatgcatttttattttcttttgtagtccgttggatgtaaatttaagggtagaacaaatctgggtgatttttttttagaaatcacccgacaaatagatagacaatccccatactcaaagaaatacttatgattttattgatacactaatttcagttttttttaaccaaagggctttactaaattcaattctatttgacttgtactagtatgtgcatcgtttcttttatgttcagctatcatgtaccatccacgtcaaattgtagacctcaaagactcaaacgtccttgtagtaaaaggaacgaatacgatggggctgcaggaa

SEQ ID NO: 102143 - DNA, 553 bp, Oryza sativa
taatcatatgttaatgaggtttctcgttttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaa

SEQ ID NO: 102144 - DNA, 673 bp, Oryza sativa
tggtgctgtatgcggcgataagctcgtccagaccttagaccttgtggtggacccagacgcccgtgtacgatcccatgactcctgatacacatatcctgggctacggaatgttcttttcgcatgaaaacagcgaccacacagaacacttattagagcgcatacaaaaattaataccacctatatcaaataactaattcactggagtaactactcgctccatttcatattatatcgcaatggaggtttatcttagagtcaaactttctcaagtctgaccaagctgaacaagaaaaagtggcaacatccacaaaatctctgtcaataaaagcatgaactccgtactacagtatgatctcttatgagtctctaaaaattatccaaacatactctcttaccgagcactacagttcacgaaccacacttgcacgttggccggctgaacagcttcttcaaaacccttgcggaagtcttatatgacaccataaacaaaaatattcccttcttacagcacacagggaactatgtgtaaataaagctgtcaaatagccgatgacacatagtagcgatgtacttatctgaatattgaatccatcaccaactggaaggctaaaaaactgagttcagacataccgattactgttaaaacacatcttgcttgacctttcataacttc

SEQ ID NO: 102145 - DNA, 668 bp, Oryza sativa
ctattgactgagagcgattgcccaaaactgtaggcgggccatgtgattttgaacgatgcgtgcgactgactaagctcaatgcaagatggtgaaaactgacctgatcactgaatacatcttgtcgaggaatcttgtaacaaaagtgccaaatcagtatgataaacgggagggcaggtttaacttgcagtgtcagggcaccggatatgtttaatatggctgtcaactgcactgatgactagagggtacaattcataagttgatcgtccacacaattagagaacagcgtggtgctatcaagcagtgagtaccatttcatggatgtgaatcgatggattctctctcaataatatatgcgggtcagtttctgctcatttacccaaagcagaacataggtcaaatttcaacataagacgcaacagagggtcgaaaggtggtggaaactcagcctgtatgatgtgcactaagtggaaggatagatgaataaaatccaaaagtacaatgaaactgctaaaagaataatacctccatttgcaacaatgtccacttccataccagcctgtcaagaaaaataaagaatgactaattaactaatacatagagacatatgcacatagagttggttcttcccaacacatagcatgtcccaatatcacaatttttttgccact

SEQ ID NO: 102146 - DNA, 749 bp, Oryza sativa
ttcctgcagcccttataaattttttttaaaaaatagtcacacaaaaagtactattcattttttattattttattaccaaggaaaggtattattcttaaaaaattttcacttaaaacaaacggccaaacgttggaaataaatagtgtaaaactatacttattttgggacggacggagtatatgtcaagagcgggggatacatgccatggcctgtgtacagccaagtagcagcaggatttgattgaggagagtgagatatatcctgccatgagaaccaacccccaggaagcaagagctaatggggatccaatgaagtgacagtgatcggggccgatgtatagaggagctttgggacttggtgtttggtatgacagcagcctaattttgacatttaacagccgctgtcaattcaatcacaaaattaacggagaatgttttgagcttttggtgcaagaatgggtgtggccccagttttttgttctctttttaccaagagcctcttcttagcggttgacaacactaactgggccgtcttatctgactcacattgtggcccgtttgttggagtactagcacagtagcaccagttcggcgatgtcatgatgtcagcgattgatgcagtaaaatgattcatacgcgtgactcatattgcttgttttcctcttattcttttcattgcagccatcaggttcagtcttcatctaccaacaagaccagtagtagtctttaagccgttccagtgggaaaaga

SEQ ID NO: 102147 - DNA, 700 bp, Oryza sativa
tgcttccccacccgtgtgatggatccgatcgccgtcccaggggagggggatacagagtgggacgccgtacgacgggacgattcctccggctgcgtccgacgggcgacggttcgtcttcttgctcctcgccgaggagtccaaccaccgcgactctcgtccttgtttggcaggccagaattccggcccattcattgtaagtggctgggattttaactaaaggaaatcccgtcctatatatgcacgtgcacgagctgggatttaggcccattcagaaatggcctgtgctgtatttttactgttttagtccacatggatggtctggcgtcctgggtatatcatcagagctttgtcgcattctttgcactgtcactccttgacgtacacaccttccttccatggcaagtacttgggatttgggtactggtgagcgtgggcagcagtgtgactttcggtcaacgggttgcacagcagatagctatgcagaatctcatgtcatcgtggttatgtgacgccatgtgatccccagagtttttatccgcttattgactgtgtcggcaacctctagcagtacatgcggcagccacttctctggccagttactctccgcctcaagccgaggacggtggcctcagcctccctcggggaccgatgcgcatccgagcgatggcaggtcatcgtacgacaaacgggctgcaggaat

SEQ ID NO: 102148 - DNA, 2082 bp, Oryza sativa
attgatataatcttgatcaaccttcacctcctggaagttgcagacgttgcctcacgactaaccgatacaaaaggtctataatacgcgagaaaaaccaatattcaaacaacaatcaaatatgcgcaacaaaatgtactattcgtgtttgctaatggatcccaatcatgctaggggctaaggtttcttaatctttctattgtcaacgtggcctatttaggagttaaccaacatagcatttatgggatacatatatatttggctaatcggtggtttagtctatcaaatggcttatggaaggattatggctaagcatgcatctatctaaataggacggtcatatactagaggttctgttgttagatggatttaggatcaatcaaataattacagtgaatcatttgtattatttattttattgatggaagctttactttaattatgaacatattttacttgtcacaataaattataaaaggttaataattatccatgctctatatgttaaattcgggaagtttataatattatagttacagattatctcttaatgaacaatccggagttacaattgaactatgaacatatgaggtcaagatttataattagtacttatctactattcatgtttgttatatactccccagtttaatatataaaaaagataaattaattgtgtaactataatgggatgtacaatatatgtgtgcaacagcatataaggtttggtcgcctactgtacatgagcttatttagaaagtgtactacccaatgctctaagtgattcctgaatatattgtagtttaattatatattagctagtttctatgagtgatattgtatatgtgatgcgacaagtttaagcactggttctattgggttactaataagtggtaatcaatttaggcatatataagctattctatatggtattgcatcgattaatttacttagtgattcctccacatctagctctgttattattttcctaaacaggttaaagattcatctatgtgtgtttatattttagttacataatcataaggctatacttgatttaaataacctataagccatggccatcgaatattaaataagtactagtattttcctgtacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaattagtgaattatatatcattggaaagcttatgaatttagatgaatttaggttcaagtttcactcaaattggagctaaatatcgaacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtctagttattaattacatctaaattactaccgcgaattgatttctcatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctcttttcccttttctttttctctttttctctcttttccttttcttttctttctcttttcccttttctttttctctttttctctcttttccttttcttttctttctctcctctctttctttttccctttcttctctccctcccggctcctttctctcttactcggcttctccctccctcggtatcttttcttcttcctctctttctctcggctctctgtctctcggctctccctcctacccgagcggtggcggcggtggacgcgagggggaaggagggcggctcaccgacggcagcagcggcga

SEQ ID NO: 102149 - DNA, 1460 bp, Oryza sativa
atttcttttgagcttttcggatgggctattcccttgattaatgagcacaaattctgatcttctaagtagtgaatttttttagagtaaattgcagtttgtgtcatgtattattacccttgttgcagcttagacagggtcttagccaggattttcactttggaccacataaccttgccatttgtttcactccacaccaccccctcatcttctccaagtcaggcagcccatcgccgttgcccctttctttgctgctattatcctctctcccaacctattttcgttatgctatcactgatcaagaggaggtagaagtacgactgcttcccagactctagtcaccctatccaatctagagggaggagtagcagatcatcacaggttcagcaccgcttcaggtgctcaagctgagatgaagcacatggtgatagagctgaagttgctggtgcctgagctcgagcttgggagcagtacaacagcgcttcgtcagctagggactagaataggcaatgtttcttgggctcaaatatatgtaggttgctttcaccagggaactcagtcccaaacacagatggagaagatgaagacttcagtatgctaatgaccaaattaaactaatcatatcacctcacctggcatgctaattttagctaccaaacacaagggagtataaagtgaaaatattacttgttcctagtccagtgtgtaactttggtaataaaaggtagcccaatgtgcaattcacttatttttttttaaaaaaataactctctatgcaaaagtttttctttaaaaaaatcaaatatatatatttttagatttctgataattaacatttaattaatcatgcactagttaccgcaatgttttccatgccggaaaagcccaaaacttcccaaaggaacgcaatatactttggaacttactccattccttttatattgtaagtaactttgatttataagaaaatatagcaacattttaaaaaaaacatagaattaaaatatattaaatgtgatatttaataaacctaatttgatgttgtgtatatataagttactcaataaatatggttaaacctctaaagaagtttgaataaaaacaaaagggtgaatagccaacatggtccctgaagtttcgctttaggccgaagtttcgctttaggctcaatttatttctcgatatttcaaatcgtccaaacaaatcctctaaattaattatttgggttaatatagtccttggacccacaaaaaatgccaagtgagcatgccaattgcgaagtcatcctcgcatgcaacagcatggataaaatgaccattcttcccttatataacatatagaaaagaaagaaaagacataaacagaaaaaaataacaggctagcttagggtcaacattgttgcggagggtggccgacaaaggaatttacacgatcactgcatggctgcagcaatcgtaagtgac

SEQ ID NO: 102150 - DNA, 1291 bp, Oryza sativa
atcacgtataatgttggtttattttgggacggagagagtacagggaacacatagcaacaaggtttcagagttttttgtggagcaaaacaccgattgagatcctatgctcaaagtcaaatcactttgagtcactgaacatgtcagtgactctaaaaacacattacttaagttagaggataattcgtgaaacacgtactatcgtaataatttgatctgagccttgatcatgactcggacgattacgacataatgtgtcctaatgcaccttattggtatcctcctctacagtacagtttatacgcttagggcatgtataaaggtagagcttagaatggtctctttgttaatacatatcacttagagactattctcctacaatagttaagataacaaaaactcttaaccattaatgcaccaaaatattttttttagtaccattctttccttttctccacctccatgcaacaaaatttcctttaataaacgttaagagtcgactctgacccgttgtcatgcgtagcaaccatgtttccctttactccactctctctcttccacgtcatcaattttacttacatggaaacgaagagagaccgttattacacaccgttgtacatgcacttagggtgagtttgaggaaaaggtgattgaggagattgggaagtttatgcacttagggtgagtttgaggagaaggtgatcgaggagattgggaagatacgcaaaacgaggtgagccattagctcatgattaattgagtattaattattttaaattttaaaaatagattaatatgattttttaaagcaaattttctataggaaatttttgtaaaaaacacaccgtttagtagtttggaaagcgtgcgcgcggaaaatgagttgttatctccctcaatgttacccgaacgaacgtagccttagggtgtgtttgaggagaaggggattggggagattgggaagatacgtaaaacgagatgagtcattagcatatgattaattgagtattaactattttaaacttcaaaaatggattaatatgattttttaaagcaacttttttatagaaatttttttttgtaaaaaacacaccgtttattagtttgagaagcgtgcgtgcagaaaacgagatgcttttctccctcaatcccccagatcgcccaggaacgaacgaagccttagagtcgctgacatatatgctcatgagtttcccatgagaaagtggatcctacatgttaggcgtgatagtatgtcactgcgaaggatctcgtttcaacaaaattgagtttcgct

SEQ ID NO: 102151 - DNA, 754 bp, Oryza sativa
cctgcagcccgacaaatctgaagtctttcaggacaatcatttttttttccttttgagaatcaagagcttaatatgaattaatcaagttacatttgaaattcagtccctaattcttctgggataaactacttcctctaagtttctgttaaattcaatcatatgttcgaaatggagcctcagataagataagagaagtaaatttgtatgttacaaaaattagcattttgatgtgtttgctgaaagcatgcccaaaataaacctaaaaaaatatttctaaaattctgccccagctaccgcacatcgtaggacaatcgctctcccatgcacgaactttttgggatcaacgaaatgggagcccatggtcctcctaacttgtggagagggagaaacatgggattggggtttcttttctaaagaaattttaaaaaatctggattgatggcctactggatccatttttccctaaaaagtctaatatcgtaggatttatattattcttcttctaccttatagttcaccaactatagttctatacaaacctcattcatcatctatctatcctatacatcaccaactgcagtactacaaacctcattcatcatctatcttatatacctatagttcaccaactgtagtcgtacaaacatcaaatctaacagcctatctacgttgcctatttggcacagctccagctccaacaccacggccacctctcttagagctagagtctagctaaacagtttcagcttcatca

SEQ ID NO: 102152 - DNA, 651 bp, Oryza sativa
gatttgacaggcccaatcatcaagacgacgtgtgcttagcttcccaaccacagagacaagacatgcatttaatgcaaagattataatacttctccaccggagctaggttaggttgttgtgcccatgtggtaaccccttgaggtataaaaggagggccaggcctagtggtggagggggaacttccgagcgaactagcgcttgggtctcgcaaccccaagcacttgtgttctacattcaatcaatcatgcacaggagtagggcattacgcttcttagcggcccgaacctgtataaacctcttttgtctcatcgtcttgggggggctaaccccctcaagatcacacagctctgctcaccaagccctcgaatctcacccgctgcccccggccgaactcacaaaggggggcctcacggttccctgatggaggagttcattctccgacatctggcgcgccaggtaggggacacgttcgtgatttttgaggttctttcgagcgccggcgtggtgagtgtcgcgccgccgctactggggaaggcgcagtatcctcaggagtgtcgcgccaccccaggcagggggcaaggccccccacatccccaccaggtaagcttggctaccaggtctttgtggcgagtcttcggaatgtccgagggc

SEQ ID NO: 102153 - DNA, 725 bp, Oryza sativa
caaaatcacaattaattaacgccttgattaattgcatggattaaagcagtttttagtggcaactgggtgccagcctcatgattagtgatgaacaggtgccgctttggaagcttcaatatccacaagggttaaaagaagacgctggatttataacccgttcttatcatgcgaccgtaattagccgtgtgccgaccttgttaataatcacccaaatagctagccccacaatgccccatgacaaacatgtgcgctatctctgtgttcatcatatatcagccgaacggctcgtatagtataatgcacgcatgtgtgaagatgcctccagccagacaggtacaacaacacagaagaataataccgatatgtacaagttttaattaacgtaacagtgcattgatttattcctcctcaaatgacaacggtagtcgtgggcacacaaagctctaccccgtttaaaatcgtggtgttagtatactcgcgcgagtgcactgtaaataaaaatttaataaagctcaggacatatcgttgattcctatctcgttgagttgatgtaaaggactgtactcgtgtactccatctgttctaaaataaatccaatcctattgatgaatgtcatttatccttaggattagatttattttggttcagagggactactcacagacatatagtaagtgtgatgtgtgtgcgtggtggtggagtgcgtgcagaaaaaaaatgtccat

SEQ ID NO: 102154 - DNA, 709 bp, Oryza sativa
attatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttataggggataacttat

SEQ ID NO: 102155 - DNA, 1291 bp, Oryza sativa
tagtttaacgaaacatttcactacataatatttttgtagataaatattctttttaagtttctagtgaatttatcaataatttctattgaaagaactagctgcatgctgtgaaggattgtcactggcagctcgttgggttcagggactaataatagttgaatacttgaatcagatagcttgttgtgcaagctttgaagtcaatggctggaatgcacaagacctagtgacagtattgggcgatatcgactttgtcaatattgagggggagctaaatagagtagcacataaactagctaattttgctaagagtgatttaggtacagcggtttggttgggtaatattccaccggttattgcatctttagttattggtgaatgtaattaggcatccttagttgagtaataaagatgtccctttcttcagaaaaaaaaaacagaagaaaatgtagcctgccctcatgtaccggtagatatgcaaaaaaaaatatatggagtatagtaataggagtgtgtatgtttatatggtcattatcgcaaggctagcttaattgtattattttcaattacatgattattagtaagtgttaactactttctccgtctcatattaagttcattttagctcatttcatttgtcccaaaataagtctatttttaagtaattattacatcggagtttgtaaaagtagagaataattgtattgcgagtagataaagtgagaaatagttgcattggatttaataaattaggggtatattattttttttattggtatgtgtgggatgggtgcaaagttaacttattttaggacacaagtagtagaactagtatataaatctacaacggtctgattttacactaagaagcgcgctacattacaagaaacaaaaatcacaagtagtacgtacttaatcgaaattctatgcgagaagttatcttatattactgaaagaaatttatagctaacaattcacagtcgtgggaatatacgaacatttcaatatactatcaaaaatataaacgtccacgtcctaaatatcatgattcttaaacaagcacagcaaaatgaatgtgactatccgtagctagagttttatatgaaatcgaaatatacaacatactcctatattcccagaaaagatatgatgaagtgcaagtttattacattggtagttcggccaaaatttaatacttgcatctaaaacaaaataagctagctgaacaaaagcaactataagctaatcaagtagccttgacaacggcgacatgacccaattcaacttgtcgaaa

SEQ ID NO: 102156 - DNA, 653 bp, Oryza sativa
aaatcaatacaatatattctaactttacaaatgagaagcatgttttagcaaggaaggaaaacagtgcctagtcataaacgttgtttggttgtttcctggactatgaaatcagtttctgtacaacgattttcaatatatttttcatataatcctgtttggtacttgcaaccgaccaaagtataactaaaaccaaatttgtagaaaaatcagaatattgtggttaaagcttttaacaaaattaatgctagaagcttttaacagaaagtgcaaatccaatccttgtactggctggctaaacattagatcatgaggacaatcatttcagcattgacagtttccaccactgtacatactgtttcacattaaatatgatgatccctgaagaagaaagcacgacattgaagtggacattgttgtgtccgcatctagtattaatttttttttcgcgaacacgcaaaaggattgcacgtaaatatattagaagggaaaagaggttttttacacaacgcaatcaagtgtccgcatctagtagacgatttcaaaacgtgggaaccaaagctctcattgccagtgcgtgccttactgtttatggcgttatttctgcgggaattcatcaaaactaatctaacaattccactgttgaaggattctga

SEQ ID NO: 102157 - DNA, 626 bp, Oryza sativa
tataaccatatcaagttagatcagtatcggttgggttatctaaattattaactgatcatgatttgatatgtttatatagattgatttgtttatataagtttgtactagagtattagctggtatattatctttatctatctatcttgttctaaatattgtttcatcgactattcatatagtatcgtccgactcatacttgacaaactcatttgatgatactacagccgatgaggcatatttaaggtttatgcttaattcatacatcaatccatagccgatctggtccaactatatcagctaggatcactaacgatatgtcatcggcctatcagccgatcagctatcggcaactttgcttgttgtttccttgctggttgcagaatcaaaccagctggcacgcccttagcacactcgaggcaagctttgcacctgcactggagttaagcagatctcccaagccactgtgtttctcgtcaacagctagagatattggataagctatagctatgttatggtgtgtaaaactgtagttgctgttgtcaccctctcgagtaacgttagttcgttgagaacttggaacaccatgatccttgtccttagtagcgtaagtgaagttagcctcatct

SEQ ID NO: 102158 - DNA, 515 bp, Oryza sativa
tgcctcatacctttgttcgacagcatagtactttgcctttgtttctccctaaatcttaataaatttggtgggcctaatcctttggccaacctggcaaatcatttcagtaataaaaaaatgtgttttcctggtcagattgatatatatgtatgatttctactaggctgaaactcttggcttggagaaactttgttgcatactgtagcaggagctgcagcagattgaaaattgatggtatcaaaggttcttaataatacaagcaataagttgtcaaagaatcattgtttgattttgtagtaccaaaattccaatcacacttagtggctaatctttttattttgactaaatgccacatgttagcagcagtagcagaatttttttattttggtttcaggttttagaactgatgttatttgttgctccaaataatccaccgatattgtcaggtgggagctatttgacttgtgtggctagaagtattcgagtcaatcatctgcttgcctcggcctacttca

SEQ ID NO: 102159 - DNA, 1441 bp, Oryza sativa
ctcgtgatgaaaaacaatattcttataactctggacttaaaaaacttataccctccatcaccacatttatttaaggattctagtttgttttagaaaaaaactaatgatagaaaaaataattaagtcgcccttattaatgtattaaatagaactggaggtacctaatgggataaatagtactccttaatccattatatttgacataaattttgaatgtcccaatcctttacatctacgtatggaaagagtaacttagtaatttatttacccgaatattggttctctcagtagatcctccctaccatccaaatgcaaaaaaaatatttagtctcaagctattttggcattaaaaactggtgtcaggcgcccaatgggggttggaaaaaacgggcgcccacgttagcatgacatcaacatgcaaactactttaaactattttttctcttaaattatttatccaaatcatgatccgattgcactattaaatttgttgcaattaaatctttaaaacaagaccacacatgtatatattctgatgaaaaagaagcttattattgaattatttttaaatgttgcacgctgttccaccaagtatatcggaattgtttactaagtagatcgaaaatgtttcaatcgtttaaatctgacgctgtttcaccttatataaaatcaatgtttcagcaaatagtgaaagaatgtttcaattcactgcaacatttgatccatacatagtgaaacattataaatacactaggtgaaacatttttggtggaacaacaaatgaaacgaattcccttaataaagggtttccataatatgtggctgatttgttgcaacaaaatgtttcaattcactgcaacatttgatctatacataatgaaacattgtgagtgcactaggtaaatcatttttggtggaacaacaaatgaaacaaattcccttaatagaggcttaatagagggtttctaaaatatgtgggtgatttgttgcaacggagtatatggtggagacacatggaagttggtggcacggacacgtggtggggcccaggagcacgtgcacgtctggggagagcacccgattttgctctccccccgccggtcgcccgaggtaagaggattctcgttaaaaactatgtcagtaatgtattaaactgaattggttgtcttgctagaatcttagtaaaaatggtacactactaatagcttatttcacacgataataactcttctttacaataatattaaaatagagtttctatgataatattttttttataccagatggggtgaaagtaattttttttaatcataagaagagggagtagggggatggttaatttacctaatgtaaacaatatgttgatctcttataaacatgtacattttggcagtggcgatcctaggtacattttcccggtgtcctcagaccccggataaat

SEQ ID NO: 102160 - DNA, 642 bp, Oryza sativa
tggcgcaggaggaggcgttggtggtgtcgccgcggcagagcgcgagggcgtagatggcgtcggggggtgcgcccgaggagccggaggcgaagagggagggggaggaagaggcgtacgccgggagggaggtggccaggtactgtatgttggattggtacgtgctgttcgccgtgtagttgccgctgctcgtgttgcagcgatgccatggcatgggctgcgcgtcggtggcgtgaggcgcgttgaggaacacgccgacgaggcatgctgcggcggcgaggtagaagtacgccatgtaggtggtgcatgtagctagcttgacgaagggtgggcgagcttggacgaagttggcaggtctagtagggagagctagcgccatattgttgtgtttgtacatacggcgttcgtgaaaagaaaatttttcgtgtgtcacatcggatatttaacttgatgtcggaagggttttcggacacgaatgaaaaaactaatttcataacttgcctggaaaccgcgagacaaatcttttgagcacacatgtaggttactgtagcacttatggccaattatggactaattaggctcaaaagattcgtctcgcgatttcccccctaactgtgggtaccgagctcgaattcgccctatagt

SEQ ID NO: 102161 - DNA, 540 bp, Oryza sativa
tccgcgtcgtttgagaagcactcacttagttgtttttagaaaagggtccaaataaaaatcaattgcaaaaacaacagcctttccttgaagcctgcattaaacacctatttcccatggcttgctgagtactcccgtactcacccttgctctatataaataatcccccccccccagttgctgaagaagatgaagcggaaccggctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtcttcctgtgataccagcactgtttcctaggactggtatcgaataacaggttaatttggagcgtcacgggctagttccggtcaggactagttcggggcgtgacaagagatggtatcagagcataggcttgg

SEQ ID NO: 102162 - DNA, 1214 bp, Oryza sativa
cggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcacagctcagctctctcttgcctaggaaattcttggactaggagatgtgtttacggtgcagttggcacatgcgttcagttgtcaacgcacctaaactcttcacctttcgtctggatcaaatgaaggattgaaaatatgtgactcttcctatcttaattccatcggttggctagctccttctagccaacatatttttaaaaaaaaaaaattcttggactggcgttcccagccttgagtacactgaatcgcatagaaagtactcatctcatattttcatgtcatgtagcatcaaatcctctctatgactttatggatctacggtttttgtttaggtttcctgttggtacttaattagagttgtttcttgcatattttacttcagattcagtcaagattcgaagagatcttatgtgataattaacaggtctgatgaccttgctcccagttttgtttttgtgtaatccgtttactgaaaagtaatgcatggtggatgaattgttgcaagaaagcatgctaaatacgcactgtactgtgcagaagttctgcagtgcaggacattcctgccgctagtcgtgccttggacagccagagctctcgaattctcagccttaagtacattggatcacatacaaggtactcacctcatgccatgtatcatcaatcctctttatggacctggagttaggtgcaccttatcagcttaagctctcaaggttggcctgctcctcatcactttctatcttctatatatgctgtgcatgttaatttcgatggtttgtctcgtgcaggtctggcttcttggagtccatatgggcctcgtgccattctctctttgcactgaggtctgctgagcgcctggatgcttatagcatactctctctctctctctctacttgtcaacactgaaatatgttttctcgggacctgacgagccccaagactatgatcttacgaattccaatgaattt

SEQ ID NO: 102163 - DNA, 545 bp, Oryza sativa
  unsure (1)..(545): unsure at all n locations
tttaccttgnattttagcaaaaaatcgccccccttgccctcccaaccgatttgtgaacagtacaatggtcgggatggaaagcagttggcagtttgggggtatttatagatccaacacacctcaaacgggttagataaaaaaagcccgtcaaaggtattgctcatacctttgacgggcttctattcaacggcccgtcactggtatccgctcacctgtgacgggccagaaatgaaagccgtcacaggtgaggggataccagtgacgggttggaagcaaaactcgtcactggtatacctctgacgggttttcctttcggcccgtcacaggtgaggggatacctgtgacgggccgtngcctggtggctcgcccgtgaccttatcccgtctgacccgtcacaggtaatggtcactagtgaccaaatcgtttgcccgtcacaggtatcccgtcagaggtgtgaggatctggcgtactgctggtgtctgccgtccagaagagccgtctcagcgtgcacctgtggacgcggcgcggctgcggcggccatggag

SEQ ID NO: 102164 - DNA, 517 bp, Oryza sativa
ggtggactggcgctgagtttcccacagtcagcgccattatggctggcgctgagatcccagcccgcaagccatccaggaggcttgctggtctgggcctgggggttgcggccaagtcccacctcagcgccagtccggttggcgctgaggttgggcacctccgcgccgaagcggttggcgctgatgtagctgccacgtcagctaggggatcggcccggccgccacggtggcacaatgtcagcgccagtcccgttggcgctgacacgaccaacgtcagcgccaatgtgtttggcgctgagggacggcctatttttggttgaagtttttggcaggggttagtttcgaagtaagttttccaaaagggtcaatttgtcaaaaaaacggtcgctaccaactaccaagccaggaatgccactgcaaacaaattaaagcacacgttgcaacgagaccaaccctttcagcatcaagtactgagttcagtttcaaaaaaaaaagtgcttcctccgtttcacaatgtaag

SEQ ID NO: 102165 - DNA, 540 bp, Oryza sativa
agttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttagctccattttagatttctgatgtcataaaccaatccacatcccttcaccttatctcacatcaca

SEQ ID NO: 102166 - DNA, 608 bp, Oryza sativa
ttgaaatttcagcttttacctgttttcatggatgctatcttttacttctgaatcatgcctaaccgaaaccctttttactatactcaatatgcagcatttaccaaagtgcagttggttaactactgtttgtgttgatcgaagattcattaagttgtaaatattgatgttacctatattattaatattgctttaaagaacaatataggaaaatatgaaaccaatatttccattacttgcaggttctttggaaaggtctagggcttgatgaaggaaatactgttggaagttggcaggggtatgttcacatatgttcttatcctttgtggaattttataatcgttgtggtaggttagagaccttttcattttggttttgtggagttgagattaagaagactatagtaagttgcaactgaaaattctgaactcactagccagctactagggtaattgagtactagtctaatttgttatatggaaattgacacacttaaaatttggtcaaacggaatgtttatatactacacggtgattatgtttctaaaatgtttcgacaataaagcaacctaggttcccattgtcattagtattactacaatgcataacaaa

SEQ ID NO: 102167 - DNA, 546 bp, Oryza sativa
  unsure (1)..(546): unsure at all n locations
tcttatggaagaaattgcaaagcaagaacgtagggtgggcataatataatatttggaaaacatgaccatgaatgaagtagatacaattaaacattaccgattgtattgttgatatttttcttaatagaggattcatataggaggnnnnnnnnnnnnnnnnnnnnnnntggatggccatggcgactgaccttagcagtagcccagagctgctgctacaacgacagtatctaatctactaatagcaatgatctgcaaccggagtattcagaaataaaacaaattaaggtgcagcaatacataaaaccggtatatgcatatatatgatctttagagtcgtcatataataccatgatcatgaatcgcctcctttaacaaattgtacatactaaataaatttcaatgttgttgaatagggacagtataaatctgaagaagaaacaaatccaaataaatgtcagtcgtgttgaatagggacggtagaaatctgaagtgacaaatccaaataaaattcaatcctattgaatagggaccgttcaaatctgaaga

SEQ ID NO: 102168 - DNA, 922 bp, Oryza sativa
tatcaaaaataaactttttagatttagaaatatgactatcaaaagtagatggagggagtatttagtattttgttggaagaaatataaacggaatgcccgacaaaggtgaagtttgagatacaaatatctcaaatagttatagcaatgtaagagagaataattttgattattattgacctttcttcagttaaaatggtctacatgtgaggtaatctatgttttatgattaatgtaaaaaatccataaacatagtgcaatcccttactaacttattggatcaacatcgctcaatcccttaccatcctataccataaagtaaattgaaagccaaaaaattaaacattttctatctttggaaaaagtatagctaccatatctaaacaaagcatcagaaactctcttaatttttttttcttgaggatactaatcattagggcagagagattgtatcgatagaaacataaatgatgaatcccctattatgttcaattgtgtgctattacaaagagcatcctttatattctactaagaaagaagggaaagataagaattaagttacatccatcacaaactgtagcttattaacccgtatgttaagtaagaacatcatatagcaaagaaggttagcatggacagatgcaaggtgcatccaccataggatgcaaagggcgttgcccttcatctaaaaaaaatgaacagatccaaggaccaatatttacctaaattaagttcattgctgaactcagtccctgatagtctgcagaaaatatgatattgttttgttcttatggaagaaattgcaaagcaagtaacgtagggtgggcataatataatatttggaaaacatgaccatgaatgaagtagatacaattaaacattccgattgtattgttgatatttttcttaatagaggattcatata

SEQ ID NO: 102169 - DNA, 1141 bp, Oryza sativa
cccctccgggtttcgaggctgaacccgatgagcccgaggaggaagagatagaggatccatttgttggggtgcctcctgattatgatttctttggttatggccatggctatggctatccccctccgcctcctccagaggatcctcctcaggcgccccttgcttgagtctgtgtctcttcgtcctctctttttggtgtcttgatgccaaagggggagactatctatcatctctatccttatgttggtcgaacattagtggctttttatttgtatgagacttgtgtgtttcttaagttagtttaatgctttgtaagactttattgtttaattatagatgatgggatgtaatggatattatggtgccttatgtttaatgtgatgtcatgtctcttttattctatattgtggttgtgatgagatgatgatgtatttgttgcaatggtctattctctccatgttgtgttggtgttgagatgaaatgattactttgtttaaatgcgattctgatatgatgaattgatccttcatgcatatattgtgatgatacttgttgttttgtgagcttcaatgtggatgcaaagatttagggggagctctccacttgcttttatgcacactcttagggggagctttcactaaacctttgcaccaaaatcatctaatattattattctctcttgtgatttaatcgaattgtcatcaatcaccaaaaagggggagattgaaagtgcatctaggcccctaatgattttgatgattgattacaatgcgattagagaggactaacatttttattcaagcaaatgtgaatgttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgtatagacatataaggagtgatgtgtgtgctcaaaatcaatttttcttcgaagcatttctcttttggagtgttctggaaattttcggaagttccgaaaatagttttcggaagttccgaaaatacacagaatcgtgtttgagtgttctggaaatttttggaagttccgaaaagaaaatttccaaaata

SEQ ID NO: 102170 - DNA, 1024 bp, Oryza sativa
tagttaaagatacaataaaattaaatccttacttaggggtcaagttgtaccatctatataaggatgggattttatctatccttagggatcaagttgtaccaaggatgggattttatctatccttataaggatgggatttatctatccttacttaggggtcaagttgtaccatctatcaattaagcaatgaatatcaattagtctaatctctcccccccaataatgttcttctccctagcctaaatctacatcccttctccaggagccgacgccgcccggctatcttcccggcggtgtttatcccgtcatggcctctggtcatgacaatggactacaaaaatacccacccacagataaatttcatcgagatcaatatcatagctctgagtttggtgttagcgaccaattttatttggacccaaccaccaaccatatatctacaggactgtactacagacatacaattagattgaaatttacaattatcaacacaatagtttagacttcttgctacagttcagtacataagtcaaatgattctcatacaatatggaaaaagtttgaaatattcaatgtgcattgttttattaggcaggcatctcctttacagaaggatgagatacattgcaggcaatgcatcaatagaagctgtcttaactaataagccataaattcacatcagtgcttacatgacaatatccatatggcgaggagcatagtgaccacctcctataccaagtagaactttttcactattactgcatcgcaagaaataaggcttagtgcttaaaacggaaacaagaataaggaaaggatacttacttagaaggaaaacaaacatcaccatatcagatactccctccatcccaaacacaagtttatttctaggctctaccatttatcccaaagtaaattcatttctatcaccttatccacccttggtcaccacaaaatgaggagttttatcctttcaataccccttaccttcccacccaccaattctattttcctattaatgagggca

SEQ ID NO: 102171 - DNA, 666 bp, Oryza sativa
aaggtttataaaaagaaaatcttaacagaagttctttccccccccttttctcttcttgggccggctcggcccaatccctccctctctctctctcttcccccacggcccatcggctcctccccgcgcgcgcgccgctgacgggcgggcccgcccgcctgccctcgctgacgggtggggcccacccgtcgtcttcctcctcccgccgcgcccgccgccgcgcccgtgccctagcgccgccgccgccgccaaatccgctcgctcccgccgtccccgcgcgcattaaagagaggggaatcactccccgtgattccctctcccgtttcccccgcttttccctctctctctccctcggattcgtccgatttccttcccgaaaccctcgccggcgcaatcaatggcggccggatcctccgcgaccgattcctccctctccggccgctctttcccttccccggcgctatgtaaaccctccccgtgctccgctcttccgtttccgccgctcaccgctcgctctcgccgtcggattcgtgctcgcgccgtgctccgccctctccgccatcgccgccgagttccgttccgccgccgtcgccactccgggcttcctcccggctcggcgccacctccctcggcatcgccgcatccccgtcgaccccgtccgccgctccg

SEQ ID NO: 102172 - DNA, 618 bp, Oryza sativa
ccccccccccgcccgtgttgcgcccgtgctcgcgctgacgacgcgcgcccgaccgcgtggggcccacgcgtcaggccgccgtcgccttcttcctccagccgccgcccggcttccctctctcccgtgaaccctactccttccctccctcaaatccgtgtgattcgctcatgggattccaaaattaaataggggaaattaatccccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttatctcgttttagccccatcccgagcctccccgtggtccctagctctctccccgccgccctcctctctctcccacgctgccggccgcctccagccgcctgtgccgcctcgaccgtgcgccggccggccgcgccgtcgcctcctccagcgtcgccgctaccccctccaccccggcctgccctccgtttcccgcggagacccccggagctacgtttccgccgtcggcctttccttt

SEQ ID NO: 102173 - DNA, 515 bp, Oryza sativa
acattgtgaaacggaggaagtaataatttgctgactttataagtttctgagcctacaaaacaaagaaggcttattcttctagatcaagtatatgacttacgatccatgctatccatacattgtatttagttttagcttaaacatggacttaagatttaactattcaaagacaatattttgtttagttaatcatgtcagtcagaaagcgtgttatgctcttttgcttatgtgtattgctacagtaaaaattctgtttaaaacatgttctatattgtgaaaagtcggaaatgcaacataggcatacgagccatgcatgatactcttatgactatttatttctttgtccacgaaaccaacttcaacgagaattacgggtaaacaagatatacaagccatacatgatacacatctaaccaactctaactacatgcatgtcaagagttctagttgagtctcaaaagtaccaagattcaactcagattccccactacaactagaacaaaaactttacattg

SEQ ID NO: 102174 - DNA, 660 bp, Oryza sativa
  unsure (1)..(660): unsure at all n locations
taaattttgtgaaaaagaacatgcattgtactccaaatgtctgatcgcaacattcgtcactaaataaaaatcatttgtaaatttgtcatagcacagtagaaaagtcatattaaagaatgaatgcatccttattgaaatcacagcgatgtaataatcttttcgtgcatggcatagatgtgtagatcatgaaatgattgcagttacttcttgttacatgtcccagcacagnagaaagatgagtagcaaaaactaatccagaaagaaaaattctaaaatcaagttttcctaatagacgcacacttatgaaaaacctcacgagcaaactaccgaacacggacgtagcgggcttaaacataagcgtgaccaaggcactaccttttctgtcttatatactccctccgttgagtttcatttaaaaatttaatacaaatatgaaagtatataattactagaaaaatgcccgtgcgttgcaacgggtgaaaataatctatctattaaactataaagatagcttaaaaatgacacgatatttgctttgaccacattgaaattgttacattaattaatagaaaaagataatagttgtatatacattatagaatgattgtatttatagtaaatgtcacaaaactaaaattatttggttaaatccaattatgt

SEQ ID NO: 102175 - DNA, 893 bp, Oryza sativa
tgttgttcttataaaccgggactaaaaatcgtttttagtcccggttttaaatggaaccgggactatcgtagatttgggtcgaccgatcaaagatggtttctccatcagtgatattttgggatggatgtagtatatttgatagagcctggggtgaaaggatgctagctagctaagagctagcttcatcatcgcatgaaacgaagagaaactaagaaaaatgcagtaacaatgacaatatgtacactcacctgtcactacaagtctacaacacgaaaaaagcctacagcaacgcttgtcttgcaacgtaatcagaaacgttgttgggcttgcaagtcgcaattgatgcataggctgcatgcctagctaccttctctctgcaagttctgattggaaaaactggcatccccaaaactctactcactgatctccctctgctgccttcttctcccactgcgcattctcccacggcatatgggatggaatatatcttaatttggcctataactttgtcagtgtaaagctcagatgaagcggtgagcgagctcctctagatgtttactcaatgagattgcatgtggtttgcattgtctctgctaattgggttgagatgtgtattgtcttgggttgagttccggtcctttctctctgggagacaagttaggatacgaatttgagcagacctgatcgtgcgctattaggactttgtcttcctttcacagtcgaggatgttttccttatctatgcaagactatttttatcttggagttctgttttcgtgtaggacatggtatatgcatcgaggtatgtgcatattgttggcaacctttggtgacaaattgacaagcacgatcgtagcaccttaagccttgcggtgattctagagtcgccaacca

SEQ ID NO: 102176 - DNA, 667 bp, Oryza sativa
tcctgcagcccgggttgcatgtgtgcactgagactgcttgcgtgtcccgccgcaaaaatcattggccagcccgattttgtgatggtccaaccggccggcgtcaaaaatatcgcggccctcgccagcgttgatccaagccgaaaagtgagtcagggctagcggctcactaataattaactgcaggtgatgagttaattaatcattgggttgccctgttaggatgttactactagtagtattgtactcgttacatcctaaaatatactacatcacttaattaatagcgataattattttaaaagggaggtggtagacttgtatgcaatggttgcaggtaggagtagcacgttgttggtggaccggtgcggagcccacactcgcgcgaacgaatgtatgagagaaatgggaatatgtgtattttgaaataaattggaatatgcgtcgcgatcgggggtccgtatcgtgaggcggtgagcgaatgaattctcgcggcctcccagagcggcggatgggtacggacaagaagcaggaactaagcagtgacatcacctcaccacccatcccctctctatctctctctgaatgcttccgaatccgcacgaatttacagtccaaactccaaacattgtgtatcaaccgagatttgacccctaatttttacaggatc

SEQ ID NO: 102177 - DNA, 533 bp, Oryza sativa
ttttcctgcttttcaactttctaggacagcatctctactttcagtttggatgctctaggacagttaggacaacagtttgttgaaatgctctaagacagtttggtggggtgctctgctctaggacagtttggtgggatgctttgttttagaacagttggtggggatgctctacgacagcaccctcttagactggcatggctgcatggctgctacaagcagctataaatatgtatccaatcctctttggaaggacatggcttttgtgtttagtaaatgaagaaaaccagaaaattgccccatctcgagtgccatcctcttctcaatgagagtaaccattgaaattctaacagcatcagcgacaggttccacatgagaaaggctctccactctctgttagcccaagctttgctcctcaaacaccggccctctctaatgatcaaacctgtaacatatggtgatcgttaatactgcagaaaagaaaagcaatggtggctccagaatgaatcaactatatgaaaggcttttcaccatgt

SEQ ID NO: 102178 - DNA, 636 bp, Oryza sativa
ccgggacaattgtgattttggataccacgggaaaagatcagttctccactagtgaatgctctattcactaatgttgaaggtgacaaaaataggctaaaactgtcatgccaagggttccttgctacaataaaacaaaagcaaatgcagatgatgaattagcagtggaaacctcataacaaaagaaccttggaagtgcacgtagagtgcaccattccagtactccgcacgtataaatcgcggtccccaagacatcatgtctggtgaatccaacagcacctctaatgatgtccctgccatgttggtggcgtggccttcatggagaaaagccttatcctcccacctcccagtcctcgacgagaatacccacaatgtgtgcacagacggtggccattccgctgtagcgtccttacccacgagtggacctttgtggcacttcttcttggtaggaatttcaggcaaatcagggatcaggaacacctcatagtgcagagactctgcagggtcgaagacgaggtactcagcactaatgcatagactatcatattctgtgaacggtggaagctggacccatcgatgcgtcgcggggttgcagacaaatagcttatattgttctgagattttgccgtggtacaggat

SEQ ID NO: 102179 - DNA, 757 bp, Oryza sativa
cctgcagcccgatgaaatcactgatactagaggcacgcttttcaaactggtaaaccgtgcgttgcatgctaaaatggtgtatatgagagctcttataaaatataacattaatctatgttcttatagtgtgaaataattaaaactcaattagtcacacgatattaccgcctcgttccacgtgagacacttaatctgtatctacatgattgatcttcacgagattcgggagattaatcgtactggacttggctgagtttggattgaattggaatccaaaaattattcgatttgtttaatccacaaatccaagaaaaagttggatttccaattggagggggcaaaatataaaaatccactgtccctggtttaatgtacgagatcgaacaggcgtctcctcctcctcggcggcgacgctcaccatcttcccccgcaaccaccgccgcgcggccgacgatcgactctgctctcaacgcacccgaagttagtatccatcaggttcaccccgcgctttctcctcctacgccgcctccgcctgcgacgcctgaagaagagctagcttgcctctttacccccagatttgatccgagcctcccaacctgctctgatcgatcgattgttggaaatctcgcacgcggtgatggtgtacaataagaagaatacaacagcgtcgaggcacaccacggagtcagaggaaggcacgcactcgttcgagatcgtgggggatagtctccacaaggcatccgcgtggaccagttca

SEQ ID NO: 102180 - DNA, 585 bp, Oryza sativa
ccagggcccacgatcaagaccttgacagcaccaggaatgtggatcttagcgcaagattgtaagcggtcacacccacaaacccacttatagtataaataagtagctaaaccgatttataatgcaaataaatggctacgcctatttgtattataagtgggttgataggtctgtccacttgtgcttatacccatattgtttcgaggatatccacggctcttcacatgatgtggatgcgaacctccgagcaatcgtattggggtaaaacatcacatgtacacactatgaatggccaataaaacatttgtccattttcgtccgattcggacgtgccgatagcacagttgtgttgcctagctgacaatttgccatggttccatcatagaattggcctttttgtttcgtaaacagcagtcatactagcgttgtttggggggagaaaaagatgtatttgacctcatggatagtgttttctgcagtggccgatggttggtctaaatacaaacgctcttatggcatcatatttttcatcgaaaaactgtgaacttctaaacctttattctatactacatgaattcaaggtataac

SEQ ID NO: 102181 - DNA, 638 bp, Oryza sativa
aaatttataactttcatatagattctgggtccggcggagatcgtttagaaaatttagaaattcacttatccaaatagatctaggaacttttagaaattcacttatccaaaataaattcacatatttcagacttccaaatgatctcaaataaaaatatcatcaactacaaagatgcagaacttaccgtgctctagaaatttgatataaaatttatcttcatccgattttatataaaaaagttatgtgcaaaacacacatatattagcagcgccaacgtaggtgccgcttttaattttcaacggtcggcagataaatgatgaccatatgtgccgatttccaataaaaatcgacacctgttacgatgcactcatagctaccggtttattacaagaacggctacctataagaaccgatacatatgagttgagggattattggtgcctttttttataaaccaacatatgtaagtcattataccagtttttatttatagacctatgaaaaaagggaaaatctcatatgtgtcgttttttatgtaccaatacctatgatagtgcttcctatgaggttctttttaagtagtgtatcatttgaaaaaaatgatgctctaatataaaggaatatctatataaattaga

SEQ ID NO: 102182 - DNA, 839 bp, Oryza sativa
cggtgtcaaacatttcaaaacggagggagtatttatcattgacagttttgaatgaaataaatattttttagcaaatgaccatatctgtttattctcttgtccaaaaatacatttaccactgttggttaagaaaaaataacttggcatttgtcaaagtttggcactgatcaaaaatgtactcaacagtttacttaaaaaagataaaatgccctataaaggtgatgattaacatatctgactatatcaaataaaggtatcccgcataattgcattgaacagttgcagacttagtagtgcactccaggaccagtatctgacacatcacacatagaccccactatgattgtaatgagagagcaagtgcacaggaataaatttggtccatttagtgctcaccatgtgcatatactactacagttacatactactctcaacaagtaaacgtaagatgagaaacccaaaagtcaaggaataatatttctcaggaagggacgacgctgctataaataagtactaattcaggacaagcagtatgcacagtgaacattctatttacctgccaatgccttgaaaccttactctaataaattccaaagcagtactaaaaagggtttttttttccagtttctggacataaactgaactcgagataaatttgaaaatatattgttcatttttttccacaaaaatatccaggatgcaatttttttggcataaatataccatcgatctcgctgaaccattgagcgaaaatgacatgagcatgacgacgcaggtgatgtcgcgcggggatagtgcgagcccgcgcggtgtcgcgcgctacaccctgtctcgcagaa

SEQ ID NO: 102183 - DNA, 591 bp, Oryza sativa
ttctctctccattttgacgggaaataataaaataatgggatgagtgtccagcagctaattaccacttttttatagtgtccacgagcaaatacacgatcttcgggtgtctcacagcaaagaccgtaatctttcagtgtcttgtaacaaattttgcctaaaagaattgtagtggggagagaagcaaggagaggaggtgaggaattccagggaagagagagaggattagaggggactggctttaaagatgaatccagctctttttggatacaatgtatgtatttgtaatacatgtgcgagtttttttttaaaaaaaactactaacacataaaatatcatcaacgtcgttttttaatacatcggcatataacaaccggcctagagatggcaatgggtacccggtccccggtcccccgtggagaattctcccattaggtgatggtgatggtattaattgtgtctccatggggaatcaaatggagagaaagtattctccgtcgggtctggcgggggcgggtctggttccccgtcccccgtccccgccctccgtggaggcccgatataaaagtatgtgtgtagtaatatgggctgcag

SEQ ID NO: 102184 - DNA, 552 bp, Oryza sativa
tatctcctcctctccttttaactctctcctcaaccttatttattcctctccttatctattcttctccttctcctctctacactgcagcggtggggcgaggatgccaggccggggcgaagcggcggcggcgcggcgtgcggcaaggcggcggtggcctggcggccggcgcaagggcggcgaggcggtggtcatcgacggcggcctgtggcggcggggcgcggagggccggccggccggcgcggcgaggcggcgcctacgttttcagtttttttttctttttttttttggagaatctgagctgagattgttgtatgatgtatttgatttgtgtgtgatgtgaatatgtgatgaattttgtagaagttgtgatgtaatttttttttaagattttatgatgtatttgagatgatcgatttgtggatttggaggcaatttgaggatgattgttttgggattttggggacgggatagggtgaaatcaatatattaaaaataatgaagaaaagaaaagaataaagaagccactagatctgcctctttagttccggttgg

SEQ ID NO: 102185 - DNA, 703 bp, Oryza sativa
ccaaagaatactccaccggacataaccacatgaggctaaccaaacctataggatgtgcccacttctctctttgtttgggacttgataaaactcaccacacttggctagacaagcccacaaaatgcacctatatgcatatgaactaatatggcacaaaatcatccacatgctcgcttcatatacccctcttgatagtacggcacatatctagtaaatccggtctacaccaaacaccaagaccgggaaaaagactaagaaaacattcttagctccattatacctttgccttgcgccatccaacttggggtcaatgcttgagccaacatcaacacttgtgaccattcggttgaaccatgtttatgccgagatctttgccatcctttgtcaagactttattctcatcacaagcttgacttcattcttgccaacatgacgatgtccttggcttggtgaccattaacccatggtgtcattcattagcctcatcgcaattagatctattcctttgcacgactcaaaggaaaacattagtcccaacaaatcggttggcaccctccacttggtgaccaaccggttgcttatgaaagatatgaatatgtttattgagtattcattaacatcataagtgtcatatactcatatgcaagctcaagtgcaaagatccgatatatataataggtgaacaacatggatctaaaacatg

SEQ ID NO: 102186 - DNA, 619 bp, Oryza sativa
tatagggcgaattcgagctcggtaccctatattacacatttctagtacagttcatagctagtgcacacatgcaacactaagaagcggaactttgcaaatttttgcaagaaaaacaacagtataaaaagaattataaaaagttacattatgaaatatgtaaagtacagatgtaacttcagtatactgacatgtaactgcagtgtaaaaacagtcaaatcataatgtaactaacttgacttcagttatacttgacttgaagaacaattggaacaatatcaaaacttacatcaccacagaccttaaattacatttgtaattcatatatatttccaatgtaactacaactgtaatttccattgttttatcctgcaacttcatacaaatctattgccatacaaaatgcacatgccatatataaaaaaaacacactaagttatcacatattcctacaataagcattctctccaaatccaatttctgttaagtagcaagaatcattcatgaaattactacaaaaaggtccaccataaaggcacacagcaaatatatttgcccatttctagtacagttcatagctagtgcacacatgcaacactaagaagcaaaactttggaaattt

SEQ ID NO: 102187 - DNA, 679 bp, Oryza sativa
aactacgagcgcgccagcgatgtcggcaccgagcaggcccaggtctgcctgcactatctgctcaaccgcctccagcccctgccttggcagcggccggtcatcgtgtccctcaatccggcgcggcccatccgcgacgagctggtgcatcgccgcatcgagtacagccacccggtcttcgacctggccgcgctgcaggcccagggccgcatagccgagctgcaggggcggcagcgaacctggttctgcggcgcctggtgcggctatggcttccatgaggacgggctgaaggccggctacgcggcggcagacggcgtgctgcaggcgctgggcagctggatgcccgagaggagcgccgcgtgaaccagcccgcgatgggtttcggcaaggtctggcaccggcgcctgcggccggtggcgaacgagttcagctacgccagctatttcctgctgctgccgctgcgcagcctgcgcgagcagcccagtgcggcgctgcggcgcaaccgctggggctggctgagtttccacgaccgcgaccatggcactggcggcgaagacgcactggcctggttcgagcagctgctggcgcaggagggcatcaccgatgccgatggtgaggtctggctgcagacctatccgcgcgtgctcggccatgtcttcaagcccgtcagcttctggtacgc

SEQ ID NO: 102188 - DNA, 622 bp, Oryza sativa
ttcctgcagcccctaggaagttgtagataatgtttggatatatcttctgaccaaagggaacgattttatctcaagtggtttaggagatataatttttttaatatgactgttgtttttgtgtcataatctggatagtagtagattgaactgtttttgaaggggttaaacagtggaatcagccaggccgcctatagacaaagttgtagaggtttttcatagctttcatattggtaaagtacaccctgattgggcgagtagaactccagttaggttgtttcagtgtggacagtctgaaattctagacagattctaaagccttctttcaagcgcaaattagaccatttaaatggcaaaataaaattatgctttctacatgaaagttgtaggtatttcaagatataaaggtttgaagcagcagtcttgtgcatagtccaagcggcgttccttgttattgagttttgatgggatggggcagtaggttcacctttttcattgttttctacgcatgtttgaatgtgttttctaaggttttgtttgtaattaggtggtggtccatcacatcgtgcatgataccaatccttctttgggggcaagtgcatgacgaactaattttttgattcat

SEQ ID NO: 102189 - DNA, 668 bp, Oryza sativa
agaggtaataaacaatatttgcgaagacaatgtcatggaccatcggccacacttgtgacacttataatcgaacatgatgagtaactataacgagggcattatccgtgagcactgctgtgaacatcgattgatcttgcatactctaagaaacttaaacattccaaagtatatgaatataatccgctcaataaaataacaatatgtggggtgcatgtcattggaaagaaataatcatatatggaagggcaagcatcgaaacaaactcttaacttaatgaatatttagtctcaaacacggttttcttaggaaatctgatatcacgattatgactatctgtgagaaattctacaatcacactgaaagacaatggaaatatgtataacatggaccgagtataaaaccacttttagaagaatatgcgcagaacgaagcatccttttcaactcgatgtttgtaacaaaaaacaaaaaggaaatatgtgtttaccataaactcatacaccacatatcaaagttttggagtttgattgtcaacttccatagcgaatccgaaagccattctataaaaaaattcaaataagattaatgatcaaataagtgtggacatcaatccaagaatatcaatactgcacacagttctgagccatggcatgaaaataaatcactcgg

SEQ ID NO: 102190 - DNA, 1885 bp, Oryza sativa
agactcgtacggcgtcatctgagcgagctcgaatggcacctccccctcctcctcctcctccgccatccacgtcgtgggtgatcctaagggagagcaaggacgctgccgccgttgtcgtccatggacgccggcaagctctgctgggtggacgccgaagacagcttcttcccgcgccggcgccgccacctagcttcttcccgcgctcgcccgccgcagaccccgcttcgccgtcggccgcctctcccttctcaagagtcacagtcatagctgctgtcgcctccttctcccgtgtcgtcgtcgccggacctcctccccacatgctagccactttgcagagaggagagaagcgagagagatgaggaaggagagaagagggggagagagatgagctggcataacgacatgtgggacccatgtggggcccacgctaactcacccgccacgtcagagaaaaccggggtcaaaaccactagaggacctcaagttgagggacctcaagttgagggacctccgatatctggttttgctgttgggggacgattttgtaagtcgatgataagttgacggacctccggtgtacttttcccttcatatcacagtacagcagtaaccttgaaaaggaccttggcagtaccagggcccacgatcaagaccttgacagcaccaggaatgtggatcttagcgcaagattgtaagcggtcacacccacaaacccacttatagtataaataagtagctaaaccgatttataatgcaaataaatggctacgcctatttgtattataagtgggttgataggtctgtccacttgtgcttatacccatattgtttcgaggatatccacggctcttcacatgatgtggatgcgaacctccgagcaatcgtattggggtaaaacatcacatgtacacactatgaatggccaataaaacatttgtccattttcgtccgattcggacgtgccgatagcacagttgtgttgcctagctgacaatttgccatggttccatcatagaattggcctttttgtttcgtaaacagcagtcatactagcgttgtttggggggagaaaaagatgtatttgacctcatggatagtgttttctgcagtggccgatggttggtctaaatacaaacgctcttatggcatcatatttttcatcgaaaaactgtgaacttctaaacctttattctatactacatgaattcaaggtataacgttgatttatggtactcttgtatacaaaattatggtaaaagtggttcgtgacctactcatttacataaaaaagaaaatactaaatatattgatgttgtgataaatgcaaaatagatagcttaaaatttagagtaaatttcataaaactacagatagtttggtcaaatcatcacaaaactacatatttaaggagatgtatcataaaactacagatttaacaataaatttatcacaaaactatagatttttgagattaaatccttagcattagtgttatatgcacgggtggagaagtggtttttactcccggttcgtaacccctgtatagtcccggttttccaaacgggactataaatccgggactaaagatcgctatctttagtcccgggtgaaataaccgggagtaaaaatcgatttttagtcccgattggtaacactaacgggaccggttggtaacaccaaccggaactaaagaggcagatctagttgcttctttattcttttcttttcttcattatttttaatatattgatttcaccctatcccgtccccaaaatcccaaaacaatcatcctcaaattgcctccaaatccacaaatcgatcatctcaaatacatcataaaatcttaaaaaaaaattacatcacaacttctacaaaattcatcaca

SEQ ID NO: 102191 - DNA, 689 bp, Oryza sativa
aattacttgcagttgtgtactgttcaaggtaatattttgatggctggcgcgcatgtgttctattatgctttaaatcttgggatgtttgtgaggtgtacgaattagttgtacttctgtacttttcagggtagtttgatggcttgtgaggtagaattgataacttgacagctagttagtttctaaaattttgtgatgtctgaacttagtttgttgaatttttgtttttgttattattattactgggtaatattatttttgaattttgtatattgtagtagattaaactttttacagatttttagttgtaagcatgattctactttccatgtcccttggatagttgtaagcatttcctaattttttacttccaagttattcttgtgtaattgacagctactagtgcttcaaaatctactgattgttgtttgtcagtttttttttaattcctatcaactgtaccctgttttcttcatcttcattaacttgctgtgcctgttgattccattcagcttgttgttatgttatttttctgccaccttctccttggtatagcttgtgtgcagctgctatacttctttagtgaaatcttctgcttgttcttttgtttccatcagctgtgtcatgttgttggagtcttgtttccctgtgcactctccatgataaagcatctttagctgtgcactcctatt

SEQ ID NO: 102192 - DNA, 570 bp, Oryza sativa
gtttgtgggcctgcatgctcatgcccctaccttggggctttcatagtgcacttacgtgtcatttagccatataattctacgtcaattttgctatatatttgtcgataaattttcccctaaaaatttgacagatgtaattacagtacaaccgtaatgtaattacactgtaacttgcatgtaattacactgtacctataatataacttgtatgtaactttcaaaaatctctcccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagagatggcaatgggtacccggtccccggtccccggtcccccgtggagaattctcccattaggtgatggtgatggtattaattgtgtctccatggggaatcaaatggagagaaagtattctccgtcgggtctggcggggccgggtttggttccccgtcccccgtccccgcc

SEQ ID NO: 102193 - DNA, 728 bp, Oryza sativa
taaaaacttgggtggtgaaaatatcacaagtttgtttgcacatgaagatggaatatcatatatatcgtgttacacataattaagctgggttaggacaacatagctagcgtaatctgaatccaagtgccgtttccgtaattgtcataggttgatgcatggatatgggatctaggaatctaagttggatcggttgtcatcttctcacctctcacgcattgcttttgctgttgagctgagcgtttgtcacattggaaattactactactagcattgatctgtcagtttggcttgagatgataagaacattaggaactactgctactggtacgaaaaacatatccatactttctatatagttgatacccacaaacaattattagaagctaaagctcaacatgcaagtataccacatcatcacccactagcaattactattctagcccatttaaaatcctatgcaagcatgccacatattcacccactagcaattattattctagcccatttaaaacccatgcaagcatgacacattatctacaatattacttcctctgtttcataatataagtcattctagcattacccacattcatatagatgttaatgaatctaggtacacatatatgtctagattcattaacatcaatatgaatgtggaaaatgctagaatgacttacattgtgaaacggaggagtagtatattatagagatcaaccagtatgtgtcaa

SEQ ID NO: 102194 - DNA, 557 bp, Oryza sativa
tgtaagatttctttcttgtcagtccaaccaagattagtctatagtatttttccttctcttatacatacatatatccgatcaatctcgactgttaaaatctgaagctatcatgatctgatggtgtagatttctctttttcttcgattaatgtgcaatttctagctttcaaagcgaacttggtgtcttctttcaagactgtttttaataatataacttgggtttcgtttttataatttttagaagtcccatcaaacgctgtcattatactcctctacgactgttccgctgtctcatctctttattgtcattgggattttaaaactcgaacataattatcgtttgggttcattttttttactatctagaagtcctgctaaaccatcagcggcttttccattgtacttctctacagctcgcccgctgcctcacctgttactgtcattaagatttaatcaaacataattattattggggtttccttcctactttttagaagtcctgccaaccgctgtgcccgtattgcttaactgcatgttcattgtcgctattgggctgca

SEQ ID NO: 102195 - DNA, 556 bp, Oryza sativa
attcctgcagcccttatgaatcaacggtttaaatcaattctactagttgtataatactacgatatagagtaccggagcatcgctctttattttttgggaatgctatggatctggaatcgcaaattaggtttcatttagagcaagtttaatagtgtaaccaactgctgactctaaatcatctatagtcaacttaatagtcaattcatacaatagtttactataaacatatcctacacaattaatatctagtcccacttgtcatacacacttccatttggaagtccgcctgcactgctacaaatctgtaccgctactctcttctatctttatctcctcgaaatgtgtttatagtaagcttataggctgctattgtacctgctctaatacatctacagtcaaattcatctacacacacaaaaaaaccgaccgtaaaaattatgattgaattcccagttagatttgctatatactcctacctatccatatagattttttttagagaaaaggtcacaaggacccggcctatattgaaagccaacctcgagcagagtttttg

SEQ ID NO: 102196 - DNA, 594 bp, Oryza sativa
taacaaaattcagatctaacaggaagaaattaaaaaaatattaatgcatgattaaaacaattaacagtataatttaacataacaaatttggtacaaaattaccatcatcacattgtcttgaatcattaagttcaacagcagatttagaaacaaaagcatcttcatttccctataaaattttcaattcaagaactcaaaaaacaaataatataaataaaacttgcaaataaattatgcaatatatgacaaaaaaaacttacatgaaaagcattatgaataggagaatgaggtaacacattatcattaggcacatgaacttctgcatataaaacgaacgcattaacaaaataaactgaatacaaaataaaaaaatagaaacagcaagaggaaaaactcaaacaccaaaagtattataaaaatatgacttacgagcactaataccagcagaagaaataccaatgtcatcatcagctttagaagtgccaacattctcaattacattttcctcaattacaacattttgatctgattcattacagctagcttcaccaatcatagcaagaacagaaatcaaaagatctccacaagatgaat

SEQ ID NO: 102197 - DNA, 632 bp, Oryza sativa
actatagggcgaattcgagctcggtaccccgcgtcgacgccgtggcggcctcgcggcgccggcgcccaccaccatgcccgcccggccaccgcacggcgcggcgatggatcttggactggatcaccgccgcaactccagcgcacctccgccaccacaaccgccacggcttcacactcaccctcctcctccccctcgtcgacgacggcgacggcgacagcggccacccggcgctgctcccgctcgccatgccaaagcaagacatgctagctagctctcagagagttgaaagcagcgtgtagatcgaagtaggagacgccgccatgggaggagaggagctttatagcggcgatggcgagagggggtggcgtgaggaggaggcgggggatggctttcggcggttttggcgggtaagactcacgctatgtggttgactgcgcattccttctttggttggttggtgtgggaatggcagttggctagcagctgcctagctccaacctgtctggctggctgcttctctttttttttcgccttaaatggtattcttttcctcggtctctatatctaactggatatatacaatcttttatattagaaacttagcatattaaatatgaaacttagccctcaaa

SEQ ID NO: 102198 - DNA, 500 bp, Oryza sativa
ctacgtacgcttagctaggagcaagctagctggacggccgcaggcccaaaagacgtcatgcctctatgcaatctccaagaagaaaaacgatgactggatcggagatttggtctcggagacaaacccgcaaatcacggcgacttttgtggaatagctcgtggcactatggatcgcagtccatggcatgcatctggatgaaggagaaccagaccaaatcacatggaagttcacaactcacgggtagtactcggcttcgtcagcctacaaagcacagtgcattggcacgcttgacacgacctttgacccattaatttggagagcttgggtgtctggaaaatgtaagcttcatgcatgctcatcatctagaatagagtatggacctctgaccggctcacaaacaggggatggcagaacaacgggcagcgccccctctataggggagaggatgaaacggcgtttcacctcgttgcggaatgtcgatattccaaaaggatttggag

SEQ ID NO: 102199 - DNA, 619 bp, Oryza sativa
cttatttgagatgccgaagttatggatacgtaatgtacaaagcaggatggagaagtgctaatttttgtgtgtaagtgactcgattgtatttaccatgattcagactctttttatactttctcctgcgacggatgatcaccgttacccatgcaagattttttttcccctggagagtatgcaaactgatgatctaaacaagccggaaatccctgtttctttttttccttgtgaattgtgataaacacccagcaatatacatccatgcaaccaatgaatgcaacaatcctacataaaactaatatttacacgaaaagactccaaattcaaactatagcaatcttaagaacacgacataatctcctcctacctaagcccctaaaaatcttccaaactccaaaccatagctacctatcaataactcttaataatcatgcttagattatgattattatacaaatgacttataataaactaagatgatgatgtgtcataggcctctcgcgagcatggcttgaaattcctcggcggatttctggttctgcagcctcatctcctccctgaactttttgatgaacacctccgccataacatccacctcccccatcccacacgcttcttc

SEQ ID NO: 102200 - DNA, 527 bp, Oryza sativa
ttttacggtttggaggattaggctgcttgctcggttgggaaccattcccttcgcatgaaaaatggagcggtatattaacacgtgattaattaagtattagctatttttcttttaaaaatagatcaatatgattttttaagcaacttttgtataggaactttttgtaaaaaaaaaagcaccgtttagcagtttgaaaaacgtacgcgtgaaaaagatgaatatgagttgagaaaacggggaaaagaacacaaccttagtcaggaaagcatccaacattaggcttgggattctgcacagcgcagtctcaaaccttagctttagcaatgttttaaatagcggggtaagacatttagcagtcagtttcaaccagttttagcggataaattatacatgagaaagagctagaatccttctcaaacaaccgtaaggggaagatattcctctagtcaatggtcaactgtacgcgcgcgttcatctccttatatcttcaagctgtcaatgctgcattaacatcacactagcacagc

SEQ ID NO: 102201 - DNA, 577 bp, Oryza sativa
gggggaggggttccaatccccacaaattgtacgggtaaaatcgaaccatgcttgaaaaaatcgactacaacacactgcagcaaccaattgttatatgttaaagtaaaatatcgaccacaaaagaagagtcgaacttagcgttaaaaagatggtttgcagctgttggttggctgcacaagatagggatgtacgcatgtgattagagattctttttctataagggtccaacgatccatgtcacatattgtagccaacaaatcaaaattttgttcgaccatactaatcgaactagaactgcaggtaccctaaagctgacaagttgtattccattcgaaagaacacccttacagttacatccactatccttggccatgggtggttgcttcatgtgaacatatatgtggactgtgggcctgtggcttgctagtgccaaattggttgttgaagaagggccgttgacccctagtcaatgacagtgaattgtactcccctgcttgtcctgcaggtgccataaattctgaacctcaagaaccagaccaaagcaacaaagcgaggtgcagtttcagtgagggaggaa

SEQ ID NO: 102202 - DNA, 673 bp, Oryza sativa
catcagattttaatgcttagctatgaacatacaaaaggctacataaagcaagattcctagtgggagattcttctagcttatcaccaaccatggagccctatctagattccaattctcactcaaccaccggaatccagaaaggagaaatggatattattaatttagaaataaattttttgggttccgaaaatgcagatgaaatagggcaattcctagacgtcactctagcatcatggggtgtcatgataatgaaattgtctgatcacaaagttaagagaaattaattcttatcctttctttggaacacttgagagaatttttcgtgatttccataaattaaaaatcggactaattaacattaaaactatgaagtttttcatagaatattcctatattccaattaattcagcaaataattggcatgaattcatcctttttgtttgtggtagtttttaaaggattaagaggccccatcaggaatcattggttttctaataaatcactgataaggttgtgtttggcttcacacggtaatataatcagttaggttacctacgttgtttcctttatctgaaaaggagttaattggaataaacttgtgtttgacaactacttgcagttagtcatgctagcaatataagaggacaactacttgcagttggtcatgctagca

SEQ ID NO: 102203 - DNA, 542 bp, Oryza sativa
aatttttttctctttcaagtattaactaataataaatttgtccttttaatatttttttggtaggtggtgtaccttgacaatgttgaatttggtgataccaatgtttcaaatgaaattccacgtatttgtgtttggaaaagtgacatgatccatgcttattctgagtttgataaaattgatgatgacacttttggtcttaggcctctaagggattttaaatctacttgctatttccaggttaatactatttttaaaaataaaaatgaatttctttattatttttccttataatgcatattgtattaatgttcttttttttcattgtagcctcaaccttgtgatgaaagaaggatttcttttcagcagaaacttgactgtgctcttcagaatatgttgccagtttacatgaaagagaaaatatgttctatgtttgatagtcattgcacttcacttcatactattgatgattcatcttgtggagatcttttgatttctgttcttgctatgattggtgaagctagctgtaatgaatcagatcaaaa

SEQ ID NO: 102204 - DNA, 595 bp, Oryza sativa
ttcagttgtctcgaatctcgatgaatgcgtttgagtattagagattcagagttggtgcctgttcttggccgatgcgaaatttgaactcaaaggaatagttgaataaaaacgtctgaataggatgcactgaatatatgagtttattccaggtgattaataccatatcatgagttggcaatgccgaaaatcttgtcatgttctttggatattctgaattcagcatctgttcacctagttcgtgttacaaagcggcaaccatcgtgtaatcaacatgttttgagtctgaatctgtcatcaagtttcgatcgagatggaacacgagctgctagtgtcgtcgttgccaccggtggactgaatcagccgtcagcgccatacgtgcgtgggctcggaagacattcgcacggatcgggcgcacggtggcctctagcgacagctggatcttcttcatacgaccgcccttttccccggcggtcaccattcttatccctggcgccattggtccgtgcgcctggagagaggagatttgaaatgtgtgatgattttatgattttggtgagatcgtgcgaaatcaatatgcaaagaataatgaaaaaaa

SEQ ID NO: 102205 - DNA, 521 bp, Oryza sativa
atgatgacctacatgtcagtgggtcccataatattgtttatgtgaatgacaaatgagtcctacgtatacttttttaattctaatgccacgttagtgccatgtgggacggagaccagatcaaatatctaatccaaaatatttgcgcattttctaaatatggcatatcatcgtctgaatgtattttaagaaaagtataggatttcttagggggtgtttagattcaggggtgcaaagttttaacgtgtcatatcggatatacggacacacatttaaagtattaaacgcagtctaataataaaacaaattacagaatccgcttataaactgcgagatgaatttattaagcctaattaatccgtcattagccaatattcactgtagcaccatattgtcaaatcatggagcaattaggcttaaacgtctcgcaaattagacgcaatctacgtagttcgatatttttttagcctttatttaataattcatgcaggtgttgaaatgttcgatgtgatagagtgagggta

SEQ ID NO: 102206 - DNA, 1542 bp, Oryza sativa
catactatgagacaattattcacttgaccgatggtgaatgcttgatcgtatttcacaatagatgtaaagacgaatttgttgctgcaatccaaacacaagtgaacaatacgttgtaatcacgcaaaaaactgtagcaaacaatcttgaacaccaaaagtcaagcagaagatggaacagaattgtccgaagtgacaagtagtgacgctatgtagtacgttgtaccgattgtgattagtgaccaaagcgtaattcgtctagattttcaagtttcaacttttttcacatctcaaatgataccatgggcaaaggacaagctgtcactaactagttcgtttatttcaccgcagatttgaagcgtacggcaccaaaatttcatgctgcctgatcataaattatacagccccatcgttttcgagcactaagctaaacaacatatttacaaacgaaaaataatgcaataagccaaacaacatatttacaaacaaaaaataatttatgaataaaaatttttatatacgtgttcttaattatataaaaataaaggctgaaaaataaactacgatacaaaaaacaaaaatcaactctaaatttaagttgatcccactttaaggaaaacgagcgaattaaacaagtcactgtcataaacagcaagttgagtagagttgtactcctcctccttgactctgaatctgaattatcaggcgtggccatctttgctgacttttgggaggtgcagacctctgaccaaatcgtcacgcggattcctcctcgtgcgctctactagtgggctacactgcataaactctctatatatttccttaatttctcttgccagaatatttgttaatacgatgaaaatgatttatatctccgatctctgttagcgctggccacacagccagttcccgcttgcatacggacgccgtgtttagtttcgaaatatttcttcaaacttttaacttcttcatcacatcaaaactttcctatatacgtaaacttccaacttttccgttacatcgtttcaatttcaaccaaacttccaattttaacgtgaattaaacacagccggagtattgctttatttttcgaccgtcacactctagtcctcttgtattggtactcctacttacccttctcttttttaaagaaatagatgatcggatgaatgagcaagctttccaaactttttatgatgaatttcttgaaatgcaggtttgaatctatttgtcaacttcataataagttgattttatttgcaaacgcataataagttaatttattcattgtatccttaaataattatcacaagtcattcagctatattcaatacaagagaacacacatggtgtttgttttgattagactagtagtaatggaaggtcttcagagttcaaagccagcaaatacacaccgtacagagatattgtgcatgcatttctattggccgacgacgatatggaactatattatatgtgtttactttgcctggaatatcggggagaaaatctttcatatatataattttcgaccaagtggacatat

SEQ ID NO: 102207 - DNA, 527 bp, Oryza sativa
tgtcccctacccctccccggacggagcgggcaacacgcgatcctgaccgtggagtggagagatccctttgctcgctgagcactttaccccgggtacactgacatgtgggtcccaccactcgtgtgggcccgggaagtcgctagaataaataggccccacaccttttgttttcggctactcaaccgcccggtattttccattctgcccctccggcgagccccaccctttcccgccctcatggcgcccagcaaccgcctcgccgtagcttcgcgcggcggcggcggcgcctcctcctcctcctcctcctccgccgcctcctctacctccgagaggatctcccgcgccgtcggagaaccatacagcgatctcggcgcctctgctgcagcccgggggggcgggcgcgggcgacgcggcgccgctggcgaagtggctgcggcggctcgaggcgttcctctcggcggcggggctcgcggcgtcgagcccgctcgggaaggccggggcggcgtccgcgctcgccgtgctgggcg

SEQ ID NO: 102208 - DNA, 556 bp, Oryza sativa
taaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgacaggtgtatatattatgccttgaagaggactcgaacctccacactctttagcaggccgaatcgggccaccacttgggatgggaatggctctttcggataatgcaaatcgaagttttttgatgtgtgagcctatatgacatagaaaaaggttaaaaaaaaacgtttgattctcttttccctattcaat

SEQ ID NO: 102209 - DNA, 632 bp, Oryza sativa
cgctatatgctagttgatttttttcagccacttacacagtagttacatatcatttacacctcacttacatatgtaattagtatgtaattttcgaatttacatatgtaattttagtacttacatatgtaattttgagacttacattgtaaatacactaaaattacatatgtaatttagggacttacaatgtaaatacatgccgactattttttgatgaaaaatatggcgccataaatatagctacacccctttgttatactacccctccgttaccgtttcatatggggccacctataaatcggacgtccaatttttttaaaaaaaaatcagacattgtttcaccaagtatatcgaaattgtttcaccaagcagatcgaaattgtttcaatattttaaaaagctgaaacacaaccaaattaaatcacctcgtgaaacattttgctacaacgtacgaaacaacattttccaaaaaaatcgagtgttgtttcaccctacataaaaacaatgtttcagcaaatagcgaaaggatgtttcaattcactgcaacatttgattcatatatagtaaaacattacaagtacaattggtgaaacattgttggtggaacaaaaaatgaaacggattcccttaac

SEQ ID NO: 102210 - DNA, 505 bp, Oryza sativa
ttaaattactgtcctacccgactacacccaacattagaacacatgaaatgcagtctatatcaactactacttctaattgtttgacatgtgatagttaaaatgaatttaggagttagacttgtttgggtcacaataatgtacccagcatgtaagctggccacatcagtttgatatttggtgtgttaaaacaagtctgaataaattggctaaagacagacatgttttctcaacaaattttattggccagcatggatccagtataaatgcatagtgatgtagcacttaggatcacttgagatagtagaaaataatggttcgtttgcctgttcagcccaaaataacataaatagattaaattactgtccaacccgactacacccaacaatagaacacatgaaatgcagtctatcaactactacttctaattgtttgacatgtgatggttaaaatgaatttaggagttagacttgtttgggtcacaataatggacccagcatgtaagctg

SEQ ID NO: 102211 - DNA, 2333 bp, Oryza sativa
attcctgcagcccagaaaaacaaatatgtccgacaaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccaggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgatgcggtaaaaaaaataaaaaaaccaggcgaaaaaaaagataaaagtccgataaaaaaacggggcgaaaaaaaaaaaatctgtcctatccaaaaaaagccaaaaaggggaaaaatcaaaacgaatccgactccgtcgacgtggtgaaaacagggcgaaaaaattccaaagcaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaaatctgtccgatccaaaaaaaggggaaaaaatcaaaacgattccgactccgttgacgcgataaaaaagggcgaaaaaattgtctatttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctatagtatattaaaaaaggaaaaaatgagcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtatagtactaatgtataaattaaataaaaaagaaaaaaaagaagaagacaaaaacactcgattgggctacgtatccagcccaaattggatttgcacatgcgagagagagaaaacagcccgagttcatgaaggagacctccatgcagtcacaaaggagacccatgtgaagcatctcaaattgcaaataaataaataaagcaacgccgcaaaatcatcagatggtaaaagaatattttacttaatggaaaaggggggagcaatgctctcctagttcaaaaaaaaaagagaatattttacttccctgaattatttcactagatcatttaactccctaaataatttctcggttcattttacacctcgagcggtatttttcttatttctctctctatatgtcgtaatttgcaatgaaatttggtattatcaattttttatctagtctttctcacaaaatgtcttttctttctcagatttatagaaacattaaaagataactgattgagcaataatttaccatatttcatgataggtaattctgtgataatgcgatcaatatctggatggtaacttatctcaatctcagtaaatatataattcgtctcgaaagccttccacgagagctggatcgctcgagcagctcgagcatgtcgtgctcgcgtgggtggtggaacgacctcccgtcggatctcctcgcgctcgtcgccggctgcctcacgttccaggcctacacccgcgcccgcgccgcctgcgccgccaggcgcgccgccctccccgcgatctcctcgccgtcgctcctcgtcctccacgacgaccaccgcgaacgctccagcttctccgcatggttcttgtcccccaggatctccatcgctagcttggccaccaacctgatctctactgggagggcgcagcgct

SEQ ID NO: 102212 - DNA, 596 bp, Oryza sativa
caaagcatcctgacctattctcacaaaaaaaagggaaaaaagagagaaagaaagcagcctgacctatttggtgtactaaatgataaatttcttgacttggacttccgcttttggatttcagcagagttcgttacgagtttttctctgggcagcagagctgtcaacctaaattttccaggctttctctcgaaatatcgaattgatgtttttggatgattcgatcccacggtgaagtgaacgccacgtacggtttcggtcggaaaatcgactgcgagtgcactgcagctggctgcagattattattatttttttcccccaatcaggagcgagtctgctcagtcgccggtatgcaactgaacagggaacaccgttttttctgcacaggatttgcacgccacgtacgtagatttaatccgtgatttgtggcaaaatttagaaaatggttttcaacagtgagttcggattgagacatccaaggtctcgaatttctcctgcagcttctgcaaaacgccgaactgctccagctaaactggttggtcggactgcagactgccttgtctgtatcgtctgattccgatcagctgcctgccggcttg

SEQ ID NO: 102213 - DNA, 502 bp, Oryza sativa
gggcgaattcgagctcggtaccccgagtgtttctctgttttgttttctaggtgtgtttattcataataagtagacattcattgaagttacacatatattctttaacattcaatttttaccgattaacattttgttgttagctagatttgttcattcatttgtgcagacacaaggcagtcccactataggtctttatctcctgttaattaaacgaataagcttgtaccaaatgaaatacaactaactaatcacataattagcatctgaaatcaaggctgagatggccatatgctcgaatactctacctactttgggcatggcataggtatgactggtgccatcccttgccacgagagaacgccgttgtgttgtgtgtgtatgaaagatgtaatcatatattataatagtgtaatatacacttataagtaactatattttatggataagctattagattgactatatataatttggagctaataggtgactattctaaacttct

SEQ ID NO: 102214 - DNA, 509 bp, Oryza sativa
caaaaactcgtaacgaactctgctgaaatccaaaagcggaagtccaagtcaagaaatttatcatttagtacaccaaataggtcaggctgctttctttctctcttttttcccttttttttgtgagaataggtcaggatgctttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcggttaatttggaacgagggagtactaacaaatacgtatacgtacttagcattgctgatgttcttttcgaagaaattcagacatcccgatgttggctataaatactttctctcaccaatt

SEQ ID NO: 102215 - DNA, 608 bp, Oryza sativa
tgtggagaaagtgcagatataactcgacagaaatacttggtggaaaaccttgtaaatgatgaatcaatctttgcagcctcctttagcttattatccttattaaataacaaaaaaattgcaaaataaataaaaaatagatatataatacaaaagtaaacagaacaaatatgtaaagcacaacaaaatgtaagatatatacctattatgtgtattggcaaaccatttgcaatacgcagcgaacataaaacaggtaccaatgttcatgttgtggaagagcaacaataatgaaaaagctcttttcaagtgagcaaactaattcaagtgatcaggcaaaaaaaaatttcgcatatgatggtgagaagagtttcttcactattggtgctcttagacaagtaaacaaacaactactaaatagagaatcatcagaaaacaaaattgaaagaaaacagttgaaaaaaataaacactaagtaaagtagaagaacaatactgcttaaactctaagtaaagaacaatttctaaacaaatgcaagatcttaagacaatctgagacaaggtaacagaaaaaatatctaaagtacaataaaatataacatatgttggaaaaga

SEQ ID NO: 102216 - DNA, 644 bp, Oryza sativa
gagagtatttttctcattaaaatataagtgctgatgtaatatttcccttctatcccatagattagatcaaagaagcatgcatgaaagatatacacaccatgctctctttttacagatgtttattgttcttgagaagatattattttactgtatcacggttctagctagccttcatgttttactgtgtattttcaaagatgatttatgctaataaggttttaggttttgggtaagggccagggtggaagggaagggaagagtatggttttaagcttagaggaatagccttgggcaatgagatgatagggtgcaagggaggctgtggagttaggagatgacgaatcctgcggctcgctgctagagacggggatcgaagagaatggcgtagaggaatggtgctatcgccggtttaacccttgttcggttacacaagtattcaatccgggccgggaataacaagtataatatgaaatttatgatagatacaacgagaggtcgggatttattttgggccggaaactaatttgctcatgatagggacaataagagaccgggaattaatccaccagttaagaggtgtggaactaatccggatattttgttgtacctaatataagtaaattggttcctgatctggaataaat

SEQ ID NO: 102217 - DNA, 590 bp, Oryza sativa
cattttgaagcactttttgctattttagatctaaacactagtagtaaaacttggcaatttgtcatttggcatttgctagtctatagtagcaaattgtgccaaaaagtgctttggaccactccctctctctttctctctctcactttagtgctagaatggcaaaagtttaggatgcatctaaacaccaactaatacttttgctataccaaaatttttgccatttgtcatttgctattttaaatggatctaaacagaccctaagatgcttggtttctttctctaattaaattttgtttaactttgattaaatttataaaaaaatttaccaacatcaataatactaagttagttttcattaaatcaaacattaaaaatattgctatctcttttctataaaactgtaagttttactttaaaaaaatcaaatcgtcttacgtatgaaatttcatatctattggtgtttctaaattaataataaatttttcactaaaatttttaatacatcttaatagactatatttatcgtaaattatctactctattgggaagtagtctgatgaacaagatgaattattagagcatttccaaca

SEQ ID NO: 102218 - DNA, 576 bp, Oryza sativa
tcttacatgtgtgcgcgtagtgaccttttccttcttcacttgcataattcttgaaactaatataccggtggaaaattatgtgcaagttatagtgtaattacactacttcctccgtttcatattataagactttctagcattgcccacattcaaaagaagggagtacgattgtagtgtaattatatatgtcaaatttttgggagaaaatttgtcgataaatatatagcaaaattggaacaaaaatatgttgaaacacaatatgtatacatgcaacaccttttttttatccgactaattggtatacctccatctcagaataagttcacctatatcaatttccatatacaaaagtgaacttacagagtagacgaatagacgtacacacgcgcgtttaccatgcaccactcgtggacaagtttggcacggaagtcaatgttgtgagaaaactatttcatacttcatcaatcccaaaatgcaaccatttgtatgttaaatactaaggttaagggggtccctctcagtcatcttattggttaaattttaaattttgaaaatttctcagactcatcttctaag

SEQ ID NO: 102219 - DNA, 722 bp, Oryza sativa
  unsure (1)..(722): unsure at all n locations
gctggccanttagaacatcttcttgcatgcccgcacgncgactctagaggatccccttcgtatagaaatacattttacaaataacgaaaattcgaaattaagaaaaacatgggaagaatagtttaaagtcaatataggaatacaatttagaagtaactgaaattcgaaattaaaaattaaagaatattgaaagataaatttagagtccacatagaaatacaatttgaaaaaataaaaatttagaaataaaaataaataaaattggaagaagagcatagattctatatagaaatacaatttacagaaaattcggaattaaaaacaatattaaaagacgagtctagagtccatataggaatatatataatttacaaataactaaaatttgatattaaaaataattaataactaaacgtatataaaatacaatatgaatattacacattagtagttttgtaaagttattgcaaaatttaaaattatgttgtcattttaatatatttgaataatataatgataaaacatatatgctattatatgagagagaatataatgatgctaggcgtgtaatctgcgcgggccaccatgctagtttggtgtaataggaggggtcatattagtaggggtttttttggacggagggattagcggccagcgtaggatttttatgtacgtttatagaggattcaatagctagattctacaaaatggggatgcgctcc

SEQ ID NO: 102220 - DNA, 613 bp, Oryza sativa
  unsure (1)..(613): unsure at all n locations
gaatttttcgttattattgttaaaatctgtaaaatttttatctatttgcgataatttggtcattaacgtcgacaattattccnttccccccncccagagggnggtgatgacgctgttcaagcngacanccactcggtaccccagaccagagtgcagaagaatactccctccgtccctattgggatattttgcttacactttttgactgttcatcttattcaaagaattttagaattattatttattttatttgtgacttattttattatccaaagtactttaagtataactttttaatttttatatttgcacaattttttaataagacgagtggtcaaaacagtgcaagcaaaatatcaaaatcctttagagcaaggttaatagtacaaccaactgctagctccaaatcatttatagccaatttatacaatagttgcttactatattattaatatctggcctcacatgtcatacacaccattatgtcttggagtccgtgccttacaggtggctacagatttatagtccgctgatcttctctctcctcttttatctctttaaaatatgtttgtagttgacttaaaagtctgctattgtacatgctcttatatca

SEQ ID NO: 102221 - DNA, 696 bp, Oryza sativa
cttaatttggttgttactaaatcatgcatcttcatgaggcgattcaatcacaataactttaaatttcttactatttatagtaatattgtacagtatgtgttcagatggtatacatattatttacttactatttacttactagatccaatagtcgacctcatataaccttgatttatcttctaagtcgataaatgatatttagacatgcccaacctataatttacctttataaggtacaatttccaaaaaaactataatatcacgttttaataatacgaatgtccacggaccacctttctagttaatatacagattgccaatggcaaaatatacgtctcagccaacgatagaaaacgacaaatattgactagaccaatgacacgccgtacgtgtgttttggtccgcctttggtagttgcagccgctggctggccggctggttgatgtggctcaggcagtcaggctcacgttggtttcgtagagtaaatggggagctatgccccccgtctggcatgacaacttgatgattgctccggtacaagggacccggtttcttgaaaactctagtatagcaccatgacagtagccacaccaccatggtgtggtagtattcattaatcaggtcgcattgtgcattgatcctaccgtattgatcaacatttattgagctgtcaaacaggctggcatcccacttaaa

SEQ ID NO: 102222 - DNA, 709 bp, Oryza sativa
gcaaccgataaatagacaacttaagaaaaaaatattttggtattgcaatgtgatcttaggtcctagcttctctcttcccattacgatcacctttgtgcggagaaagtcaattcaaacattttaagggtacatacttcatttcttacacatcatcgtatatatattatatgtctaaataaaaagtaactattaatgacatagtaccaaattttggaaacaatgaaaaggaactgttcgatttgatatcaaatctgtgtccataagagagaatatgcgcaatgacaaaatttaataggatagcatttccatggtttgtctagtttgttaccctgttcaagttctggtacgatggattttgatagaaaagcaaacatagattctagttggatcacctgaataggaaaaccgtaaaaacgtagaaacatgataggatgacaatcaaatttctatgttaactttaaaaatacataaagcttcaaaactattatacatagggaacatgcagaaaatttgagtcacgggaagaagaaaacatgaagcacaacctcaatcttattttcctaaatgtttcccatggattggccgtccattccatacaatttttaaaggaatttgtagtgctggatcctttgttttaaatgtatgcattgaattttttttcataggatacaaatctttcaaaattcctttgcttttctattattccata

SEQ ID NO: 102223 - DNA, 683 bp, Oryza sativa
caatttgtaggattggcaatataatttatgggatgcgctagattaaggagagattgtgatacatatttatgctggttcagtccctcaagaagaggtaatactctagtctagttagagtagattggatctgcatcggggttcacagatcagtaatagaatggctgatggcgcgtaagtgtggaaaagcgtgtaacccttagggttcctgcagacgccccttatatagtactaggccatccggtggtatacatgttgcggtatcccttataatccaaatacctaccatctaattacatgggattgaatagactttcttagctcttatccatttctatacaactgaagtgccgcatgggtctagggcactcggcccaccctatgcaatatagcccaaaggcctcctatgggacatccgggtatcatatccccacatgaataaaggtcggttgatatagtaacgtactggcaaaattattctgaactcttcgagacatcttctcattatttacatgatatctaaatggttatgaattttttttaacaaaatagattaatatgtaataaattactctataaatatgcaaggttaaatttaatttctacaggttgcaatgaaaaaaataaattttaaatatgaatatacactaactagtcattgtttaatttatttttctgcaatttgt

SEQ ID NO: 102224 - DNA, 785 bp, Oryza sativa
catcagatctccgctacaaacaccaaatcgaaatcatagatccagaaaatacctacagaacaaacacaatacaaatcaaaactctaaaaaggaggagaaaatacaacccaacaaaaatcaacaagagcaccaggagcacgtaggcatcaaagcaggaacagtcaccggagcaaggaaacggcatttcgccggcgagacggcgtcgacagccaaaatccccacctcgttgcctccaccttggcgaggagaaaaggtaagcttcctctctcctttctgtatctctctcttctctccctcactctctcgaagcaacgagaaaaccaaagcagggttggctttcaaaatgaacagtgtaagtgggtcccacgtaagcccaagcaaaagcccaatccaaccaagaaacccaaacgaaaactagctaagcctgatccagcattgcactaatctcaaagaaatatcaacggcctagaaaacgaatgatttagccatcttttttctgtcgacagccatatagcggtttttattttttgttctaccgaaaaatatttcacctagtgtactcacaatgtttcactatgtatagatctaatgttgcagtgaactgaaatattccattgcaacaaaaaacccacatattttggaaaccccttattaagggaattcattttattttttgttcccccgaaaaatgtttacctagtgtacttataatgtttcactatgtatggatgaaatgttgcagtgaactgaacattctttcactatttactgaaacattgtttttt

SEQ ID NO: 102225 - DNA, 551 bp, Oryza sativa
tatatggtttccacgcaaaaaacaaaaattaaaaaaaattgcaaaaaataaccctagccaccgccagatctgggtggcccccgctgccaaatttgagcggggctcatctgcccgctgcgtgatctgtcgctgccgcccgccactcgctatcggcgcacgcccgccgcccgatgcctgtcgcgaggccgacgaaggcggatctgctcgccgcccgcggatccggccgttgagggccctacagcggcggatcaggctatcgcggaccctacggtggcggatcaggccatcgcaggctcggtggaggtggatccgccagccaccgagccgcccactatcgccgatcgctccctccgcctgctgcctgcctcgtgccgctcaccgcctgtctcgtccagtgaggtgagagaggagatgaggtgagagagtggagaggaaataatgaggagagaaggtgagagagaggagtggataaggatgaaaaattttgaagtgtgaagagggaaatgggaatgtaactcagactttagacagatccttaagaagcccgtcta

SEQ ID NO: 102226 - DNA, 3367 bp, Oryza sativa
gactcggtgaacatttgtgatttgtcctacattcgagatagataattgttcagaccgagatagataaacatttgtgattagtgtattgtgtttgattcgtatgaactgttcatcagaaccttacattcatcatatatagcttttttggtttatgtgttgttgaaatattttagggtttggatgtagatctgaatgtatttgtacctgctataatgtttttgtccgtgaccgaggcagcactatattgtgagaatctgttgatatgatggaattttttgtttgctcggtgtgtgtggtaaagaaggtttcatccccccctacaggtctcagtgcttgtatctagcctgcctctgttctcctgcttgtgcaaacaaatactataactgatgcagtctgcctatgtgtcactctccatccaactacaatttctctctctggttgaaaagcagcagacttgcaggcaatgccactctattcttctgcctttttgcatcattaatatgctagcagtgcctttttttatccataatcgagtgttattccttcagctttctgaattagtgtaatgatacattagtttatctgatcatccatctatggtctattttagattagtggtggtgagtgcggatgtatacatcgatcatccccggagatggcgatgcatgtattgatgtacatggatgcaaatggctggttcttggtaaaatacatgtctactactgtagcatctgtctcaatttgacaaagagtataattaattgctactatactaccaatactacctagctactatagatgtcatgattgattattcacttgcttatttattttaattttctcctgatcatcaacttgttatttttgttttgatcgattgattcatggaactcaacatcagatgttcattagagctaagctcgcgtatgtatggtaggattgaattaaggagagaattgacagtcacctgagtccatacatgcataggcacatgtgagtgtgagtgctcatcttttttttatcagcttaattcttcttgcattgttgaaacacacaaaaaaaatcaatcagtgggggtgggggtggcggtgggggtgggtttggtgattcactcagtggttgtggctaaattggaggtgtcattgttgtggtttgagctcaagatttaggaaggtcttgcagtgctgtagcctatattgtttgtgcaaatgtcgatgaatcaccctctttttggtttgtatgaaacatagcatttgatttagctctcatgttgtgcctatgtgcatttgcaactgttgatgttgattaaattgccaaggttttgcttgtttgatgtgtgtattggcccttagcttttgcatgatattctggcaatcccttagtattcactatgaatgtcatgtgttctgaaacttgaattatcactgcagtattctatttgtcagacttgaagttgtctaattgtaaaattcaacttatttttctgcattcttgaatctgaatttaagttttgccttcagttacatgattttaacattgtaactacaatatttttctatgtaaatatagtacaaatgaactgtaatttttttgtgtgtacttggatgaaagtaggaattaactgtgctaactttgtgctatttggtcatatgttaagactcctcttttgacctgttctatataatttttaactcctttgaacaatgaatcattcacttttaactttgaagttattattttgcatttgatttaatttatatataatgaaacataataaaatacatggtaatttcttgattgttttcaattcctatccttttttggatgcatctctatggaacccaaaattgaaattgtagaacattagtgcaaaaatcataactgaatcagaatatttttgtacacttaaaataatttgaagatccaaatttctgtttatgcatgtagattttaaattgaaaattatgatctagattaagataaatctatacataataaccttttttttaactttttacctaaatttgattgtttcagaatgaaaagcttttgaagattgtagttgaagaatatcttacctcttgatgtctttcctcattggaattgcttttcatcacccatgtttagaacatttgatgttttcaaattcttctcttttaatcctaaacataaaagcattcaattaaatatgtacagattttgcactagtaatcatgatcataattaaaatcttggattcatttacatgattttaatattgaaattacagtattttttctatgtaaatatagtagaaatgcactgtaatttgtgtgtgtgtgcgctaggaagggattaggaactaattgtgccaactttgtgctatttggtgacaagttaataatatttgtggactattctatatgattagtttgaattttgtaactttaggaatttgtatgctttcaaatttgaaaattgtatagtattagtgcaagaatcaaaaaatattattccaacattgaatatgtagtttatttatgttcacacaaatcatctagtttatttttgtagataaactggagtacatttgtgctattaatctcacacgtcaaatttgcatatttgctccaacaaactaacatggcacaaactttgaattgaagttatttatttttcttgttgacgtaactattccataggattagtttcaaattttattttctacttgcattattctacttgttgtgtggattcctgactatgaaatgcattgcctaggtatataattgcatatctcttcagttttatgaatttgatttaaaattgaagtgtacttgattggtggactatttgaagaataatcttccagatggctgaggacacattttataatagaaatcttgatttaaaataaacatatggcatcctttacatgagctttatattgaagttacagtgttttttcaatgtaattcctatacaatttcactgtaatttgattcaaaagttataaaatattttttccaaataactgagatgcatatagttttgaatacaaatgaattccaacatatctaaatagataaaatttgtcacattcagctattttgaaacagaagggtagagttgaaattgaataattacatacctttggattttttttccagaatggaattgcttttcttccaccatccttagaatatttgacattcctgaatctaaatgcatttacaaattgaaaatacaagtaagcatggaaggtatgcaaatcatccttctcgtgctcagaattaacattgtataattcttaaatgaacagagtacactcttttcatattatatacttgcagaaaacaaatgtttcaaactctacacaataaatttg

SEQ ID NO: 102227 - DNA, 684 bp, Oryza sativa
aaatcaattaaggatttttctgtttttagtaaaaacacagtgaatcttctaaaattcatatctaattcatctgagctccgtttaagcccattcaaatctcagtaaatcaagaaatatatatagaatccattaaaaatggttttgttctctgtttcagtagtcttatagcctgtttgtattgtttgctttgtatgtcgcttagattccggctctcccgacgctccggcgtactttgaaatagtcgccgaggttcctccagcagcagagcaaggcaagtcattcttgtcacttgaacatgttgatcctatattgcaaatgctccattgttttccttcaaatactgcattgttttataatattaccatgggatgtttacctactgttatagccatgctattttgtaccatggtcctttgttagcttgggatataacatgcctagatattggactagggattgcttagccatgcttagttcaactagcacacaatggggaaaattatattaatgtatagacttcaggatctagtgttgatgttggattagagccaccgtcctggtgtcgcttcattaaaatatgttaaatggtgggctgtgggtgcatggttttgctagtcgcgcccatggcacttaaggatcggttcgcgggaaaccctagaagaattcctcgtacttaccacaagc

SEQ ID NO: 102228 - DNA, 690 bp, Oryza sativa
tagggaaggaggcgaaaggagggagaaaattgtgattttgctatcgcaaaagaatggtttcgctggaatgctatcccttcaaagtgattcattaaatgctatcataaactaagggtgttcactgaaatgctattttagatctttttgattgctagaaatgattttactctattttaagttttgttctgaccaaaatacccttgtgtccttgtctttattacgttgtgaaccatggtgcatgtgaaccactggtatgttgtgaactactgttatgttgtgaaccattgttatgtgaggtattttgtgaaccacatgctattcaatattatgtctacatgctgtccaaatttgttctattttgtttttacaattttttcatgcccaaattttatgggttaagctagcttctccattatatctttataacttggagtgagaaaaatcttgatgtgtatgcgcgcttgtggctgaactggactacacaccatttttaattgtacaaaatgtgaaagcaaaatatattgctatagcaaagcatgtgtcaaaaccagagaagtgctgtttgactttcaaaccagtgcactagagcttttgtattagtgttaatgatcaattagtatatatatatcacgcagcggagcgtgagccgtgcataggtttcacaaatatatagcaatatattttgctaga

SEQ ID NO: 102229 - DNA, 617 bp, Oryza sativa
tgatttaatggaattgtctcttttgcatgggaaattatcacccaaaatggccctgcaagtgcagtatatttaggtaagaaatctttggtgttaactgtaaaatgtgcaattgtataaacttctttatccacatcaattcaatgcgcaaatacacaggtgcatatgatgatgaagaggctgcagcaagagcttatgaccttgctgcattgaaatactggggagctgggacacaaataaactttcctgtgagtcatctatacttgctaattataattggtttcttagcttccatttagttcttctacaattattaaccacacactgccttttcttcaagaccttcatttggttaaatttaatcatttatattttgcatcacctgagctcaatttcgaagactgattctcttaagatgcaaattgaaaaccaaaagatatcttagagagtgttgtaccaaactttggatcatactagtccaaacatatcctatgcaactattgtgtgatgtttgaaaaatctgaatactcttgactattatattatgttcttttgtatgcaaaggttagggatttattcagtttacacttgacgattcggagatggatgtttgtgtcctt

SEQ ID NO: 102230 - DNA, 622 bp, Oryza sativa
acaagatagcactaggaacaactcatgcacaactctgatatatgaagtttagctcaaacataacagtattttctcttttctttctttcttctttcttcttttcttttttttccttttcttttctgttttttttttgtgtggctttttttttctttttttttgcacctttcttcctttttttcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaagggaactgatttttaaccaatccaatctactatatctttccaaaacaatcttgactacttccaaaatcagatatggtaattcaccttcctcctctcgtgcacgaca

SEQ ID NO: 102231 - DNA, 817 bp, Oryza sativa
ttattggctgaaacttcggtgaaattatgaacaatacctattgaattgagcaaatctatccaacaaaatataactcaatagatcggatttaaccgagacagtatgacattgatgatgagcttaatagatttaaacaaaccgatagatattatgcaaggcgattgatatattgaatctaactaagataacaaagcaattaaagaaagatctggtacatcatataaggaacgcaattaaagacatcatgagtatatcagacttaagcaagaaagtactagccggaccgatacaggcctagctaacggaatttactttctcaccggaggttgaaacttaacatatgtagcccaacttgtcaacacgttttcttaccggagatcaaactttatcaatgtagcctgctcaaaaacaagaatccgtcgacaggttaggactagtgttgcaaagtgccaaaagttatatataaaactgttgtgattacagaccctgggtatatatatttatacccttggactggaacaagtccgactcaaacatgacctgatctgctcagaactctagctaattacaaaagagggaaacgacaagtctgactcaatacgctccgattggcttaggactctatctatattatacaaattttcctcgattcggaagatgattccaaaatagaattaaaactaaccaaactcatcttatacactttccaactgacgcaactacaatcatggcgtcaacttctcctttgacttggtcttgacttgtcaaattttgcctttaacaataataattggaatataaaaactattaggggatt

SEQ ID NO: 102232 - DNA, 651 bp, Oryza sativa
cagcatctgtcattgctgaaaaataatcagcaatggcgggaatagattaatactagtagtttacagtgtgtatctagcctagatgtagcaatatatacttgttgagtaatggaccataagaacgacggttttgttcttagttaagtgatgttaactaggccgtaccaaagatacatgcatccaaaacgggcgtattgtgattgatgtttaacgaaaaatgtcaacgtcgccttgtagctatcaagcgtggttttttttatatatatggaaggagggatccaaaggtgacgcatgctcttccgcttaacaagggatggagcgcctgttcatcaaggacctaattttggcgttattttctcccgtctaccgggaggtactagtactgggaggtacaaaatcaaatctgaccatctatcgtgagagggtacaattgagaaacacagaagagaagcgaaaccatctccggtgtcgcgccaccgctttctcatctgtttaaagggttcgctcttctcatctgttcagaagaattcggtaaaattgtaaagaaattgaatggcacaatttcctgagtgccttgtagttgcagacagcagcagaatgtatagtaagcagaactaagtgttcactgttcagggcttcagacaggcgctt

SEQ ID NO: 102233 - DNA, 606 bp, Oryza sativa
atggcttcctaaaagcatcaatgttggaagtttgtggtacaagaatgattgtttcatattggccactcatgctacgaaggttttctatttgccagatacaaagctgggtgaaaattggcaagttgtacagacatttgaccataggcatctttataacgtaagtcagacggaggttagtgctactgcatatcaagaagacgagtgctatgatgaggaggatccacgccgaccagtttctagcattatatatgatacgcctttaaatagagatgatgagcgtggccctgtttttgaagctgctgaaattgctcggttgatgaaagaatctagcaaagaagtgaatgtcattggtgatgaagatgaagatgaagaagatgacacacttatggagtattttaacgaagaagatgactcagttatggaggtcgatagtgacgacgaatagttctgtttgaattttatgttttaatattttgtcgtaaggctcaattagtatttgagaccatgttctacttatttgataccatatgttctattatttagatagcctcaattgtatttgagatcatgttcatctatggaattatgtataatggttcgatgcca

SEQ ID NO: 102234 - DNA, 668 bp, Oryza sativa
tcccctccacgccaaagcagcagtagaagggacattgaatatgctccaggcctgattcctaatggaggtggaccatcttcccctgtcatcggctatcatgcccccaggactttaactccctccaagatctaatcagggaaccagcagatgcaggcaagaaaagaaaaactaggtcatcggctgtggacgttttggctctagctccaaagaaaaaaaccaagtcgaagaaaactaagacgactgatgacctgcctgccttagatccatccattgaacaagctctggatgaagaagagattggtgaagatgttgaccaggctgcagccgaagtgagtgacacagaaaaaacaccaccagcttcacccaagaagacacctccaactccttctgcccccactcatttctcaagagtaagcatatctcttcggcttcttttgtaattacttcacttttcggcgaactactcattgactctatggttgcagaagaagaaaactgctgtgaagaagaagccagcagcaacaattctcaagtcggctccaccagtaagatatttttaattcttttactagtcaatctcagccgattttatataacacttgtctattttacagcctcctcctcctcctccttccgtacagcaatcgtcaagtgaccgaactccatcg

SEQ ID NO: 102235 - DNA, 636 bp, Oryza sativa
caaaattccgtcaaaaatcctccctttttggtgcttagatgccaaagggggagaagatatatccttttattatggtcgatcatgagtggtttttatttgtatgagagatgtgtgtttcttaagttagtttaatgctttgtaagacattattgtttaattatgaatgcttgggatgtaatgtgatatatttgtagatgtgatgaatgtgatgagcaaaatgtgttatatttgtagtcttgtgagcttcaatgtggatgcaaagatttagggggagctctctacttgctttaatgcactcttttagggggagattttactaaatctttgcaccaaaatcatctattatattcattctctcttgtgatctaatcgtattgtcataaatcaacaaaaagggggagattgaaagtgcatctaggctcctaatgattttgatgattgattacaatgtgattagagaggactaacacttttattcaagcaaatgtgaaggttgttatgtcctcgacatgttgtaatgagatgcataccccatgaatgcgacatcacgatgcaatgcggcaatgatcaaatggtatattgtatcttttaccttgcattgtgtcgtaggaatgccgtactatttctcgttgcctt

SEQ ID NO: 102236 - DNA, 659 bp, Oryza sativa
atttcaaatggaaaagtcatcaaaaacaaagttgtatgactcatcaagatctacaacttttgttttggtcactgttccatatgatgttgtttgaatagtttgaatttgattttcaaaatatgacaatttcaaacaacattttcagatactaaatgatttcaactgaaaaagtcatcagcaataaatttgtataactcatcaagatctataacttttattttggtcatttctttgtccaacaaagttattcgtaagattgttcacataataaacatctcttatatagtttttataaaactatataagagatgtacattttgtgaacaatcttacaaatcactttatcgaatgaagaaatgaccaaaatagaagttatagatcttgatgagttatacaactttgttattgataactttttcagataaaatcatttattgcttcaaaatattatttgaagttttgaaattcaaatttttaactgataaaacaaagtcacaagaaaaaatagccaaaataataccagtaagaacacaataacattatagaacatgattttagaaacatttagggaaaaaaatcatccaatttggagttagatgcactagtttcaaatttttcaaattttattttcgcatacggcttcttaagtggctagtatg

SEQ ID NO: 102237 - DNA, 558 bp, Oryza sativa
ttttacctctgtcagtgagatcaaatccgtcgctacaatgctgccatgtctgttggtccgtcggtttcgtcaccagggcatgatttgaagcaatcagcaagcagccgccgccgaaatcatgcgaagatcaccgtcggttgagcctgtacatcaccaagtcaatactactcggatacgtacggcaagacacaaagtccaggatacaaattaaatatacctggtcaaatctgtggtcaaggaaattaatccatagacaaatcagctattacatgcacaaagtggtctccaaactaatccatgcatgtgctaccgacgattacatgtctacacggctgcatgacacggctgcatgctacggttcatccattgacaggccttgaatcaaaattggatcacaaaccaggtttatcgttctaaattttcttatataaattagatttaattcacagatcactaattattatttgatctattattttatacatgtaccgccggccgccttcgtcgctgccgattggtttcatcacctccacggttggtgtgcgccgctgccgttgc

SEQ ID NO: 102238 - DNA, 560 bp, Oryza sativa
ataacatttgtcttcaccttttcttgcttatgtatttagtgcatgtaccttgaagcatatgactagagctttgtacttttcttgtcttccttctccatataaacttatagtttactattatccttgcttaaggtggttgcttcagcaacaccaaacacgagggcggcgaatgctatctagcgccagataatggtgtcattttcttccatatttttttttgctcgccatatcttcccgctcatgtcattctaccaacacttttttttttcgtcgaagacttcatactcctacaaatgattgagacagaaaggtgttttttcttgatccagtggagataaagaaataagcatcagtactaataacattgtttactgcttactttaaatgccaatggcacgtgttgatgtagaattacgcatagataacctgccagcggctagcatcctccaaggaaattgtaccatgagttaggcaaagtttgatgaaccagagcttagaattttactaccctccggtgaatgtgacagtgaatgctatggacaggaactctttgcgatgaa

SEQ ID NO: 102239 - DNA, 549 bp, Oryza sativa
aagagacctctgttgctgtgataatccgtcttcctgtgataccagtactgtttcctgggactggtatcgatcaacaggttaatttggagcgtcaagggctagttccggtcggtactagttcggggcgtgacacaacagcttcagtatatgtggctggctcaagagaaatctccacctgttcagcacaactaaaagcataataaaccatatcacattcctcaataaggcagactggagctccacaactcctctttgttctgcgatgtgcaataggttcatcttgtggctgcaaaacaagaggtgagtgctgaataatatcattaacatcattaccaacaatttcagtttcctgatcatccacgtgctccacctgcacgctaacatattgctgctcctcatcagaaccacctggtatgatatctgtgggcaagctatcattaaacataacagattcattgaaaacaacactcctgctcatgaaggtcttattagtttcaggattccataatttatatccttttactcctgaaccataaccaagaaacagac

SEQ ID NO: 102240 - DNA, 592 bp, Oryza sativa
ctttcctctgtttctttctctgttctacgtgatcctgctttgcgccttcctctgctgctctgttttggtgtttcctccccccttttctacatcctatctactctgctccctcatttgctactatgttgtggtctttcctccctctcctctacatctcatctactatactcctccctctactgctctgttttgctccctgactccctgttagtagtagtactcagcacatatttaccctgctttgctcttcccccatgccgcctctctctgtgtattcataggatggtgttcttttagttaataaattgatatctagttaagtaattactataaccatctagtgggctcaagatttgccaagaacaaggtatatatacgtgtgttgtactgctcttaaaatacaactttgatttgctatcagattagattattttgtttgccacctaattagtatggagtgtctaaggtgttgcctcaccttgcgccttactggtaaggcgataaggcagcccgggatcatcttaggacgctttaccaccttaaccaccatccaccaaagtaatggtggaaaatttttaaggaaaaagatttt

SEQ ID NO: 102241 - DNA, 586 bp, Oryza sativa
cattataatttctttggacttcaataattttaaatcatcttactgacttactgtctgggtaaccctgttaagattgacctcttataatcaatacaagatggccacatgacactattagtctattactcgttagcatataatctctgatacatgccgcattactcacctctttttcgtggttatggacattatccagttgattggatgaccatatgacgaccacgattgattggtatgatcaccatatgatttattattgatggcgatctatgcttgcaatctcagtgtgataagagaatgttcttttgctcaaagtggtattatgcgaaaaggcttctccatgtatggacttattggagataagccctacccctcaatgaggtttgggttttacacttttccttttacttttgctcacttcaccatggtgatagggtacatggaaggtgatcacgtaacccacatattgctccccagtctgagttagggtctttctatgccaacaagcatccaatggggcctaataacagtcttccaaatcatgaaggggcaagggaagagtgtttttcattactgtagaagactt

SEQ ID NO: 102242 - DNA, 635 bp, Oryza sativa
ctgcggtcacccacgtggcctaaccccctcgggagggtcgggcccgagggggacgtgcccaccccctcctctgtctccccgaggggtcgagccgctcctgtttcggccccgagggctggggcgccccgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggactgtcacacgcctcgccccgtcccgtaggaatgatgagagcctcttgacactcgtccctagctggagccggcgtggtaactcctggagttagcacgtcagtcccgactcgattcatgccaggcttcatcgcaaccattgcaaggaagtcactgtatgaagaagggcagatgtgcggcatgctaaactgacgcgtggtggagaagaatgactggtctgtgactggactgatgcccgtcacgtcatctgcagacaaccgtgctcccacgttgcatctgcttccggcggagtggaggtaggtatgacccat

SEQ ID NO: 102243 - DNA, 2005 bp, Oryza sativa
tatgcaccttttaactgatatatgcgtaattcaaatttggattttggatcacttaagtttttcacacaaacctatgaaataatgttttactgttgtagccagaactctttagatgtaatttcctggtctggagcggctgccttttattttattttcctttagctgacctgttttttttaccataatgctgatatacagatgtcatcatgtaggcagtctaaattaagtcaccacctgatggcatgagaaatattctaacttgcttgtcttactctgcagttatgcatttcgttgaaaaggaaacatgaagaagccaaagagctagcagtgcgggctattgttaacaacaatacaatgctgatgttaaaccatccaatgtttgaggataaaatatcctactgcttatttttttagcagttaatcactgcactttcacatttattaatattaaactttttattccttaaccataattaacatttgtgctcttcagaaatttgctagcaatctgagatccaagaaggttttattcgaggatattagtgccattgatgctgtaagttatcaatctcatcccatttctcgatctctgtgactgaccttaacataattattcccacatgaagataaaagaggaagtgatattttctaaattaactgtgttgaaaatcctattagtaaaacccactatgatttgccttagttatttactgtagagagagttttcagatggcaattgaaaaacaatacccaatcacttgaagaagataaggtgatggatagtaatgccccatccttggtgtggagattgccgcatttcattatctgcatggagattattatgagcctcacaccaaccgctcataacagagatactcttgattttcaataatagtcatctctgaaggggccattgtgtatgatgattcctgagtgtctgagcaaaatgatggaatgactgtcttagaggcctaattccctcttttcagtatctcattcaggatcctccgttcctatattcaatccattcaaccaaacgctttaccttgcaccagctcctccagagaattaagtgtggaaattcttgtattataagcccatcctaaaaaggccttagtggaatagtgggttagatggtttgagatatagaacactcagatatagaacaaatggtatattcagattcatgttctacaataagattcagggtactatccatgtttgtattcaagtagccatacagggaagattatattcatgtaattaccgggaagtgattagcgtagtaaatgcatgatttttgtctatattagtagtgcaatgctaatttcctatgcttttagaaaaaaaagatttggatttttacattattcagttctaagttcaatggaagcatcagaactgaaaataaaagtggatacgttagcatgaaacactgtgctttcctcagttaaatattcttgtaatttgtcttagatgatctatctgtcatatttcataagaggtgctagacctttatagtgtgatcaactaccataaggattatggcaccatctcttgttctatttccccattggccattcccatgtctcctatacatgtatgcattgtatattagtttcttatcatctctgattgaacagtgagtgttttcagtgttatattagtgccacctaacttcgtattacccaacttgtcatatttctcatcgactgggatatatatttttttcaaaagacaagatagtctcattgactacaataataaaatgaaacacatgatggcttttatttgtatgtgcatttttttaattgagcaacagcaattgtggtttgtgagctattagcctcatagaagttttgtcaacgccagcatatgttgacacttctgtttccggattcttaagtcaacatacttctctatctgacttgctcatttagtttagcatttcaggatttcgtccataaggatattattttatttagtagaattgtgtgtgctacat

SEQ ID NO: 102244 - DNA, 584 bp, Oryza sativa
aaattgttaaccaaggagaagcggacagctactatagcttttaagcattcaccatacataagaagcacacaaatattattaagacgagacaaaatcatcagcattagaaacgatgtcagagtttgtaccgatcgaagagtcatcttcagtgaagtaggagatgatctttgcatgcccttcagtactgtagcgatccattggtttccatcaatgctcccttttgatttctacaaacaacaactacaacaaaagacgctacttatgatttgcaggaaaaagttgaatgccttgttataggacaatgaaaactggtggtgattggtgagtgtactgtgtctagtttttccaaaagctattggttgaccatgatatattttgggcataagatgaatactgtccacttattggtggttagattatttttgagcatgaaaccaaaatgaatattctatagtctgaggaactcaacactttttaagcaaggaattgaaagaatccttacaaaaagctttatgatgtcctcgatagtctcagcagagaaacatttgttgataagtgggagcctatcgaaataagattgtcat

SEQ ID NO: 102245 - DNA, 648 bp, Oryza sativa
tttttttccttttgtcatccttgagacgagatcatattgtaataaacatgtgtccactgtactagttaattactccctccatcctaaaataagtatagttttgcgctatttatgtccaacgtttgaccgttcgttttatttgaaatttttttgtgattagtatttttattattattagatgataaaacatgaataatactttatgggtgtctatttttttaattttttttataaatttttcaaataagacaaacggtcaaacgctggacacggttcctcacgactgcacttattttgggacgggggtacgtagtatccatcgtaacgcgtaaattaatatactactacttgtcaaatgaaactaatgtctcgattcctgacatgttggaattataatattgttatggtcgttattgttatatactagtatatgctagctgaccaagcaacatcccgcccaataggtttcctgcataaactgaacattacaccagtaacacgtatataactagtgacgaactgatgatttcattcaattatcatgacattgcccaaccgatggtatatattatactatatgatactcgtccggtattctaaagtattttagttttgttataagctaaatttgggtaccgagctcgaatt

SEQ ID NO: 102246 - DNA, 1067 bp, Oryza sativa
ccgccagagaaaattgattatcgctggcggccgataaccgctagcgaagattgatatattctctggcctttgctttgtggcggctgcaatttccgccagggaaaacccaaaatggccgccacgaaagatgattttcatagtagtggcaagaggacaatgtctggatatggtccgagattgattttccttccccaaccacaaaacaaaatacaaagcctttctcaattgtcaataccggttaattttgtgcccccccagcctagttgatgattaaaatagcccatacaatacatggtttcatttttgttgattcgtaagtagtacatgtaagagacaaatatattgaaaacaatgcagacacgattttataaaaaaaatgtaagataaaagtcatttcaatctctcaattcattaatttcttggcacatcataaaaaatgctaacatgacaccctatttaataagaatgaaacaacaagtgggagtggccttaataaaataataatttagtagggcgcacatgttaatgagacccactccttcatcgccccaaagtcgagcacgtcgctcgagctttagcacacgtgaacaagtgactgctaggggcacgcgctgtgctgagagggaaagaacatcataggaggaggaggaggaggagatgaggcatacggaccaggaggagggggtagacaccggtgccacctatggcgatgatgacagggcaagctagaggtagtgggcagcgatggtgatgatggaggggatcttgatggtaatggaggaggaggctatccggtggccaccatatttgcttggggggacagtggtggagcatgtggagctccgtgcataggaagctgaggagattgctggcgccactgggtcatcacctagccctaccttcattgctgcatctctacctccatcgagagccaccactacctctagctacactgagcattgttgtcgcttgcttgaactcctcatccttctccatcgagttgcatccccagacaaaatgcaagtaaacatggaccaaaagtgatattggtgagacggataggtgag

SEQ ID NO: 102247 - DNA, 522 bp, Oryza sativa
gttgctgttgcctcttttcttttgctcctggagaaaaatttttgtatcgcgctgttcccgttctgaatttttgatgtactagcaattataagttctaaattttcaaattctgcaagtgatctcataatttcctgaattttgtgcgattctgccgtgagtttcagtgtagcattctaatcgtattccgttgtgcaattgatgtacttgcaaattcctggtgtgcctgactatggttagaactaagaaatcatcttccctcgtttgtatcgaaaggaaagaaactaggctatttcatgtgatctttgcgctagaatgcttgtgacttttgaatttcgattagataattcccagtagggtacagtacttaagtatgactcgtttcttgcagcattcgctggtgcactcctcgtccgtttttttcatttatggccggcgcaatccgcgcaaaggcgagagcacgtagcgcccagctgagcacatgatgtatgctggcactggcacgttgctgctgctgccatccaa

SEQ ID NO: 102248 - DNA, 538 bp, Oryza sativa
  unsure (1)..(538): unsure at all n locations
cgctagacgtgccgggcgggtgtgacagtgcgacaccggattttcggtgcnccgccgggcgagcccgccgacttttagccgtacgtgatcgtcaaggttgcgatcgaatgaattaaatcattttgttcgtgtatatatacacgtaatgctgtcactgtaaattaaactacattccaaatcccgcggttgtttctttggttttcgaattcatgcaatttttgttggagtggaagtttgtaaattgtacctaccttcactaaccacccaggttaataaacatcaaagatgagatttgtttggaagctggaatgattcgtcttctccttcccgccctgaatatatgtactaaagattctgacatgctacaagttgactgaaagtttcatgttatgttcagatccacaatcgtgccatcctattatcttttcgtttttgaaaactaagctagattatgctggtgctatatcatgtgcaggttgcaacttggaatgaaatgctcgcttgagagcctatgtcgcctgacacagtcgatgggccg

SEQ ID NO: 102249 - DNA, 1109 bp, Oryza sativa
atggaccgctccgtttttcgtgtatgggagatgggttcccaactcccacctccgaacacagccttattataatttagaatagagataatatatctctgtcccataaagactttgtgacctccagcgctaactcccactcaatgagctcaacgcctcaatctacatcgccagcctatgactataaattgacctcagcttttagccgcctccactcaacaaagagacattgagagggatgaaataatatcttgcatgtgggccctatgaaatattttgttattttgttgattggattgtcacatggtactatatatgctagctctggccaaatccagcaaaccgcccaagatggtgctcaagatggttatttgtctggtttacaaacttaaaaattactgaatacctgattttagtttagaggataatatagactacccaataattgaaggcgggtgttaatatggactaactcaacaataaacatcaattttgaattccaccaaattttatattagagttttcaacatacttcacttttttatgcaattatagaaaacacgttatttattttaaagatagttgatcacaagcacgcaaacaatcaactacctagaatcgaactgaacatgaatgcttgtagttacgactaattattcttttataataatcgtcttatccatatatagcgatgcatatatgtggtggttgttatttcacaatctcagcatgtatcggtccgcctccgagagatgcatgcgtagggtatggtatgttcataagagtgagcgcgtctgcaagttgctagctgtttatgaggtgtttggaaaaaaaaatctctacttagcgtgatggatcttttgatcaggcgacggattcagtcattaatatcgggaaacaaccgcgcggctgaatttctgtttcttttctttccgagagagaacaattccgggtcgatcacgaatcacacaacacacgtatatgtaatgattgaactaatatatcgaaccgaactgtacatttggtcggctacgtgcataacgaggtaggagtagttcgcatctcaacttagtccggcatggcgatgatggctttgggtccatcatatcacg

SEQ ID NO: 102250 - DNA, 1559 bp, Oryza sativa
cctggtacgtacatatatttttgcatatatataggctggagttaatatctatgagttggaataattaatttagttttttattgttgtgagcgaaaaagaaaagaaaagagataagatggacgtggggccatgcctgaagtacgtacgtacttacatgcacctatgtgggttatgtgggccttttgagataaatcggcttggctatttttattataaattaaatggtaaaaaataatgggtccaccagattaaatgaaaactaactgttaaatttattttagaattctaaatttattagagcggcatgtggcggtatagaagccactaatttaagtgaaaatcgacagttagatttgatattttatattttttacgagtctagttgattcatatttgtggaataatatattttatttttataagtagaaaattctatttttgattttttcgatggtactatatacgtatattttttggctttatttttttatcgtaaatacgctggtatgtttttttcctccctcatgaatcgtagattcgtaagtaagccgctcttttccaaacgaaccgatgaagagaagttaagctttattgttttctacatagtacgtacgtacttatggagtatttatgttttttccctgccaacagtaagctattagtttctttttaaataaaatacatctaatctaatctaatggtctaaattatcggatccaccaatttaagtgaaaatcgacggcgagattagatattgccacatggcggtttaggaacgtttgtagtagtgtcacgtggtttttggctttatttattttatcgtaaatacgctggtacgttttttttcctccctcacaaatcgtagattcgtaagtaagccgctcttttccaagcgaaccgatgaagagaagttaagctttattgttttctatatagtatgtacgtacttatggaatatttatgtttttttccagtaaggtattagtttctttttaaataaaatacatctaatctaatctaatggtctaaattatcggatccaccaatttaagtgaaaatcgacggcgagattagacattgccacatggcggtctaggatcgtttgtagtagtgccacgtggcggcttgagagcatttgtaggaagtttaatggacttgtagtatataatatataatagaagatggtagctactacctaatctcgtggaacaagtctcccggtctcattgttcatacttatgcatggtacgttgcctttgttttgttctgtagatatgatttgtctgttagcttatccggtactccctccgtttcagattataagacattttgactttagtaaaagtcaaactgttttaagtttgaccaagttcgtataaaaaaatagtatcatttttaacctaaaacaattttattatgaaaatatattcaattattgatttaatgaaactaatttagtattataaatattactatattagtcaaatttgaaacgatctaacgttgaccaaagtcaaaacgttttataactaaaacggagggagtagtattaataaaca

SEQ ID NO: 102251 - DNA, 2546 bp, Oryza sativa
  unsure (1)..(2546): unsure at all n locations
atatattcatagttaaatttattgtttttttataacttgtagaagtcgaatttgnacttgcangattgnnaagtnatatattacatattaacctatcatatcaattttttttaaatttttcataaccatttaaatgacatgcaagaaacgggtagacgtccaccgagtgtttaaaatagtttcctatagtgatatagtcaaaagggtcgatattccacaccagctacgcgctagattgcgaaaagcatcgaagaaatgtttgcgcaagaacaggcttttttccaaacaagagccaatttttattgtgatcctcttatctcacgggtgagtggtcatgctccatacgtatcacccgtgagacccagcttaattagagtcaaaaactaacactgataattatagttagctaatgccacgccatttaatagacatgtttacggagtacttaactatacttaatagagttgtctacgtactcggatcaatcggtgatcctagcaagcaagcccattgatttgacatcggcgtcaacaagctgatctgtcaaagagcatgttaattaatgaacaatcttatagtagtactccacatccctaaacacaaaggattttggttggatgtgatatatcctaatacaacgaatctgaacaagctcctgtccagattcattatactaggatatgtcacgttcaactaaaatctcttatatttagagacggagggagtactacactgctccagtatatttattacgatatttcttatttaatcgactgattttaccaattgattttttaccatgtactctgatccaatcgtccgttcacaaaagttacgattggaatgccgaaataacccgcgtgatatatagcgacgtggatacgcgtgacgtcttcctaatctatttcccatcttctctctatatcgtgtcgtcccaaacaactcctccatagtgtgtatcaataaacacaagccttcctagtccatagatcacacgaattgaaccattgggatatggtacctcctaaagacaagatttagaggaagagatgtttctctaaacaataattttaagaaaaaaaattgtgaacttttggagactgaaaacgaaatattaggtttaaaacctcacaccccactctactcgaactataaaaggtctctgtttaattagagttgttagattagaagagtactcttcatatgacctccgctgtgggatgtaggattggcgttaagtttaacgtctctctaaaaatgtatcctcgctccaatcttatttttttcttctgttttttttaattctttgaccagctgagaatggcatgtttgtcaaaccgtaccccatatctcgctgctctctagatgatttggacgtccagacggtcacggggccatgcatggtgcatgcaccaccttggaattaattccaaaagcttctctgctagccgtccgttggaattcgagtgcctctttgcctggaatttcaacatatgtgtttcgcagtgaccatgcatgcatgagtgtcatggctagcactttcaccagctcaaatgtatcagatcaaggctaataatacagccgacctgctggctataaggttctttatagccttctctcagtctacccatataatagttagctcttcacaattaatacatggcccacttgtctctctcacagagtttcttggttcttgtgttcaagccagctgttagtttacagcccgcttctcctctctctcctctcttctttcctccaactcagcatttagccggcttatagcctactattatacttgctcttagtcgccactgcagactatttggaaatgcaggaatatattacataattttacatacaagtcagtttaaccataataaatttctcctatacgcagggctgtccatagaaatatacggccctgtgcaaaatataaaataaatcagtatatgtactagcgacacagcaaaagctatatcaaagaaacgaatctacgtatgacgtctgcctaggtagaataagaatcgtggtaccaattcatcaatttttcttagtagttaagtagaaaaataaaatttttattatttgaaatagacgttattgcatacaagataaaaaatgtatatcttcaaagtagccataattatgattaaacacttgttggagtgaagaaaaaacacatatattgacatgtttggtagcaccccagctcctaaattttctcaagtgcaggagtggagtaatggtgcagcctaaacccagctccacctcttttattttgtaagagtgctcgatccagctatacttttattttgggtggagctgaaggcgccgtgccaaacagtcccttaattatctgccagtcttatatgtgtcatttaacgatttatcatcgaatccacatgtcatacatatacgagagtccacatgttataaactatgagcggcaaattattaaatatcacatcttaaaagtagcaaatagttaaatatccccgcaaaaaaaaagttaaatatcccaaagagaagcccgttctagtaga

SEQ ID NO: 102252 - DNA, 1809 bp, Oryza sativa
gagaaggagacgggggaggagaaggggatgtgggctatgtacatggacggcttagtctatgacatgtggggacagaaggagtggggttcagcgtgtcctggagcgagcagacgtggcccgcccgagggggtgcgaggcgacctcgcggcgacggagcgacgagcgggcgaggtgggggcgatgtgtccggttcccagccacaggaggagggcacgagagattctgggccgtcgatcggacgtggcgtgagaggttattagggcagtcccaacctttaacatagacatgttttccataaactctacatcattaagaaactagtactagacactactcttctaatataaacaccactattccattaatttaatgctacttatctcacatgatgtcttagatgttgtgtagaaaccatgtctcatgcaagacatggtttccctctttttcttcatttattcacctgccacatcattttttcctagttggcaatttatttaatgctatgaatactattctatttattgggttgggaatgcccttacccgctgatccgattacacgcgtacaccttacttacgtgtagccacttggtatcactcccttgtttcagcgttaaaaaggttcaggtagtgagaggtagacacatgctttcatcgaggaaactgccgtaatcggcaaaaactggaggtggtgcttgctcagcttggctgcttggggcgtcgagtcgagatggatcggagcatgcaatcgttgagttagggttcaggttgaatctcgggctattactaaggctgtgttcggtaggaaggataggaactaatctcttctatacggaaaacagagcgattttttagtacgtgattaattaagtactagttatttttttttaaaaaaatagattaacatgattttttaaaacatttttttgtatggaaaaatttttcaacaaacatatcgtttaacagtttaaaaaacttgcgcgtgaaaaaagagtggagtggattcccaactgctcctgccgaacgcagcggcgaatccagcatggttgttggggggactcgagtccccctaactagctggatcatcattgatagatggagagatgaaagaggtaaagagggagaaaatgaagagtagggggactgaaaaagaaagaagaagataagtccccccgaatagggagtttggctaatctcgcggactttcattttgtacaggtgtaacgagaaagcggattgggtggtcaactttggttttcatggatatggagtttggtgcgtttttctttctttttttttttactcatgcaaagtgggcttttgcgatgcaagcgtgcaacatataaaagcgtcatttgatagttcattttctaacaagtaccgtagtttttttaaataactaaatttgtgataaatgggagaaaaacatacttgttcattttacttgcatcctagtgggtcttgcactatgtgagatagtatgtaaaggaggatggacgaatgaaactccagctttttacaaaaaaagttagaaccttggctggactgaataattcatccgacctttattttttcatgaaatctgatcttcctttggatatcacgagacacttacatgcacttgtatctcaaaagatttatctatggccagaatccagataccatgcatgtcctttttccgatcgcaatatccaaacgctccactcatagagaccgcgtatagtcgtatacccgcaccctaaaatacgactacaactacaagacgatctttccaaaggaagaccgaaatcagatgacgactttattcgag

SEQ ID NO: 102253 - DNA, 580 bp, Oryza sativa
attaatctcgcgattaacaattaaaagctagctcgattgggatgacaatagctatatcacgggcgggagtggcggcgcgatatgttaattattacgattatcggcctcacgcaatgcgtttccggtgcgagttagcatggaatttctttcttaatttgcccgtacgtacactatatgcttttcagtaccatgcacgatagcggcggcggcggccggcccacgtgtcatgtaagctagctccaaacaaaatgcacacatcattaatcatttatcattatttggtttttttgactataatatatactctctcattccctaaatgtttgacgctgttgacttttttaaacatgtttgaccattcctcttatttaaaaacttttataaaaatatgtaaaactatatgtatacataaaattatatttaacaatgaattaaatgataggaaaaaaataataattacttaaattttttgaataagacgaacggtcaaacatgtttaaaaaaatcaacggcgtcaaacatttaggaatggaggaagtatatattaatatatgtagttatatgcaccttttctctttgg

SEQ ID NO: 102254 - DNA, 1907 bp, Oryza sativa
gtgtggcataggccggcccgtttaaggacctcgagttataccttgtttgtctctccgtgtctaaaaaatgttctgcagatatgtaggtatggggatgggatacgattgatctgggattgtggaagatggaagttgtggacttgtggtgcactgctgtcattgagttgttttgtgatgtgcagtaaggtttggttggagaacttaaaattatgagaaatagtgatctgaaaaccttaggtttctcaacattcgacttctagtttatttttcagacttttaactatatattcttagaatctaaatgaatagttgtatttttttggatcttctgattctaagtgaagctacagttaccataagctctccaaacaagtccatagactgcattggagctaccgctgctcatagatgtgcactgaattatggatattctagttcttggcgttggtagaaagcatgttcacttgttgcctcttaggtaaaattttgctataggacatagtaaacataatctttgccacatgacaccaaataacataggatacttgataacaatccggcccaggtgaggttggccgaggcccccggaccccaacagttcataggcacacccactcggggaaaggcccaatcaccctaaaagactagtccgataggagaagggtggctctctcttttaaggtggtttcctcctcctcccaagctaagcaatgtgggattatttagaggctcacacagtcgccgcctgactttggcgtctttgccagcgggtaatagtggaggatgtcctcatcattcaccccttaacaaggacccagctctgataccaaatgataacgatccggcccagatggggttggccgaggcccaataatttaaggttgcccggaccccaacagttcataggcacaccaactcggggaaaggcccaatcaccctaaaagactagtccaatagaggaatggtggctctcccttttaaggtggcttcctcctcccaagctaagcaatgtgggattattcagaggctcacacggtcgccgcccaactttggcgtctttgccagcggtaataatgcaggatgtcctcatcaacacttttgaaatatagtaatttttctaccgaataccacatacaatattttatcatttgtgcttttggagaaaaaaaaaagtgaaacgacaagagtgtccttggaccagataggattatgtatccttaagggtggcaacaggccgggaccgggttgggctagaacgtcccagcccccagccccacaaaggcaatcgggtgaaaatcatcacccgtacccgcccctgtaagggacccgacgggtaaccgaggtcctgcatcacccggatgaagttatactccataaaatatgacaatacaccaaataatagtatgaaaaaaatttcaatagcaatatatactcattgatcatcacacccatacctaaagcacatggtcaaggtcaatccactaatacacgaaagtagcacatatacatacatgacacattatgattagcacgtggcaggttggaccgcggctggttgctataggtcatgtataatggtctttattagcggtctctctttattatcatgtaagcatatttggtgacgtggaagagagagaaagaaggaaagagaaagatggttgctacgcatgacaacggcatagagtcgatcttagcatttataaggaaatttttcgttgcattgagtctaataaaggaaagatgactagtaaaaaagtattttggtacattaatggttagataccgtttttttctaactattgtaatgtgatagcctctaattaacgtagaggccacactagtctctacctttgtacttacccttagtgactcgatgacgagacgacgtggagacgaatcgatgt

SEQ ID NO: 102255 - DNA, 713 bp, Oryza sativa
gtgaaaatagggttgttctttttaataatgaaaaactagcatggtagcccatacagattacgcggctagcattattatattttctcttatataatagcatatatgttttctcattatattattcaaatatattaaaatgacaacataattctaaattttgcaataactttacaaaactactaatgtgtaatattcatattgtattttatatacgtgttagttattaattatttttaatatcaaattttagttaattttctgtaaattgtatttctatatagactctatgctcttgtttcaatattatttatttttatttctgaatttttattatttctaattatatttctatgtggactctaaactcatctttcaatattctttaatttttaatttcgaatttcagttacttctaaattgtgttccttcatcgactttaaactcttcttcccatgtttttcttaattttgaattttagttatttgtaaattgtatttttatacggactctaaactctactttttaattttattatatttattccaaattttagttagttttaaattcctatatggactctatactctacttctaatattccttatttttaattccaaatttctattttttttcttcattgcatttctatatggtctatatactctacttctaatattccttattttaattccaaatttcagtgggctgcagga

SEQ ID NO: 102256 - DNA, 692 bp, Oryza sativa
gcactttacacaccaacatcctgcagcaacgcacaggggggcatttacggaacttattttaatcaaccccattcattattaaaaaccttccttcttttggtaaaaaaatattttggtaatagtaagagataagccgaatacttacacgtactaatctttaaactgtacattggctggagggggactagatagtgagagatgagaaacttgtaggcatgcaaaaaaatgtccttcgtattatatgagaaaatgcaaggtttataccaaagacttgtgtatctatcagctatgtaagggctggtaccttccttggctccttgatgcaccaactcttgtttagctgtccccttttttgtcttccagcaacatcgttatcaaaatataaaatatatttcatgataaagactacttttatgtatatatgttggtaaatttacaggggtcattattctgctcactatcgaatccaatgcttctgaaaggtagcatggtttataagatgaagtccaagagggagatgttacagcaaaggcaacaattgcccaatcagtatcatttcctttcacatatcaactcagcagtgaattttgaggagaagcaaacaacatcatacagaaatactgacattgcaattgttgggagggatgcagacttagataatctcatggacattttaatggaaaacagcgctg

SEQ ID NO: 102257 - DNA, 543 bp, Oryza sativa
tgaggaaatgcttcacatgcataacttggcgcatgatcttgctagatcagttgctggtgaagatatccttgttattttagatgctgagaatgagcgcaatgccagatattgtgattaccgttatgcacaggtgtctgcttctagtttagagtcaatcgatcgcaaggcatggccttccaaggcaaggtcactaattttcaagaatagtggtgcagactttgagcatgtcagtgaagttctttcagtgaacaaatacttgcgtgttttggatctcagtggatgctgtgttcaagatattccatctcctatctttcagctgaaacaactgagatacctcgacgtttcatctttatctattacagcactccctctgcaaattagtagctttcataagttacaaatgttggatctttcagaaactgaacttacagagttgccaccctttataagcaacttaaaagggctgaattatttgaatctccaaggttgccagaaacttcaacgattgaatagccttcatttgttgcatgatctacattacct

SEQ ID NO: 102258 - DNA, 511 bp, Oryza sativa
cccacgtaaccaagtgactgttaggggcaccccctgtgctgagagggaaagaacatcataggaggaggaggaggaggaaatgaggcatacggaccaggaggagggggtagacaccggtgccacctatggcgatgatgacagggcaagctaaaggtagtgggcagcgatggtgatgatggaggggatcttgatggtaatggaggaggaggctatccggtggccaccatatttgcttggggggacagtggtggagcatgtggagctccgtgcataggaagctgaggagattgctggcgccactgggtcatcacctagccttaccttcattgttgcatctctacctccatcgagagccaccactacttctagctacactgagcattgttgtcgctggcttgaactcctcatccttctccatcgagttgcatccccagacaaaatgcaagtaaacatggaccaaaagtgatattggtgagacggataggtgaccggccttccattcaccatgtgt

SEQ ID NO: 102259 - DNA, 607 bp, Oryza sativa
tcctgcagcccttctttcctggcttgtttcctctctcacctcaatccctgtcacagatgtttaacagaaaaaaaggaaagaatgtcacgggtatgcctcaagaaactcaagttttcaactcaatccaccactggcctcaagagagttagcaagggcacacccttggtccattccaagcatgctgttagttcacagctaccattggttggaagtcaagaccaaaatcagtatgtgtttgatcgagcatttgccacccaggtcaatgagcttccaatgccagaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtacaaagtagagagcccaatggagagaatccattgaatcccgggaaatgctttcctcctagcctttcgtaccacgtggggtcacgtactaagcaagccaaaggcaagaagagtaagaatcataagagaaaagcgccgatgcgaactgaagaaaaaatacgtaagatgacta

SEQ ID NO: 102260 - DNA, 633 bp, Oryza sativa
attccatgtgggttttaatttttttattttgcttctattgtgggttttaaaaatttttagtttgcttctatttttagaaaaaaagggcattttacaaatttgccattggtttttttaattttgtaagaatgccacttgagtatcagttctggtgatatttttgcaattttctagcggcagtattgtaataacgattcaaaccattggcaaatttgtgattgcctcttagaacaaaggatattaaaaatgtgcaagccaagtacatatttattacaagtatataataatctaaacagtagaaaacctatcacaatactaatcactttgctgtttaagtcaacaaaagtacaaaactacatactggtttgttcgcccttcttagcagccaagcagctgcttgtagatgcagcaaaacaacttgcgatcagctgccttgggttgcctagcagccgttgtactaagcaaccgaacaagccctttaagcactaatttacttgatcaaagcgatacactattttagaaagctccataaagataacgaagttagtgtcattgagactacggtgaaaacaatgagcctttataggtggattcggtgtggagtcccatagaaaggctgcataggcgactgaa

SEQ ID NO: 102261 - DNA, 708 bp, Oryza sativa
tgcaccccgaattgtctctacgaattagaattattgatgatgtggctgcttacatgccatgatgtggcttctttgatgctttgctttatataggaagataggattgttcaagaagtgagtgatgatattctaattaggatgtgtttgcactacaacaaatataccttgtagagagattttactaatactatagagacatttttaaaatgccttcctaatactataaagacagttttaaaatgtctttacagtgttatagagacattttgaagagtgtctttttaaaacgcctttacatgcatttttaaaatgccttcctaatactataaagacatttttaaaatgcctttaccatgttatagagacattttgaagagtgttttataagtgccatttggtgaattttacggcaactatagcaaatcaatatgaaaaagaaagaatttacggatattctaattaggatgtgtttgcactacaacaaatataccttgtagagagattttactaatactatagagacatttttaaaatgccttcctaatactataaagacagttttaaaatgtctttacagtgttatagagacattttgaagagtgtctttttaaaacgcctttacatgcatttttaaaatgccttcctaatactataaagacatttttaaaatgcctttaccatgttatagagacattttgaagagtgttt

SEQ ID NO: 102262 - DNA, 679 bp, Oryza sativa
ccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagc

SEQ ID NO: 102263 - DNA, 886 bp, Oryza sativa
caccaacaaatctttttttttttgaggaaatgcaccaggaaatcttagcagtgaaacaactctgaggtggcattaccaatatagtgagttaattccatatggaattaaagaccatgttcatttatttctttttggtaaaacttgctatgctacatcgtaaattcataatatttactgtagaataatatagaaatgtgcatttattatatgacctctattttcatattcttactcaattccagagagataattagaatagatgattttaccccatgtcaggttgtaggcttaacccacatatatttataacccaaattgcagagatcaaatcatttcaaagatgcttggtagaatggaattctccaatttattaaaaatggacatgataagaattcaaaatttatgtaaatgttttaaaaaattgttgggtttaaaacccattctaaatggaaatattcaaatattttagcaggactaatagaacgaaaatatctaaaatttcgaatagaatctgataaaaatttggactttttgagcaaatgtttggggaaagatatccccatgggtagttgaaatacccaaaaatttttcataggaactacatctattgtctcgacataatattatctcataaagtgaaaactgtacgattttaagtaattttagtttagaatttatgtgctgcaagggtaattagaagaaaatcataacccacgttgaaagcacattaaataagttaaataataatttatatatagtaaagtaatattttaatacaaagtcacatacatagatattcgtaataaaatttcacacatattaaattagttgcacgcgcatgtgcgcgggctacctttctagttaggaataaaatgctcataaattt

SEQ ID NO: 102264 - DNA, 623 bp, Oryza sativa
tcttgctttcggattgagctgcatcggtttcgatcttcaactagaggtaaaacttgttatggcggcttgcgtttcgggattagtgcttccatctttatgatactctaatcttgttatgtagttcgttgagttatcagatattctatataatctcaggcaatattgttatctaaccctcaaatcggctaacatctgttgctaaaaggcagccgatcaggttaaatactattgttgacttagattatataggatatctaccgctctatgaaatatccaacggcttgattgtctagatattgtccttcttttcatacttatagctgcatcagttgagtttgatcttataagttgtcttagaatctcaatctctagcctgcttttggttgccgattagggtagtatcggggtttcaaccgatcttacctgatttagctttatatttcatgtatttgattgatattgaaagtgcatctaggcccctaatgattttggtgattaattacaatgcgattagagaggactaacatttttatttaagcaaatgtgaaggttgttttgtcctcaatgagttagcgtaatacatatcccgccgaatacgttgatgtgatgtaatgcggcaaatg

SEQ ID NO: 102265 - DNA, 648 bp, Oryza sativa
gcctggagaggatggtattttgctttcaaaatacttaaccctgtttggctttgctttgggggtggtgtctgcgaattgcgctctaccaatgagttcctagattcggtgcataatctctttggtgattgaggataacagttgccatctacaaaaaaccatttgagaaatgaataaccgaacaatgcaacaagcaattaaagaagttttaatttatgaacttcctgtttaaataatgtgtgatcatatttcatatggttatcaaatttgttagtccataaataaacacttaaatgctccatactgcctcaagcattccttgtgcatgacaataaggcgtcaattctactttcaatgcaaaccgacaacagttgatatgaaacaaaataggatacatgctgctgcaaaactgagctcgtggtatccccagttcaagagtaatagatgcatgactatgttcaaggaccaaagtccatactaagctagactgtacagttcagctcataagtctagaggagccagaggtttccttggtaaatggcactttttgttacattatagggacttttaaaatttttagtggccataccttttcatcacagtcctttctgccacctatatataggctacaatgcagaattgcacatacta

SEQ ID NO: 102266 - DNA, 1251 bp, Oryza sativa
acatttaatatattcatgttgaagtatgtgaatagtcagctcttccatcaaagccaagtacaagttaaataatagagccttcaatttttcttctcctctctccttttctcacttatgtatttagtgtatttatccaggagcacgtgttaagtgaactctcatttatttttttaactctctcctccacataagtatagttgacttatactcactattatccttactctaacccttttcaatttttgacttatgcttgctattatccttactctaaccctttttcaatttttaaattccttcttctccacataattttacagttggcttatagctacgctactatatactcctttcatcttattttaagtacagtcgtgggttttcatgtctaacgtttgaccgtccatcttatttaaatatttatgatttgttttttttaaagtcacacataaaatactatttatgttttatcatatgtcataataaaaatattaatcataaatatatttaataaggtggacgatcaacattacatagaaacccacaactatacttaaaatgggacggagggagtgttaaactcggagcaagtttaatagtatagccaactactaactctaaattatctatagtcaatttaatagtcaattcatataatagttacctataaataaaaactacactattaatatctggtcacatctgtcatacacacattgtgtcttaaagtccgtactacagttggctataatctgtagccacatgcttctctctctttttttatcatctcgatatacttttaaagctgatttataggctgctagtttacctgctcttggctctgttcgcaagagggtgttcccaactctcccctctcgttttttacgcgcacgctttttaaattgttaaacgatgtgttttttttaaaaaaaacaatctatacgaaagttgattaaaaaatcatattgatctattttttaaaaaaacactaaaacttaattaattacgtgataatgaaccgcttgttttcggtatggagggaatgagttccaaagcaccggaaacgaacgcaccctactctgtgtgagagagagagatggcatcatggtcttctcatctgggtattactcggcagccttgtgctacgcgcacgtacgttaaaaaacacacacacagacacagataccgtagctctcgtgggtctccgggtctcgatgcactgctcccagctgctgcaaaaggagcgccatg

SEQ ID NO: 102267 - DNA, 913 bp, Oryza sativa
cacaagacccacttttactgtaactgatcaaacagaaattaaaaataaatcgcttgacaagaacatgagggactcaaaattgatgttatcttctatctcccaagacaattgatcacctaacaagttatccacacattcatgtgtggcagcaaatcagcaatatagcacagtgaccctcaatgattaacaacatcagttacagcaccatctcacaaagcagtgtgtggcatatacttcctctgttacaaatgtaaggtatattttatctcgttatgacgaggcttaaccaacaattattactctattgggatattatttatgttattaaaagcacataactaaatatttttaaatacgaatataataaattctatttcatatcacaaaattatactataacaaagttattattggtcctaacgaaataaaatatgccttatattttgaaatagatggatggagtatataactagccaggtgcccaagttgcctggcttaatcagagagaggagttttcaagggtgaaaaggaaggcatggaaaaagaaagagaagctcctcactttcaagaagcaaaaggcagtactaattacactaaacaaatggtgttgagttccaccgagtaaagcaaaaggcaaaggaaggctacttgtccagagcatgccaaacttgcctggtgatgatgaagcaaggaggatggcttggctgttgcttgacgcacttttcacgtcacaattgacatcagactggacactgcaattgggcttgtgagtgaatagtgatggcaattgtgcccgtttgactcgtttacccgtgggtaaaaaccccattagggttgggtttgttctccattttatacccatgagtatcttattgggtcaaaagctatgcccgatgggtaaatgggcatgggt

SEQ ID NO: 102268 - DNA, 580 bp, Oryza sativa
aacttttagatggtaaaaacacgctaaaaacgacattttagtcttctgatgtccttatgtcatgggatttaactctgtgatcaggttgagatctctctctctctctctctctctctctctctctctctctctcctttttttttcttttttcttttttttttgtcgaagaggatttacacaatgtaacagttctgttgggcgttgcgttggtggtcaataatgcttttctgaacctatgtatgaatacctggcattagatatcctttgtgtcgaatgatattttgtttttctgaatctatgtatgaacacctggcattagatatcctttgtgtcgaatgacatggtgactgacaagccatagagcttgaatatcacctcaggtctcagtgatgcaatgggctttgcattcaaatcgtttataagcaccttgtatcaaagaatgcttcatcgaataatgaaattaaccatgccaattcacacttgaggtgtttataagcagcagtttactcccaacgtttggcaagatcagggaagcgcacgtccaggtttctccatatcttataatcatattgaaaaaaaa

SEQ ID NO: 102269 - DNA, 735 bp, Oryza sativa
tgtgacttgtgacttgtgattcgattttttttggtcggtaccattttttaaatacaatattgaagtttttataggaagaacatatttagtaacttttttttgttcatagggatacggtattgtctcaggtataatgctagctcatccaaatgatccttataaagatcactcccatgatgtgtatatatgcacagcttaagatctctgtttccacattccacattgctgatgcactcgacgaagaaaccttcatttggtgaaacccaatttttggaggaaacgctccgccattgcttcgggagacgctgagacacgatatcaaccccggccaaccaccggagtaactcaccgtgctaaaaaaaaagtatcttctggttgcatctactccctccgtcccaaaataagtgcagttttgcactattcacgttcaacgttttactgctcgtcttatttgaaaattttttatgattagtatttttattgctattagatgataaaacatgaatagtactttatgtgtgactaaatatttttaattttttcacaaaattttcaaataagacggacggtcaaacgttgggcacggatattcacagctgcacttattttgggacggaggtagtacacaataattataattaattaacttcatattttcttacaaactttagtgaattaagatattgatatatatactccatctgtcaaaaagaaataatcatgggtttatatcca

SEQ ID NO: 102270 - DNA, 726 bp, Oryza sativa
tggattggtttttggtttctgatttttggatccaaattggattcagtccatggatttctttggatgcactagacagtccagtactctccaaagtccaaacctagcgtcatcagtcgtccacggctccactccttccgccgctgccgctccctccccttgcttcgcctcctccacctctccgccaccgtccgcgaatccgccgccaagccgtcgccggtcagattccctcccccaccaccattgcttttctttttccctggtttttctcggtctttgatatatcctggttgttttgtttgtgtttttttttgggtctcttcctgatcttggtggttgcgggtacaggtgaagcagaagaagaggaaggtgcgtgcgccgccgggcgctggcgaggatgtcctcctctggcggtccggccgcgtcgccaatctccctaagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtggg

SEQ ID NO: 102271 - DNA, 564 bp, Oryza sativa
gaagtaatacttaactaatcacacgctaatatacggctgtttccgtgcatataagtgattagtcgacaaccttggctgccagcgcagcccaagggcccctttaaattgcaggattgagaaaacagagaaataggaaaaacgtagaaacagaatgccacacttattggattcctatgagattttaaacacattaaaatctccaaactagcgtttgattatcacacaggaaaatcgtaggaatcttagacatacgaggaaaacatgaggtgagacctcacacttatttttctctaaaattgctctaggaaggtccattcgatgcaaatttcaaaggaattgttaggaaataatctgtccaaaggggtttcctgtttgacggttcgacctcgccttcacgctttcagccaaaacacagcggtggcggcgcgacagccgacttggtgatcggcaaaagcaccaaaccatccccctcctgcctactccccttaaaccctactcctctcctaatccttcccttcctcgtcgccccgcggcgacagcgagctcccctaaccaaaaccccac

SEQ ID NO: 102272 - DNA, 717 bp, Oryza sativa
tcatccaaaccagagcaatccaagaggtcgaatgtactgatgcagccttgaacaacgccgacgtagatgagacaattgcctgggccggcggaacattggacttaccccttcgccggagatcgaacaccgatggagccccgcgtcaggtgccaagtcccgttggacaataaaataaagtagaaaaggtaaaaggtggcgatgcgccgaattgtattgattgtggagattgtttacaatgaccccggtgttgatgcgaaaaacacacactggcctggaagatctgcttaactcctgtgcaggtccaaaatcttgcttttaggttcatgagcgtgccagttgatttgatcctgcaatcaacaagaataaaagacaagaaaatgaggttaaatccataaacgataaccgatcggctagttgccgatgatatatcatttatcttcgagccgatgtcatgttggaatcgatcggcagtaatgaatgaataagataagactaaatctacttggtcggctgtagatattaacgacatataatctttccttcgacgtatgtttaaactaagtgattgggatagattggtcgccatgccgagacagtataaatcacttaagtcgaaaaatacattaaagcaatgattatataggcgtttatagcatagctggtcagatagaactagcatgtatcagctaatactccgacaccactttatactaagat

SEQ ID NO: 102273 - DNA, 1005 bp, Oryza sativa
cacttttgtgattagaaaaaaagggctcgatgcatcggctcgaaattaagccgatgcaccgagccaactctccatcatcatcatcatcgtcacaaatcaacatcatcccatcaactaaacacaatcaatatcatccaaacacaatcgcaaaaaatgtccaaacacaatcacaaaaagattacaatcacggtaatcccgcggcctcccatcgtcgcgtcgtggcggagaggaggccgcacccaccgtggcggagaggacagtgataaccgaagatctaggttgccccccaagtatttaatgggacgacgttggtttgtaagggtctgtttggttgctacccgaaaaagttgtgcttctggatgtacggatttaggatttatttgactcttccattgcgttctctcttttttttttcatgctttttctttcaagatttcaatcctcgtaatgtacgcaagatttgtgcttgtgcatgggaggttagagtaatagatggatcttagttggatcttgtgccaacgtcccattaatacttcatttagttgtataatgatcaaaggcataattgcgggcttaattattcactttatagccaattttatctttttaaaatttggcattgccaaaattttagcaaattagcaacattagtaagttttgataaaattggctaaatatgagatatgaccaatatttaataacaaactaaacgccaccatatatttatcaatttaccaaacaataatatggtttaaaatattgtttaaaatggtattaatctgaacagacggccatgcatatttgttgctcaggcagcaataaccaaccaaacaagcacatactcaggctgcctgaccaggctagatgcattgtcttctcatatgccactcaggcacacagaaatttcaggcatgttgctcagggtagcaagcaaacaactcgtaaagctccagggcaaacagctcgtaaagctccagggcagactggcagtgacagccggagata

SEQ ID NO: 102274 - DNA, 683 bp, Oryza sativa
atcagaaaacttaagattaacatcaaattgcaaacacccctgattcatgagcaacgtatgaagcatttgataattaaaatggcatgcaaagggcatgtccatatgcagacaccccaaaatcacaataatctgttttgtgagggatacgtatccacaaaccacctcacacatagataaggcacaaaaaatataggtctctttaatttactatactccactccatcatgcttgcacatgtatccaatcagcagtgtttcctattttagcggaaaacaaattaataaaacatgatttattacacttatttacatcatagagccaacaactgtgactagcaagaaatttcagaggcaaatacattcaatcgcagtcttttacagcatgattattccagttatttataacattctattacatacattactaattgtcccaactagcaaatacattcatacaaaaaatctcacgaccgaatctaattttcaccaaaagttgaatagctaatgagctacagccaagaacatccccaagaacagccgcaagaacacatgaaacaaaaaacttaagagtatagttattaggaccggaccaaacagactagcaaagaaaaaaaaggaaataaaaaacagaagttgagccttagttggtcccgtttagttaaaatgaagggaccagaccgataa

SEQ ID NO: 102275 - DNA, 726 bp, Oryza sativa
gtaaagatggacctccaacatccaaagtttgataaaaatttaggatgggttttatttactaaaaagaaaaagtccaaatacacccttaaactttgatggaagttcatttatcacctaaactttaaaaccggacattttaaaaccggacatttagatccttaaactttacaataccatttatatagccctctaatatagctttgcatagtattttttttttctaatttgtattatacagtagatgagtttgatcacatcacatgacaaggcattggatatatgtgttaaaatcttcacttaaatatttctttttacctcatgttcactctcacttagaaagaagtaggtaggattaggattcttgtgattggttgagaagaggcagtgaggaaaattgaatggtggaaggttatgatgctggaaaatttgaatgctgaagagaatgttggtggaaaaattgttatattttaggataaatttttacgctataagttgttatattttgggataaaatttgaacattataagtgcttatatttttgggcgaagggagtaccgttgattatatataaaaacattatattagttattcaaagccacccatttaagctttcaaatacacaaaccaccaatcaaaactatctcaggataatatgtgccgacgggagataccacggattataatctagggtattgaggtacgttggtacgagaagggctgcagga

SEQ ID NO: 102276 - DNA, 697 bp, Oryza sativa
atgcaaagatggcgatctttgccgcatgcgaaaatcgttgccggccgtatgtaaaaacgtattctgtagtagtgcatgctcctcacactgaaacattttattttaataaaaaaactattctttcttgaaagtagtgaaaaaactaatcccagccgtgataattacactggtgtaacctcctttggctaatatacatctaaagtatgtagtgaaataactaatctttctcaatacggtaatatgcctgccatgtcatcaaagaaatacagaccatattcaatttatattttcagcaagaatcctagagctgaagccattacagacacggcctaaggatagacaaacgcggccttgaatgattaataatttttgttttgtttgtagaacacaaagatatataatggactaaaatgcatttttgttctcttcaatgaaagggatgtatggcctggcatgtaaaacaatgagaaagtgcggtaacttctaagtaaaagggagccaaaatttattatagccaagtccatgcaagcacaccaagtcatggccctcaatttgtaacctattattgacaatattgagtatttccatataacggaataatttgttcaggaggggttcaatttagaaggaggatcgaattacagaattcgaatcctgagggatttaacatttggcaagatttgggattcacccggat

SEQ ID NO: 102277 - DNA, 1317 bp, Oryza sativa
gcaagtaattaatgtctccaaatgggaacagctagctgcaaattgctcaataaggctatcgacaaaaagtagtatagctttcatgaatgttgtcttgaaatctgagaaaaatatcgtaatatttttaacataaagcaagcatattatcaaaatatattaaattatagttttaatgaaactaatttggtattatatatagatgttgctaaatttttctataaatttagtcaaactaaaaaagtttgacaaaaaaaagtcaaagctagttataatatgaaacggaggaggtagagcttatatattcttacatgggcctggtttagtttccaacttttccatcacatcaaaactttcttacacacataaacttccaactttttcatcacatcgttccaatttcaatcaaacttttaatttttgcgtgaactaaacacacccataattatacgtgacaggggtatgaaaagctagctatgtgataaaatgtacggtgatggaacatgtatatatgagttctcgtaggcctgtttagatcccacctcaaaattttacaccctatcatatcgaacatttaaacacatacatgaagtattaaatatagggtaaaaaaataactaattgaatagattgcgactaatttgcgagatgaatcttttaagcctaatttctcaatgatttgacaatgtgatgctatattaaacatttgctaatgacagattaattaggcttaataaattcgtctcgcagtttacggattctgtaattagttttttttattagtgcccgaacacctcatgtgacaccccacataatatccgatgtgacacgctaaaattttacacccctgaatctaaaacacactctaaataaataaaaaaggacccccacgaaaccaaacatcgatagtcaagattggaagcaatacagtgaagtattactccctatgtcccaaattataaggcatatatttttttacacggtcttcaatgatatactttgaccattaatttattccatattatgttactaacgaatatgaaattagcattacatgaaagtactttaaaatatgaatctagtgatataacatgcataatacttagcatatatatggttagtgtgattgttagtcaaaagttatcgggtttaatttttcttaaaaagagagcgccctatattttgggatgaagggagtatttcatttcctcgggataaacgagaaaaatccacgaggccccctttccattgatctgcgggcgaatttcccaggtcttctggtaaaaaaaaattcccaggtcttgtactaatgaattctga

SEQ ID NO: 102278 - DNA, 682 bp, Oryza sativa
ggtacacaattaatgaagcagtggcacttagcaggagcatggtttgttactttcttttgttgttcagtgtgaaaatggacttttgagtaaagttcaagggctaaaaatggactttacccaatgcaatacaacatctagtttctctttagtatttttagagatattaacctttgcatgtgaatggattttgttgtttttttttttaaatgtcatatcatgcataactgagatacaccatcatcgcttaatgtttttcttacatcatttctaaagtgtgcctccaaaatattgcaagataaataaatgtaataattcagtttttacgttcaaaccataggttcctggacagcgcgtgcttgcgcttcagctccttgctttgattcttaatagggccttgcagaacctacataagacggatctaattgataactttaaagaatcaaatgatgatgacaagtttaatgactggcaagcggtttgggcatatgccatcggacctgaacctgagttggttctctctctaaggtaaactggttgttttcaaactataataataattttaatttggatttgcttattccatgcaagagtttattagttaccaaagtgaagagtacttaactgaaatataccggacaattctattaagactaaataatcaagaaaccttaacacatgcttt

SEQ ID NO: 102279 - DNA, 617 bp, Oryza sativa
cattcaagatgatgtggttgtatcaggtcaagatgttgctgctggtcttgttagaatgggaatacttccacggatctgcttccttttggaggtgagggtctggccatctgctctccctcatcccctatctgccattgtttctttcagaatcccactgccatgcatgcacccagaatcccaccgccatgcatgcacaatatgggtgcattaggtcatcttttgtttactatatccgtgaattgtctggttccttgatgttcaatcctgtctagtacttgccatccatccttgaaatggcagtgaaatgcctccttacctggttgacacatcacttgttttcaccaggaaatctggtttgcagcagaatttgtggctggctttgattgttcttttaccatcggaaaattacaattttgatattcaacaaccaaactatgataaattgtgtatagcctttcatttttagcaatattttttatttcctgaagctatgggccttatccatttgcagttttaagtattttgtagttctatgatgtcatgtcatctgatacccgtaatctttcaaacttcttatctggttattggactgtctcgtagattgttctgttcaccct

SEQ ID NO: 102280 - DNA, 509 bp, Oryza sativa
ctctacgaattacaattattgatgatgtggcttcttacatgccatgatgtggcttctttcatgctttgctttatataggaagataggattgttcaagaagtgagtgatgatattctaattaggatgtgtttgcactacaacaaatataccttgtagagagattttactaatactatagagacatttttaaaatgccttcctaatactataaagacagttttaaaatgtctttacagtgttatagagacattttgaagagtgtctttttaaaacgcctttacatgcatttttaaaatgccttcctaatactataaagacatttttaaaatgcctttaccatgttatagagacattttgaagagtgttttataagtgccatttggtgaattttacggcaactatagcaaatcaatatgaaaaagaaagaatttacggatattctaattaggatgtgtttgcactacaacaaatataccttgtagagagattttactaatactatagagaca

SEQ ID NO: 102281 - DNA, 557 bp, Oryza sativa
cttgggttatattaatttgactagttgagctttatttatattggttcaactagatattagatataattgcttaccctgcttagaaacattagtacacttatgggataactaatgattcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggt

SEQ ID NO: 102282 - DNA, 605 bp, Oryza sativa
tgtccacagccgaagcgtaacctgcgtcatcactccggccattatgcaagaagaagacaagtcactcgccttgtggtcactggagcaaacgccgtacctgtgaggcctcatgttaattctaacccatagtagaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaaatcaagtgattaaccaaagagacatttgtttggactaagagttacagatgcgtccttttcggatcaaaggcaacgacagttagtatagcttttggcgaaacacttcaaggtttcacggaaaggcagcaagccaaaggacctcatcgtcaccagaagcatccacaactctcggagtgaagagtacttggttgacaaagtttaagaagtgattgatagaagataccagcaaagtgtttatta

SEQ ID NO: 102283 - DNA, 801 bp, Oryza sativa
aaaaattcaaaatcccttatattgtgggacggagggagtactcagcatcatcggcccttgatttgctaaagggcaacttagagataaaaaagcactacaatggtaatttagtaattgtgtcagtcgtaacagcctctaactccttcctggttgtttgtgctacgccctaattaatttttagccggacacgaactggccactggacacaagccccaattcactaattctcatttccacttgttgcttgatcacatcgctatatatgttttcatccactatatcactgccacttacgtaggcttcatccactaaaccaaatctattttcttcttgcctctaatggttgatgtctaaaatttgacttttagtcattcttgtaaacccatttgtgcgaatgcaagatatatatttttctggggaaagcaagatatattctaattttaaccatgctttcttgcacagttacatatggcgttaactactaatcaattaccaatttattgtcatttacacaggttacgattaatggatgactgatcaattacatagctctatcagtatatgcaatcggccttctcttctacctctaaacgcatgtttgtttccctgtaatcgatgattggaacttcataatatgtccggggccatgcatccaccatacataactgctgtcacgtcctgataaattcatcccgaaataaaaatcattttccaaaaggaataatagaattaattaaaattcgaaaagaaattggcaaacactaaaatacgtacaagaaaaagtcaaatgtggcccggaga

SEQ ID NO: 102284 - DNA, 1273 bp, Oryza sativa
gtatatgtagtattagcctgtattgctcttattttcaaatgtataccctacatttgatttttttagacggacaaaccgaccgcctagatacaattgacaagccacatcattttttttccacaaaatacacatgagtatgatgtggaggatttaaactctagatcggtctcatagtccacacgcatccattattaccgtcacactattaagtactcgttgtttggtcatcaattacaagaggttgtagatttcattgagctctaaaacattgatgtagagcatgttttaatcatggatcatttgaaacataaatctgagatgttgtaataagtgggcagcataagctagcgagcgcatgtgaaaatcaaccttcatatacggaccgtgaccggcgactcccccagtattttcacatgagggtcttcttttgacccacttataaatataaatagggtgttcacaaaaattattttttacagtgtaacttttgtacacattaatataaacaactatgtaaaaagtcacttctagagaaatgattttggcagacgaccaaaacatttttttttcaggtcgccatctactatgtctatagttcaaggcctgcaaaaatacacggtcaaaatgattttcgcagatgctacatccaccctcctgtgaaaatattcacggcggacgaaaaaaataaatcacccccaccccaccccaccccatccacaccgccaccatcctaccaccacccatcccaacccgttcagaccccttgctaataacaaatcacaagttcttcattcattcaacaaattcatgttatctagtgtttaatactatgaaccggtttttgcaagccggacctcatcatgcaggggtagcattatggggtatgcctgcgataatatatgtatcttcgcagccgtatgagaagatgtattttcgcaggaggacagccatcatatcccccgtccacgacaatgcaggcggcatttttggtacgaaaatttgatctgcctatatatagtgaaatgggtgttgcctacgtgatgtgaccatcaagtatatgcatacaacgaagcataagaaatataaaatattgtcaaagaatacatcgagtgaatggagtatctataacatattaaagtccaataagttttggaatacagttcggcctccggagacagcaatgactttaagcagacctagcgtcttcacgccaactccgatttgggtgatcttggacttcatggaaatcttatctcgctacctttcaaacgca

SEQ ID NO: 102285 - DNA, 1768 bp, Oryza sativa
tttccatattgtaatcctgcccccatcctgtataaggtaggcaggaggccctctagggggcatatgattcacaactagattgacagatcaatatacacttggtggattcaaatccccaaacaggagtagggtattacctctcattgagagggcctgaatctgtctaaatccttgtctccacatccatccacttttaagtctcgtgcgctacccctttatattgccgaattcttgtttcgacaaacatcacacaaattattgaaaaaataaagatgtttacattagagtaatcataaacatccctaatcatatttctaacacagttaaataagattcccgcatatatgcgcgggctaccttcctagttaattaaactggagtgcagttatacgggcttgatcgatcgaccaacgaaatacttagcttctgacgtgattcaggctggaaaatagtggggcagctggtgctgatggtgatctattttgtgtttggtcgttgacgctttattaatacaaaacatgcatgcatatatagcagggaaactatatgtcaaattgtcaatcgttcctactacgagcacatgcataactcgcgcaatatgtgcaataattaatactcccttcctccatctatttttaatagtcatattttatcttgacacatagaccaagaataagtaattccactcatcatccaatttaaacatgctactaattatttctcgtaaacaagtgattcattaatatttatatttctcgatgcccatacaaccaatcttgtgtggaagaatagagagtcatacattaaatctgaaaaagtcattaatatgatagggtggtggattgaaatatacctatccaaaatagatttttcatatttgaaaatatgactatcatgatagaaggagtaataccaagcactttgttcttcaaaaggttaggcgtactgataactgaacccccaactgaattatatacgcatatattgtttttgacggcgcccattgcagagtgccaagtccaagctagctagccagccagccagatcagtgacactgacacagccagagacgcatacggaactattttgatttctcgaggcaatgtttcgtcgtttaattgcttaaaaatcatctaaacggttataaaatattctggaaaattttgataggacttatgcaacatatctatacaactttataaaatcttagattcaaactcaattcatatattgagatataaaaaaaataaatttatatataaacagtagcgcacgcggttcacatctgaattggtcaaatttgaacttgatttttaagtagatcgatagaaatcactgtactctatattgttattttttttaaaatttatcacatactactatttgtatcgaatttagaaaaagaaaagtactctaggagacatccccgagtgattaaaatcactccccacgcagatattatatatgtcatgcatgtacagatacaaacagaacgagtatatggacagatatgcaggtcctactctccgtcgtcagagctacaccctccgtctaaaaaaaattcaattcatgggtttccgtgactaacgtttgaccgttcgtcttatttgaaaagttatgataaaatttaaaaaaataagtcatgcataaagtattatttatgttttattatctaacaataataaaaatactaatcataaaaaaaattatataaaaaaaattatataagacagacggtgacggagggagtagttgccatcgatcaatg

SEQ ID NO: 102286 - DNA, 694 bp, Oryza sativa
ggactctatactctacctgtaatattccttatttttaattttgaatttctattatttcttaatggtatttctatatggatactatactctacttctaatattccttatttttaattccgaatttctattatttcttaattgtatttctatatggactctatactatacttctaatattccttatttttaattccgaatttctattatttcttaattgtatttctatatggactctatactctgcttctaatattccttatttttatttccgaatttctattatttgttaattgtatttttatatggacttctcctcttccaatattccttgttttttaattccgaatttcaactatttctaaattgtatttctatatggactctgtttttctttttctccgattaatatgagaatttctagaccgtgagaacgaacatggaggctcttttttctattccattaataagttaatagattttatattactagaaagagtgcccgtgctttgtaacgaaaaaaactactactagttacaatcgtgacatcttgtatgtttaatctttgagcgttatggctcgtgacattggttgcatggctgattattacatcacgatcgcctcaccccgatttctagaatcgcataacactaaatggtggaattaagggaatatacattggaatcctagaaacaaa

SEQ ID NO: 102287 - DNA, 644 bp, Oryza sativa
tgttcatggctcacatttgttagacttttgagctgtaataggctgggaataatggtacatgaggagggaacttagcccaacaaataaagatgtttcttctagtctgtatttcaattggttgttataattcttctacacgtataaatccaatttggtcgtgcatgctaaaagaaatcggggagataacataagctgtggtttttctaaccatttacctcttgttctacttttcgtgatgcatggtcaattgaaaattttggaacggattattcgtagaattattaccgctgattttctgattgtatggataaatcaaatattttaagaaataaagtgaactaatagtctaaacaattcgatagaagaaagtagttaagaaaaatatatttttagaggtgtggacccaataattcgataaagtagttgaaaagaattgtaccaaaatttggttaattgggtaactagtaattcagtaatttattttgcaaatgcaagtgttggtagtggttgcacattgtttactttgattcgattggtcatataataatatcagtggtttttttataaagtaaaagttaataagtaatatgttgatgtgatgtacctgactttggtatttgtaatgtaatggggacattggtatg

SEQ ID NO: 102288 - DNA, 2988 bp, Oryza sativa
tttagtcttgtggcatgacattccctattaggataggctatatgcgcaatattttggcaactgtgagctaaatctcttctggtagaagacttagcttattttgctagtttatccgccatcttcttaaattatcttgagatccatcgcacctaaatcctgtcaataggaacagaggaagtgatttgcgtccaaaaaggtctaagactccagtggcctggatcatccatgaaattcttcttctttgctgtgtccgcaatagtagtattgtcagataggtaagtgacacctgaaaaattcaaacacatgtcagtttccaaagaaagttgtaaagcaagaagttcagcttgcagagcagaatgagctttgtttgaacaggcttgaataaacatggcattatgattttgaggattatgaaaaaaaaaaattcctatgccagtttgtccattgtcccaggctgcatccaggtagcatctgattccattcggaattgtgtccatcctccttgtgcctgcctctgattgctcattatcctgcaaggcaaattgagaagaaatctgggaaaaagatgaaatcagagcatctgccaggtagctaacttgagagggttccttgaaggtaccctgaaacttaaagccatttctggctttccaaagttgccacataatgatgaagagattgctcaaattaattctacttggaccattgttaacagtaaaggctataattaaagagagtctagagctggcctgaaatctatcaatatcaaagtgataaccagagatcatccaagtaagtctactaaaaggacataagaagaaaaggtgaagatcactttcaggcgtaccacatctacaacaagcagcagggatgtcacttattctttgattaagtgtgagagaggagggaagagcttccctgagaaatctccaagcaaagactttgactttgggaggaatgttcttgtctttccaggtggccttaataagagcaagggtttgggaatctacctgttgaagattttgattatcccttttgtagaattccctataagcactttttgagttacattctccattctttgtgaatctccaacatagtttatcactcgaagtgtcctgcatcaaggggatctgcaaaatcttttgaacagcttcctcttcaaactgggagttaagcttcaaattgtccctctctttctcattattccataaatctgcaactttaacaggtaattgactaggcatggggttagtttttataaaattatagatatcttcattaagatcacaccatggttgattccaagtggaaatgtttccttctcctagctgccaagtgacagaatgtcttaaaaccttcctaatgtttaaaacagagctccaatagacagatttagaaatattttttggagcatcccaaaaggaggaattaggaaagtatttacctttaaggatttgagcaatttgttcctgtgggtttgtgatcaacctccaagctgagttagaattaagcttttattaacagcttgtatatctctaataccaagacctccctttgaaatgggcctgcaaatgtccttccaagctctcaagcataaaggatttttgtcatgtccttctctaacacctgcccaccaaagttttctaataatagctgtgattttattaagaatattttttaagagaagaatagtagccatatagtagacaggtaaagaagcaaagacagagttaatcaaggtcagacggcatgcatgagacatattattagccttcaaggtggtcagcttggctttgaatttatcaatgatgaatttatagataacaaacttgtttctattggtgacaaaaagagggtgacctaaatgtctagtgttggcatccatgagattgatagggaaaatgagccttatagcctcttgaatgtgggaaggggttttcttactgaacattatactggatttatcataatttggagtttgcactgagttcctgcaaaagttttcaatgatgttctttatctgacaagcttcttcaatattagctgtacctgtaatgatgaggtcatttgcataaagaagagagtgaataacaggtccagaatcacttagtttaatgccattgatgtgttgattatgaagaaccttattgagttgatcagaaagttcatttaaagcaagaaaaaaaagataaggagaaagaggacagccttgtcttatacccctgttagcattgaaagaaccataagattgaccattaatgattacagaaaaagaagaggaactaatgtaggatttaaccaggttaattaaatgatgatgaaaaatctttcctttgaagagcagagtcaataaaatcccattccaatctatcaaaagctttagaaagatcaattttaagcataaaggcattctgagagtaagagttcaggcaaacattggagcttcgctgttttgacacttctagtggataacaaatgggcccatttgtgtctatgaaatgtgggtccagtgtcattttagaaaagattaggggacgattttgatgacaagttgaggggccttcggtgtactttttccgcacacaatataaccctgttcaggcccaaccgtacgacaaccgcctccgatcccctctcctcactccttctcggcggcgaggcgtctccgacgaaaaccctagcacgcatctcttcccctctttcccatggtgagtatccacaaccaagacctcgccgtttcgatccgctcggatagttgcttcgtcggctcggctccagatccatctgaccgatcctgtgatccagcttgttctgccttttgggtgttcaggatagaccacagagctacgcgggttcagcaagaaggggagcgggtatgattttagcaagtatgtcgagagggagttgatggagaactcgatcgcggcaacagcattaagaattttcctggagctccggtggaggaggatgaggagggggatggagtgt

SEQ ID NO: 102289 - DNA, 2039 bp, Oryza sativa
gggataccagtgacgggttggaagcaaaactcgtcactggtatacctctgacgggttttcctttcggcccgtcacaggtgaggggatacctgtgacggtccgcggccggatggctcaccggtgacgttatcccgtctgacccgtcagaggtaatggtcactagtgaccaaatcgtttgcctgtcacaggtatcccgccgccaaggtaataatattcttggcggttcgaaatagccgccaaggtaattcctgccacccgccaaatcaccgatccgcgcctaatgccacgtcatcgatccacgcctcctcccgcgatctcaatcttaaccgtccattccctccccatccaacagtagattcactaatgagttaaaatactcctatgagttaaattttaactcatgacagttaaataatattttgaagtagtaaatgatttcaactgaaaaagtcatcaacaataaagttgtataactcatcaagatctataacttatattttggtcagttctttatctgacaatgtgatagtaacattttcataaaatttacatatatctcttatagtttatagaactatataagagatatgtacattttatgaacaatgttacaaatcactttgttagatgaagaagtgaccaaaataaaagttatagattttgatgagttataccactttgttattgatgactttttcagttgaaatcatttattagttgaaaatgttgtttgaagtagtcatcatttgaaattcaaattcaaactgttgaaacaaagtcatatagtaaaatgaccaaaccaaaagttgtagatcttgatgcgttttacaactttgttgttgatagttttttcatttgaaaacatttactacccaaaaaattatttgaatttcatatattttaaaattcaaattttttatagtttaatcaaactcggatggaaaaatgaccaaaataaaaatggtagatctcaatgagttctacaactttatttttgacaactttttcacatgagttcatttattatgataaaattcgatttgaattttttcattggtaaaatggcctcatgccacgtcatcgatccgcgcctcctcgcgcgatcccaatcccaaccatccatcttcatccaacggactgaagatcgctgccggttggtctccatgatcgatccgagtgcagtgagaacaaaaaacacctacttattcacctaacaagacaatgcaaggtacgtacactacactggtcaaggtcacctgtgacgggcccaaaccctcacctttgacggttttgggcttggtcaatgatcagtggtcactggtaagtccagtcacctttgacgggtggccggctgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgtcacagggtgacccacctgtgatgggcccgaaagtaaaggcccgtcacaggtgggtcacctgtgacggtccgacgtttgcgagtccgtcacaggtgaggttacctgtgacggatgtttcttccgaaccgtcactgatgagttaattccagaaaaaaataaatgctaaatattggctagcctcaggaattgctagccatgccctctgaaaaacagaaacatcacaggtgccagtcaccccccctccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtatataaaatctagcccctacattcatccaaaacatcgacagacaacaaatcacatttaattcatctatacagcagcaccaataatcgaaacaacaaatcacatttcattcatctaaacaatgca

SEQ ID NO: 102290 - DNA, 792 bp, Oryza sativa
gcagcttgcagcgccatatccatgtccccctcctatattccgtcctcacctcaacatcctcctgggagttatctcccagctcagcaggtggccgccctggtctctctctctctatcccttcctcttctggtcatgtcctctctatttcccttgattagttagattgggcatcagctgctgggctggtgccgcagacctcttattacaaagatcacctgtgttcaaattgcgtgttgtagaggatgggaggatgtagccaccaaaattgtgtgttgcggaggattaaaaggtgttgctggcgagctgtacatatatgtatgcaagccggtgtgtgtatatgtatatatgtatatatgtatgtatatgtaatcttgactcatgaaattaatcttgtcatatgtgatttaaattttgctatgagatagatttgaaatattgccttgtgtacacaattatggaactaatcttcgtttattcatgacaaatccatgcgctgcacgtgcctaatcttgcatgccatatgtgattagattttgcttaatttcgaatcttgtctccaaacacgattatatatggaactaatcttcgttagttcacgttatggaactaacccatgcgctgcacgtgcgggcccctagggagttctcaactccctcgatgtgccacgtgatgacataagagcgttttgaggaaactacgtgacagtttgagagcgtttttaggaagtttaatggacttttagtatataatagaagatttggtacctcttggtacctaagggctgcaggaatt

SEQ ID NO: 102291 - DNA, 556 bp, Oryza sativa
acttttatacacacatacatatatatatatatatatatatatatatatatatatatatatatatatatatatatatatatatatatatatgtatgtatgtatgtatgtatgtatgtatgtatgtatgtatgtatgtatgtatgtatgtatgtatgtacaaattcatgcataaatgttaatttgtttaagtttggaaaggaataccctcaaaaaagtttgcaaaggattgagaagatcgctagagtaaaatgcaaacatgagagtgcagcgagattatacaaactatatatggtggtactattgaataaactttttgttgtaattgttaaactcccatgtggaactataaagattgctttgggaaaaaaatgcgaatattaggaaggacctaatatcaaataaatagaagggatgagtcttcgaactcaggccggctagctcaccaccatgtggaactggccggagtacccctgggcttttctctaaagattgctttggttctaaagataaatgcagaaatgtatgaaataagctctttttatgttttctaaagaag

SEQ ID NO: 102292 - DNA, 1046 bp, Oryza sativa
taatatgaagtagaatctcatgaaattttcttttgactttttatctctcctctaattcctgtgtttttcttgtgatccaatcaaacgaccattcttattatttttctgtgttttgcaatgctttatttcagtgccccttttaattggaggaaaaatggaagaaaaacaaagaaattaaaatcgtacactgttcatgcctttaattgctaggaatgagtaaaggaaaaatgtaggaaactttcctattcctatgattctggaggaaaaatataggaaatttaacattcactctaagctaaagttctagctatctcgcttaggatcgagacaaatctagtagctcatggtcacttttctattcaattagtgtagattagatatgtataagtaaataaccaactcaattaactccaataatacagacccatttacggtccaatcaaacactgtgttttccaattctctgttttgcatatgtttcatatcctatttctttgtttttcctattcttacaattttttcgatcatgcatttcaaagggatcctcattattgtcaaaatcctaagtttttccaatcccacgtttcaaaaaggccctaagtttgaagatactagaaaattattatttatagattattctaaaaagtactttaataaaattgaatatttatttatttaaatattataacaaaaaattatagtaatattatcagtgtcaatgataaggcatacctcctatactttggtttatactatacggaaatactatttacctaattatatacggaaaggtaccctttgattagggaaatgcagcacatctagaaggaaattatcttcccgagacagaaagtatcagagtcctagtcgggaaagataaggtctccttaactcgtatgttgtcctatatctccgagttaacttagagaagaaggtgatcatcgctataaacacaaggcctcctcgagaagggaggggcatcgagttacaagctatagtcaaagccacatcaagatataaatccagagaaagccaataccctagtc

SEQ ID NO: 102293 - DNA, 520 bp, Oryza sativa
agtcttgctaggagattacaggaaagctaggtgatctgatttgagcaaattcgcacagttttgccagccatttgttgcattagttagagatccatctgatccatatacgcattacgattaattgtgttacagaacgtatttaaaaatactgatcgatgcatgtgtcctactagtatatatgtacggcaagacaaaagcatgcaggatcatgagttggacaaggagcaggtgaaccgacattatttacctttttctttgcgggtgggccccacgcagcagcctatgttgctcgctgagctgttaaatttacattgtgtgtccaatgccattgttaaacatctacttccttcgtcccaaaataaaacaacttttatacatacatacatatatatatatatatatatatatatatatatatatatatatatatatatatatatatatatatatatatgtgtgtgtgtgtgtgtgtgtgtgtgtgtgtgtgtgtgtgtgtgtgtgtgtgtgtgtgtgtgtgtgt

SEQ ID NO: 102294 - DNA, 547 bp, Oryza sativa
gactttatccttcacaaaatatatctgtttacaatcgaagaaatataggtcagatgcccacaccacaaacacccaatctagtctagagtgccacctgcaaacacaaaatagctacttctgatggctttgcatgtacaaaagacgatgaccatccttccagtagatttctccatccaaagcaagctatcctacatgcagttcttcaacaagatgtgaaacattgctagaattggttcagctatcaaccacatcccacctagaaaagatattacacataataagcacaagaggaatgttacatgatcattttgtaatactgaaagtaaaacaactatacataagaaaaagggtatttgttttttgagtaaatttcataaaactacacgttttgtggtccaagttatagaaaactatacacactttgacacttgacgtttaagtacatatattttggtagtgtatttttacaaatccacactatcaatgaatgtattcacccgtgatatgacatggctgttccacttaggacgaggatgtggcatcctat

SEQ ID NO: 102295 - DNA, 662 bp, Oryza sativa
cctgcagcccatcgccattgatggactgatgacttgattgtcagctagcttgttggtggatttgagtggcctcgatgctagcttgttatatggaatggaatggatggctgtgcttagcttggtccaagctagtgaaggtgaagctgcagccatggttgaccaaggtagctagtgcatgggcctgcctcgtcgattttttggctgcgacaacgcaggctcatgcacaaactgacgaaccatttcatttcgacccattggatgcatgctgaaattaatcagagatgcacatgtgtcatcttctagatccctcactcattttggtctccatcgacatacatggtcaactagcaaattaattaagtttttttttaagaaagagagtaactagtagagcaaattatgcattgccaagtaagtatatccttatctcaaatagtttggctactatatatacatctagagtatatatgtttggtcaaacattttagacttcagttgctagcgtgaatatataaaactaattttctcttcaaaaagatgtacatttattgttgcagtagtatatctctgacgacctcttctctagcaacaagatctctaggtaattaacacttgtacacattcaactcgaccaaccaggtctgcatttctagaggaactat

SEQ ID NO: 102296 - DNA, 695 bp, Oryza sativa
attcctgcagccctggttgtttttgtgatgtgtcaacttaccaaaattcatttattttgtagaacaaatttaatactagtggctcattaacagagtttgaatgattgttgtttagtatagggaattgtttacctcctagttcactgacctttcagcatatggctgacctgcatgttagtttacatatacttgctttatgggctttcattgcttattttctgagattaattgataatgattatgactcttctgatttatgccatcttgaatgccatttacatatttttactattgatattacagtgtttttctttataattattgttctaattcattgtaaatttaatatgtcactgcactattatgaattatgagttgtctattttcattttatgaaatcaatgacattgaagaaaaaatatgtactgaaattttcagatatcttttgtttggtatttttcaactgccattgattgatatgatttttatgaattgtaaaatttttgatgtcagacatcatttgagatgttttatgattttattttcttttttttgtagatttgactatggtatttttactctcaagttcacggaggtttggggccctagagtgctgcttccaaatatcttttcgcaaagagatattcctaatatcagaatacagttaaacctttccaaaaccccaaaaaaaaaaa

SEQ ID NO: 102297 - DNA, 586 bp, Oryza sativa
ccgatcaccctaggagcagctacgatcaggttgtttttttctcacatgttaacatcacttatcttcttagttctatgatcttgcagtaattcttcttaacttctcttttcctgtagaggtttgaagcagtgaacctattattggctttgatcctgctattcacttcatataaggtggatcgatcaatgcttcttttcttctattctccttttggtgtactaagttactttaccatgtttgaaatggacatatatgatgctattattgctcacccaatacttccttttatgagaatgacaagttctcactgtcattttacaaaaatctacctgttttatttcctgtgaaatttcagtcccatcactgtctctaacaacaatatactctaatactcaaccaatcctggactccaggtgcatgtattacattattaaaaaagtatttggcatataccttccatcagtcaatggctaacagcatgatgacttgcatcttttggggattcttgtttgttccagctatcttgttatagttcaacctagtccttccatcatttagtgagcactaagttgtcacacttcaaaaa

SEQ ID NO: 102298 - DNA, 647 bp, Oryza sativa
ctctcatctgcaattacatcacttgacactgcttgttaccaagtgctaaagctagctagatgaggttgatgcaattagcctctgagaaaagtgtagcatcacaaacgtacgcgtgcttaattaatgcagtctttgtttaaaacgaaaaacaaaactaatataatgttcgaatacttagaagtcagttgtattttataattgcaaattaacaactctgagagatatgtgtcacaatcggcaccgtcaccaggacaaacaagtttgcaaatatcactactgattaatggactaatattatattggctggtcgtttgtacagtaatgaaggaattgttggtgattgatgaggtgtttcttttctgctaaagataaaaataaagttaagacatggtgaaaacaattattacttaattaattaagttgtaattattacaagttcaaaattttaatttgtctaatattttagagtaatttttacgtagaaaacttttatacaaaagacactatgggctggttggtttgaggcctaaattaagcttaccaatatttgtcaatttcaatagtgtttagtgtctatttggtttgaagccaaattttgacatgcctaagaaaataggccattttaatagtgaacttagactattttg

SEQ ID NO: 102299 - DNA, 1200 bp, Oryza sativa
ttcctgtttgcaacgagcaggcaatttttctagtaatgatagaatatcagaacagaaatagagaaaaacataagtcaacccggactaaacctcagcatcagatccaaaacccaaccaccggatggatagacgagtgagtagtgaacaaaccacgcttggcatgaacacttgaaatttaaaataaaacctaaactttttcggcggaagaaccgcagatccaatcgtaaccggacccatgcaacacacaccgacagaaacaaaaaaaaaatctaaataatcttccactccatttccggagcataatcccccagatctaagcacctaaccacacatcattcagatcggatcccatcaactcggaacaaagactctcgatcaatcaatccatccatgcatccaatcaagacgacgaacaggatcgcaacgcgaatggacacggatcgacgcacgaacgcaaaaaagaggagaggaagagaggcggcggtgcggggcttaccgtgggagagggggaggaagcgagcagcggcgatggaagagaggaggaggaggaggacggacgggagggagaaggggtttgggagggcttatttataagagaggatatatatgctttgctttttttttcttggttttttgtgatgtgtgagagtgtgcttttggatggtgggggttgggggttggtgagatcgatctggtggtgcacggttttttagatgaaaagtttcatctttttcatggagtaatatattgttactgtgttgtaacggaattttaattaaaatttgttattaaactattattatcgttagtttttacctatataattcttatttctatatatatttattaccgacatataagctctttggtccatgtgaaacttctgaccccgcatgtcattttactttctacagggaagggagttggtggtgggagtggtggcacatttaccagtttatcgctcaccaccgccactactcccttttaaaatgagtatagatattttgggattgtttcttcctttatgtcttgtgttgtttggtatgattatttatgttttcttttatatgtatttctagcttcacgaatttttatagatttagatttgtgattacattaatagattttgaataacatttagaaacttgaaaataatatcgagttgtgccaaacagggcattagactagggctgcaggaat

SEQ ID NO: 102300 - DNA, 1422 bp, Oryza sativa
tatacatatatacacatatatacatatatatatatatatatacatatatatatatatacatatatatatatatacatatatatgtacatatatatatatatatacatatgtatatatatacatatatatatatacatatatatatatacatatatatacacacacacacacatatatatatatatagtaaataaacatgagaaatatgtatttattgaaaatagtcaatattgtgtacgcggctgtgagaaggaaaggaaatatcacataatttcaaaaataatgatagtagttacagagatgaaagaaacaatatattgtaacatacccaaattctagaccttaaaaatttcctgacaaaatagctggaagctaaattttccatttttgagagccaaaaataaaatcaattttaacctaggcgtggtcaatctaacttgaacctaaccaaaatttgaggacatattaaaaccttttacatgtctaacctatatcatagatgcaaacacaagtgaaagcatgcaaacttgcataaaacgtattttgacttgagtccttcttatgcatttggattttcaattcacatttcataataggtcccatgaataataactaaaatctagacaaacaactaaaccattagggcctagtgctaattattggaaaataatacatagaaaccataatacaccttaaaatataccaacaaggccaatgtcaagccccgcaaaactaatttggtcatccatctgaagacaagtcatgatcatggaagtaaactaataaattaactcatatagggtatattctatcttaatcatttttataagtatcctcttaatttaatactaaagtaaacttatacataaataggtaagaagcttgtgacatgtgtaagtaacatatcaacatcatttcaggttaagaagagtccaaatataatttttataaatatttacatgcatttaggaaagggaaacacatataagagataagtcttactaattatctaaaataatttgtgcaagataaaatcacgggaaaattcttgtaggctattctcactacattcaactcactgtaattttggtataatttaataactacatttgatacctcaaataaatcagacaaaccagtcaaaaactagattaactatagttcttaataggctaaaacaatagctaactaaaatatgcattaaactgcatagaagtatatagaggaaatagtttattcaaatactaggacatttatgatgagtaaatataaattttctataatttatcttctctgtttagttctcctaaaaattcaaactatttttcaaagagctcatcttctcataatttctgtaagtaatctatccataatttttaagtgcaaccaaagaaaatggaaactaggtagggctgcaggaat

SEQ ID NO: 102301 - DNA, 616 bp, Oryza sativa
ctaccgcccccgggacagtggagacccccctaagcccccactaaatttttttccatagatccataggatgtggggactggaggttcgatttatgctgatgtagtttattcagcccccactactattttttttctagatccgccactgcgtagttgcattgtttcagctgttttgattggcgcgtacgtgcgaatgcggccggtctccaggtatacgtagcatgcaagcggtggtggatctagaattaatttttcttgagagcctggtcaaagcctaagcgaatgggctagataaatattatctttatcaagaatagataatgggtgttggagagctgtgtgtagctttggccttatgctcatgacagcaaaaacgttggtgtgaaagaaacagattaagcagcggtattaagtggtaattcactgactagctaatatggcgatggcggagcccaggcacctgccctagctccgccactgaatgcatgtgttgtcctctggtggtccatcagtccatgtgggtccatccaagctacaactactttgtaaagtgaaaatataaaatgcaaatcacgtatataatggaaacttgaaaactaccgttggatcgagaaatg

SEQ ID NO: 102302 - DNA, 622 bp, Oryza sativa
aagaattcaagagcatttgatcaatttaaagtgatctgatgaacttttgtttggagtcataagaaataatcactgatttataattttatattctcattagttccgaaactcattagtctcattcaaatttcactcggttgtaaggtcgtactccctccatccatatttcattttctgattttttttttcaactaggatgggcatatttgcattcttcatacatctaagacttaaatgtcctagaacctgggcaaccatattattacttattggttgcatgtatccatacaatttttttttgtctctacacagaatgaattgatttgtccttggtttcgctgaaaaaagtaatatgccttggagggtatttgttttttttttaatttcatcgccgcattagaattccatgtgcacttgtgttttggttgtaatgagtgaatttctttttaatcttcattttgtatggaaataaaatgaggtttaatttcttctttgttttagtgatttatttattgttagttgtattattagttgaatgcaataatatgttgtatttttctttttcatttcgagctagaatggaaataaaatgaagctggataactttaattcaccactaaat

SEQ ID NO: 102303 - DNA, 740 bp, Oryza sativa
ctttttaactgtaccatatctcccaaaccgatctcgcacgcaagggaggcgagatgtcggctctatttttgttctgccgatcgcgtgagggaaccagcagctagctagtagggctgaagccaatcacagctaggttaatttccttgctcaacaagatcaataagtggtgttcatcaaacttcgctcttcatctcgtctcccgcatttgcaagcaacataatttgtgtagtagcagaaggggtattcaattattttatcttcatctcttcctttgaggcagttacatcttgcctgtatgatttctatttccaagaggcaacaaattaagtatacgcgcccaactaataatacgtacgtgcgtacgttaatggaagccagaacagatcgattaatttgcacgtacgagcgagttgttcacacagatggaacggtaaatgatatacatgcatatatatttttggagatatatatatacatgcatattggtagcaacaaaaattaagagtgagacatttttagcgaaacagaggctcatgtcatgttctatcttgtacagctattctattcattgttgcgttcaacacgtatgcgtacaaatacatgcatgatcagtttagcattattcgtatgacccgcatatttggtgcgtgcggaatattaatttttactatctaatccaacaattcaaatatatatgtccgaaccaggttgcgtttttttttttttgggtgggggggggg

SEQ ID NO: 102304 - DNA, 656 bp, Oryza sativa
tatatatgtatatatatatatgtatatatatgtatatatatgtatatatatatatatatatatgtatatatatatatatgtatatatgtatatatatatatgtatatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttataatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacact

SEQ ID NO: 102305 - DNA, 2089 bp, Oryza sativa
ccgggactaaagatggatctttagtcccggttgtttataccaaccggaactaaaaataattggggcctgacacgacctgacaacctcttcaaccgggagtaaaaatgatctttagtcccggttggtgttaccaaccgggactaaagatcaaaaaatacccctaagtttttaaaccgggactaaagatgctttttagtcccggtttttattggaaccgggactattgtggaattgggccgaccgaccaaagatggtttctccactagtgtcagcataattgttatattgttaaaagacaggtaaaaaagtagcaaatagttttattactatatagacctagaaatcctcacataattggagaaaaaagtttgcatagttagttcgtatatagttagtctagattatagtgtgtagatttattgttcgtatacacaatataattatatttaattgagaaaacaaaagcgatagttttatatcaaatacaatattattttttatataaacaaaagctagaaaaagttgtatatgttctacttttaagatctttgctccgcgtaaaactgtcataggaaataattgtatactgctatagtgaaaaatcgttttgcgctctgtctatctctctataaatatattaatttgttattactgctctgtagtgctccctccatttcaaaatatttgacaccattgactttttaatacgtgtttgaccattcatcttattcaaaatatttaagtaattatttattcttttcatatcatttgattcattgttaaatatactttcatgtacatataaagttttacatatttcatattttttttaaataagatgaacagtcaaacatgtgctaaaaagtcaacgctatcaaacattttgaaacggagggagtatgatattaatagctaatatagctagcctctgaacaaagaaaagatgcttaggcttacagtgcgatcggtcgagcaagcttaattaagcttgcggggtaggactccagagcccagacgtgtacgagctggggtagcttaattagcttattaggcaaagcgaaccgaatacagaaatgatcgatgtgtagttgcacgccgcgcggttcttaatttatagctgcaacgaagcagtacttgaccagtagggtacgtatggtatttactgcgtgcattttccatcctgcgatcttatactgcatgcacgtccttttttgcggacgtgaggcggttaattaatttctttttctgaaacagcgctactaattttattgatcgacattaattaactgtaagatctagaagactataatgtgtgaagcgagcgacgaggtatatataagatcagtggcggatgcaggatttcgaaggtgggtattcaaaaatttacagcttgcattgattaattattgattcatttacatatggaaagctacaacttagtattgattctgatatgcgtacatccaaacttgcagaaaggactaggagcttggccacttgtttatgatctgttaattactatataattataacctagtaggaaaacctaagctcctggttcctgcagtatacgtacatataaattaaagttgacttaattggttttgacatataaagttattgatcccgggcggccggccagttccgacgatgacaaggactttactgttaggcattagcaacttgtgaatactcctacatatataccagcagttgaaaacggtgggttttcactgcggcttcgtgtcctgtttcccatctatgccatcagaactcattcatccagcgtccaatgatttgacaaattttgtcctggaccgaatttttttaactattcggtgacaacgtgcattcacacggatatttgtattattttgcacatattcatgtaaattttgttttcatatgcttaagagaataagacaatttaattgtattaataattacatattttagtaattacattttcaaacttaaagattgaatccactaatttatggtcactcatatttgataattttgactataatttagctacgaaaggacgggccacgccaccactattcaccatttgaggatccagaacaaa

SEQ ID NO: 102306 - DNA, 618 bp, Oryza sativa
atatatatatatattcttgtctaattacttatttcagactcaggatactattttagcctaggaaattattttcctaaggatttgtttggttaattcctcctcataggaatggaagtctatgcggagagacgtgaaatcaaacgtcccttcccctaaaaataaattccttcctgtaggaatttactgaacaagccctaagggatgcccatgaaagaattatccatgagtcatatcaaataactcacattgtattaactatataaccaggttaaattattatctagtgtaaatgttactccctccgtcccgtcccaaaatataagcatttttagcatagtgtgaaatcaaacatttttaacattaactattagtagaaaaaaaattaaaaagaacaataatgtaaaattaatgttactagatttatcattaaacaaactatcataatatacaactcttttttatttaaaacatcttactttcatagattttgttggtcaaaatagtatctcaaagaccatgtcgaagtctaaaatgcttatattttgggacaaatggagtactaattaaacaagacccacgagactatgatgcatatgctagctagttgatcataggaac

SEQ ID NO: 102307 - DNA, 760 bp, Oryza sativa
gaatgattaaatcgatctgcatacgaatacctgagacccaaattagaactgccaaactcatgtcttccagtgcttatttttgagtttcatatcataattataaaagtgtattaacccttgaaagatccattatgacccacgaaaacaagaagcataaggtagaatggtaaactgcaagattaactgcacatattgtatactgaaacaaagaaaaattagttgtgtgccatctacagattttcgttgttttgcttaatctacagatcagttaggaggcaattctaatgcggaatatggaaaagcactaatccattcatttccacataattatgttaatcacttatagaaaattgtgcatgtgattattacatgctatccacctaacaaaacaagtgtattgatctcgagtaactagagaataaattgcaagatttgaccatctaatgaaatagtttattttgggtctagctcaaagaggtaattcctaacaagtactagtaataagataggcagtgtgccgaaacattatattccccataggagaatgcataccatcggtatcttgtctattaaatgatattcttcctcaaaatccttcaaatgaaccctctctggcactgtcaagcagtttaaaaaatgaatacatcgctttgcagtatgttcctgtatacaaaaaccttcaagtgaggttctcacatattttcctggagatgtatggaaaatgtttaaattgacggactattataaactcatgttttct

SEQ ID NO: 102308 - DNA, 1070 bp, Oryza sativa
ctaaataaatatttttcttcaaaattttgtattttttattccgatatattttttttataaattatattcctacttgaacttttataattgtttttatattttttgaatttttttatttttattcagaattttaattaatctcatcgtgggttctagatggtctcttctttcaatagtctttatttttctattagcaattatttatttataaattgtattcctagttaaaatgttatttttctttttctaatttcaatttgttttttatttcgaattttacttgatctcgtactgtgttttatacggactattatttttatatttcttattttcttttccactttatgttgtttcaaaatggtattcctacttgaactctacttttaatttttctaatttcagattttattttattttttattctgaattctaattaatctcgtattggtttcttctatggactcttctttcaatgttggttatttataattctgaattaccgttatttttaaattatattcgtacatgaactcttcgttatttttttctaatttcgtattttagttatttttttattccgaattttaattaatttcatattgggttaattattatctggactcttattttaaattccaaatctaagttatttttaaattttatttctactttaacttttttcatttttctaatttcttattttattttatttttattctgaattttaattaatcttgtattgggttcttatatggactcttctttcaatattgcttatttttaattccaaatttcaattatttttaaattgtattcatacttggattcttctttcatttttctctgattaatgtggaaatttttagcccccaagtgaacgtgatacctcctttcaaagctattataataatataatagataaatatcattactattcgcgatatcggttagatgccactgaaatttttcaaaattgaaaccgtgccatcacagtcacattttaaatccttccgacttcttccttcttccttattttttcctttccagccttctcttcgtctcttttcctc

SEQ ID NO: 102309 - DNA, 680 bp, Oryza sativa
gtagatcgactcgtggcaagtagctcagcgatgtcgatttagcaaaccaatgccttatgccactcagccatacctccaagttgttgatcggaatgggatgtgccgggttggttgcccgaagatccactgcgtaagccggggcgcgcgtactcttctttactgagcgagaaagactctatccagatctatggatctcccctgcgtccaagcgagaccccatccacataaccccttattttctctccaatggtagattcgaaccccaaatcatagaaactacactatatatgagtttctgtcccgcgtttcaatgggactccctggcagtacggtgctgaattctctggcttttctagcacgcacggcctttttcatatagcaccaggatgattaagacttttcataatactgggtgaagctaatacttttcataagtaagaacgagtgaagctaatactttctttgctgtgctatctcaagagtttagctttgagagttggaaaggaaatagggcggtgggtaaggcctatttcagaattttgttgatccccattttctacttctcttatttacgatcagctcatttcttaatttcattatacatctttctttgacggaatgcaacatttgctcccaatggactccctctggtcataattttgtaactggaacctgatggg

SEQ ID NO: 102310 - DNA, 573 bp, Oryza sativa
tcatcaagtaatgttctgtgtacatgacgaaaacacaaggggaatatataaggccaagccatgttgggcgagatgtgccccatgcacctggcaactggcagctggccagtgatggggatgccctaacttcgtgtccccctacgtacgtctccatggacggatggaccaagcgtgtaccccctttcccattatacatcgacgtcattttttttttcaaatggtttctttaaagtatttggttggaatttggaaaaaaaatatatacgaggggacatccccttagggattaaaatccatccccaacttaattcctatccccctaaatacttactctccccatcacaaaacaactccatttttagcatctaccccatccgtctcattttaaatgaaaccaggagtttccgtgtccaactttaaatgcttatcttattacattttttttataaataggatttttattggtatgagatgataaattataaataatactttatgcatgaaatatgtttttaatttttttcaaaattttttcaaaaaaaacggacaaccaaaattgggcaccaaaaaaca

SEQ ID NO: 102311 - DNA, 650 bp, Oryza sativa
caatcgtattcctcgtatgtacatgtttcgtattgtgataaagcacctatgccgctagaaatagtagcgccttaaagaaagcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgaggtttctctgatctgtttacggtattcttgaagctttctttcttggtcaccggacagagtgagaactgctctgctttctttccctagcacacacttagtagatagtaggcacaactccgctaagagctcatcgaacttgagttctagagtaagaccacagctcgatatggctcattcactagtatggtttaccacatgccagtgatagatctctctcaagtgaggtctggtatcggtgaagtcaatcattgaattgaagtggtagagtgcataaccgggcataaggccccatgtatttcttatcagtg

SEQ ID NO: 102312 - DNA, 581 bp, Oryza sativa
aaggggaggtaggagagaaagggggatgggattgtaaaagagggaggaagagatagagtagatagaggtagaagagttttataggtgactagtttgttatgtaggattaaaatcatttcggattgagtcagagggttaattatgcggtttgaataatttaggatgtaaaatatctagtatttgagtttaggagggtaattagattgattgtaatagttcaggggtgtaattagtactttttacaaaagttaaaagcaggtatctttccatatgcatttatttcattaacatcattgaatgcatggttgttgatttcttgacattttttcttgatatccatttgattatccaagaacaaagaaccacaggctgtatatgtccaatcatattcaattttttacatgcaggtgaatgaaggagagaacatgagctgcccagacaaaacaagaactgtaaactaaggaaattagcctttctttaaagacaacattcaattatgcatacatgaatggacccttgtaggattaagaggcatcaagaaattgaatagaacgatcttaggatcatgccaccatgctgat

SEQ ID NO: 102313 - DNA, 711 bp, Oryza sativa
cgttgaaattttcttcgattgatttgattaattaatatatatcccgcgtggggtggtggtggtgcggggttcttcgcgcgtcggtgtgatccagcgatttggtgcgaatctgtcccccattcttttggggggctttttggtggctgggtgggtggatgcgtttgtttagttggttggcggtgtgcggggtgcgttagggttcgtggagatctccgtggttcgtaagatagacgatctattagtgttgcgctgttgttgctcggctcgtggggtttagggttttttggctggagggatggagggggcttgaatggtggaggagggtgagtagatgtcaccatgggggtggtgatgaatggaagtttttgggtcggtatttgagggcctgcagattctcatctgttgcaatgtttgatctttgagtaagttttggttaaaaaaaagaatcacatgttttatggttgaagatgctgaaagcccttagtaacatgcttgatttttcatgttacaaagtgtccatgaaatagtgttgaatatcaaaacttgttagtcgatattcttccagatatcctattattagatatgagatttgaacgaggatgaattctgtgaatctttaaaaccagcactatgtgccataaagtcaaactatcttaaatcttcctttttttttggcctccatcagtgaatatcttaggctttgtccttttt

SEQ ID NO: 102314 - DNA, 514 bp, Oryza sativa
tcacaaaacactgggatccctgtccaaccgattgacacaattggagaaaaaaggtcctattatgggaccattcaagaaatatgggaactggactatggcctaaacatccaaatccatgtgctccgtcggaaatgcgtaaaaacacaataagggtttccactcattactacgggctaaccatagtccatcacagtaaaacaggccacaaggatgatccatgggttttagcagaacgtgtggctcaggtgttttatgtgaaggacccttcagataaaagaaaaactattgtcatatccggaaagcaacagatcgtcggcatccacaacatctaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgattccaaatgt

SEQ ID NO: 102315 - DNA, 1019 bp, Oryza sativa
atcacactttgtagtgttaatttatggtaattctgcagatgaaaggtaccactacatatctcaggggcctactcattactcaaggatcgtaaaacaccagttaaaatattaattgccatgtatatacagcaaaaacatgttactgggatgctctggcagcaagtcaataagatatcaaagaaggtttaccaacatatttgaccaatgcaagaaaactgtaagtttctctatcctacatgcaacataactggaataacttaaaactttgcataactactcaaatattgaaggcattcactgtaaaatggtattgaagttctggacattctaaccaacacaacaaactgataagtgatactctcaagtgtccatacttattgacaacataacaaacctatagagtcctacagtttaagaatcacagatatacatccttgctgtattacaatgcactggttctccaaaatactatgtagtaagacatgaaaagcaaatattgcagtacaacaccaaaacattcagataaagcagtgaatataataaagcagataaatgctccaaatagtgcagtaaataaaatgatccaaacaacgcagtaagtaattgaaggaccataaacttgctaaggagtcggtgtacagttacttgaaagaacagagcacaagacatactgagttgctgacatctaacaattcttaccagtcaccactcagattcaaactaacaagtgaagtacaaatctagcagatctttgcataattcgaccacatattagaaggcaaaatatgatctgcatattcataactactcacaattaagcacaagcagagcggcaaccaattagctacagccgacgaaccagatccatgccaattcgtactcaaaataaattccacgagcccaagaatcctaccagatcctgcgccgcatcaaaccccagatccgggcgccccgaggaaggagagcagcctgctggtagtgtgccattggagccaacgctcgggtcgtcaaggaagagg

SEQ ID NO: 102316 - DNA, 758 bp, Oryza sativa
actaattgggatcatgtgaactctggagtcctagagcaactaatgctaatatactactgcactgttttacccaggatttatcttcttctcccttgctccatattgtaagacattttagttttctaagtcagacttcttaaactttgaccaagtttatagaaaaacacactatcaagacatatttcctggtagattttaatgaaactaatttgatgttttagatgttgatgtgtttttctataatctaagacattttttattcaacactgaatctatcccatttataaaacagaggcataaaaaatgcacaatatgtgccagttcgttctggatccatatggtagcttagtttgtttgtttattttgatggaatttgcagacctctcgaccttttatttagcggaacccttgcttcaaccaaaatgttgatttcacagtatggaagatttatagaaaactcctttcatcactcttacaaagggataaccctgtagtcgttttgtctctatagtcatctcatttttttcttatccagtcaaagttttatgttcttcattctatatttcaccttgtaaacagtttaaacccattattgggactgccaaggattacagtgtgtcatacataagcataacacgattaatggtaaatgttcaaagggttctttcttgttatatggacttagtgcacactgcacagcaaaaagaacgggcagaatgcatcaacataaggaatgaaatattatttgataatttgat

SEQ ID NO: 102317 - DNA, 628 bp, Oryza sativa
attcctgcagcccttgatttagttgtagacttgtaaagcatcactggtcgtacaaaagttacagaaccgacggggaggagcatggaccagctggaggatgtacgtggtagcttggcttatgtgacctgtcgatgcgctcgtgaacatgataggagtaggacgacgctacagtagtgcaattccattattgtccaccagaaatgcataaatggccagcatgggactttctgtctgcgaaatgacatggttgaacagtacttctgttacttttcaagagcagcattatcagtattgttttgcaagaagtgtactctaagcagcgcgtttttattacaaattaagttatactggtgtagttacgatgttgttcggtgggtgtagcaagaagtggtggacgtcctggaacggtgggaactggtcatgacggcggcgaggcgaggcgacctccagagcctcgagtccctcctcagcaagcgcgccggcgtccggggacgtgaccagtacggcctgacggcgctccaccttgctgccatcaaagggcactgcgacgtgatcgcgctgctcgccgggtcaggctgcatggacatcgagtgcgaggacgtggaagggcaccgcccgctgcacctcg

SEQ ID NO: 102318 - DNA, 729 bp, Oryza sativa
attcctgcagcccggcatcaacaccttagttactttaggatggatatagataccttgtggggaaacggtatggaagatactttagcacccccaattttctcatctgctcataagttttgtaacttggatgtcaggtgatgataatgctagaatttagcttcagattatatcatctcatgcttctcgtgggctcatttcttctgaaccttttgtttgttatgaccaatatttaaatgataatcatcagcttgtagataattttcatactaaaagtttttagaaaatttctaagaaattcacaagctagtaatttattgaagttctgaaggatccagcttttgtgtcatgtcatcagttgtttcactgctatttgcaagaagacatttcatcatgtagtccaaaagataaagaatcgctttaatatgtattaccattacttgtcagtgttttagatgcacttccctaatgatatacaaatgattcatgtcacgacctgtctattttctattcggcatctcctcaatataaatctaatggaactgttcctgcagttaggcatggcatcaactgttgccatcaatttgattggtgctcacgctggcattatctcaaagttaaggaattgcgacatcacaagctacagtggcttaaaggcaagatcatctattagttttgagtcaaggtcatcattcctgggtcagaatgcatctcttcgatcatctatctctc

SEQ ID NO: 102319 - DNA, 502 bp, Oryza sativa
tggaggtgtcactgctccttcgcaccctcttggctcttgccatgcatgaagccagaagcagaatctcgattagccggtaaaattcgagctccaatcattttttcgctgatttcaatcaatttttgataaatttcgaacgaagttcaacagttgaacagaccattcgaaatgatggctcgagatggtcgaaattcgtggagatcgtgacccttggctagaagttactcaaataccaacagcgcaacgttcttgccatgcaaataagtagttcaattaccagcggtgcaatgcgagggatgatagtcccaaaaatcagtgaatcgtcgtcatcttggttgttttgaggaatggtactcaggaaaagggaatcgtaactattgtgactttcatggatcctcagaccaaacaactctagacattaaaacaaaatgtttctataagcaatcatgcatgctcaagtggcgctcacacagataccatgcaaataagtctaaaaaagcag

SEQ ID NO: 102320 - DNA, 521 bp, Oryza sativa
aattgccatacatgtatgcacgccttatattatgaaacaactttaaaaagtagttgtgccctatattttggaatggagggagtatattccatgcgaaaactttttatatataagttactttaaaataccaaatatgttcatttatcagatttataataattgaaacttaattaatcatgtgctaatagctttctcgttttacgtacatcaacttaatatttatcttcatgagtttcaaacatcaccataatgtaatcaagggaatgattatggaaggttatccaaagtttgagaaaaaaaaaacatcattggacgagaacactcctttatcctttcttggagtagttttttgatatctcattagcattctaagatttcgggatcgttcaaggtaaccgtggttagccaggtccgtgacagttgctaagggtaaccgtggacgtcacatggcatcgccaggtttagtaggtctgcagaatcagagatagatcgcgagtcaacctctccacttctccaactct

SEQ ID NO: 102321 - DNA, 2346 bp, Oryza sativa
agctagatattgattggcattacatacaccgcgactgtagaagttatcagaggcaaaaagttttcttatgacgacatgattagacttgggatgcatctggaatataaaaagaacagtgccatagtggataacttgatcgtttgtgctccctggcattgacgtaatatcccaattaattcattgacgaaggcaatgacgcaaattaatccctggctttcgtgataccctatgaattgctgttgtgcaatatgatatataattgggaaatattttgactctgagcaagactttgtacagatgataatgacgcagaaagagaggagtgaattaaacatatatgttctgaaaatagcattcaggacagacaccagcaacattaattagctcgtcatcagttcatacttctgaaattagggcagcgtgagctgtctgtacctaactactgcatctatgcaggcgacacaacatgttatacttaaatgtttatgggagagtagtttcattcattgaacaaaatgtgcattattatgtgcagggagatacttgaatagatagcatcggtgttgtgcaaattgagtttcaaattctcccattgataaattaattctacaattaattgaacagaccaacttaactagtgacagttaatttatttatttaaagatgcttaatttgatctgatatacatatatatatatatatgcatatatatatatgtatatatatatatatgtatatatatatatatatatatataaattaagcatcaatgggagaatttgtatatatatgtatatatatatacatatatatatatatatatatatatgtatatatatatatagatatactatactacagatgaggtgcgttgtattaaaacacaacccacccccacccccacccccaccccgctcccccacacatttcttgtagtactgatagtaaaatgattactgtaggaatatgtatctaccctatagtaatgttgttacttcccgcacatattagccattttctttacacctgctttgtacggttataccccgaatttttaggatctgggaatgggcgaccaagggagcggcgtcggtgtgctccagcggcaggcagcgggagaacggcgaaatcggccagcgacgggtggaaaggagtcgccaccgcagccgccggaggtcagagctgaggggaggtgggcggacaacaacgagcgacgcctcgagggtatctttcctcttcttgttcttcttgttcctcttcttttccggcgtggccccggccggaaccctaaacgggggcacgtctcattctccgtccgcgcgtccgccgcggcggcgccggcggcagggtgtgatgccgcgggggatgggggatggggatggaggcggccgccgtgccggaggagctgcggcacaaacgctctgacggcaagcagtggcgatgctttcccatctcctgcaaactcgtgttctcatttactcagatcctgtatggaaaggagggcggcgacgagcagctgtagcccctcacccagttgtcggctcgtcacagccccacacggatacatcttaggcttaacataaggattgccatattaaatagtttccccctaacttgttgtcaccatgaaactttaccacggattaattgttagaagtaatagactccaataaaaattttggcttgacacctgtatcatgcacagtacacacggaactatgcgtatataggcttgagaggcactgggaatggggtgatgacaagcagaccggaagccagaagcttgaaacccaagttttttcaggttgtctaactactaccaatcagttgcttctcaggctatttgttgtatgtgagtcgatgataacaggagtgtagatatgctcgatcgcttctatggctagactgaattcgtattctgtcttccagtttaatggcatactatagcaacaaaattggtcacgggtgatttttcttttgttcttattgttctccatcttagcacagtcacggagttttgccatttgcatgcacgaaatataggccagcggtgtacgtaataagcatcgatctctttctttttctttttttaagagatttgtcggatatattagaaggaataaagtatgccaagcatgcactagaagtagaaagtaacacagaaggtgaaaaaacacctggggtataacagctccattaagagattaattacaagggggctgcgacccaacccactgaaattcttccaaccaggagaatctctagattgtgcgatttggtttcacattttccttaactatgaaagatacttaactctcgttttacaaagcagctagattgctggaa

SEQ ID NO: 102322 - DNA, 2575 bp, Oryza sativa
taggataaaaaagattaaggcaaaaaaaaacatacggagtaccaacgggaaaaacatcgacggtttttaaaacagatgtttctataatgtaaaataaaatatattactacacaaatatacgcaaatatatatcgaacagcaagtcgagacaatataaatcacttatgtttaaagatactttaagataatgattatacgtatgtttatagcataaccgatcaaatagatctagcatgtatcggctaatactccgatactactctatattaagagattgaaacagagaaattttatcaaatcaatttcttcaccaatatacgcaaatagaactagatctataatataaatatcaaatatcaaatcaatggtctttaagcattcatctttttaatttattttaatttatatttatattcaatttgtgattagtttcatgctttaattaaatgaaatatttatgtcttataaaaggtatattatggtcctaaatacatcatgacacatgggaccaacatataataattaatgttgtggtaatttttaaatagtttcacattatattttaggatttcacatatcacttgataaatatacaacactaatttatatctacaaatgtaaaaaatgaaaacaaaaaaaatagtctattttttaagtaaatccgatttaatttaatttttttggattaatttatcgaagtttttattttgaattttttagaaccgtttgattggtatttaggtgatgagcaatatacgatacataggtgtgataaagataaaaatatttcctaccaatcatctttgctttaatataacccgttcatccatcataaagcagtcatatatgtatgtttttttccctttaccaaatagtttaacaacaaatgaacaatcaagtatgatgcgcagtaaactacacatgatatatttccaaggaatttcagcatgctaagcataattgatgaatgtatactcccacaaatttttagttattgtaaagaagtttgaaaaaaataaatacattctttagtaaaggtgtttaatgtgattatcaataataggtattgaaaataaatcaggtgctaaactatagatatttatcaatataactaataatatggtgatatagagattattgtggtggtatacgttttttcagtagcatcgaatgatgaacctcatcattttttttcaaaagagagtactctatgtatactatgaaaatttgaatagcgatgattaacaccattaaattgtgtctactgtgtgctacacatctactcaaagtttttttaaaaaactattattttgatcaccttgaatttatgtgtcattttctaaagggtatcaagcattaacaacagagtttgctacgctgtctagtaggggtatacaaatagctgagtgaggtgaccccaatatacaaatacaattctccatgagggtatgatagtaaattagacattacttatgctcctggatggtctttaggggcacgactacatcgacgagggagtcatctttcaactcaacatagaaagaatgtcttggtggctacgatcggcttcacccgttagaggagcattcatgtttatctttaacagtgttattttattaattagtataagtgatatttttaaaatatttatatatggattcgaaaataagtgaaacatgaactcttagataagtagtgaatgttttagtgtatcaataatgtattaggcttattttattggtacatctccagtttaatctattaatagatacacaacttttaaaacagtaataataacttgtgacaataggagaatttatacgtaatcgggagagactgattttcttttaatcttggagacattcttatcatttactaagtatattaaagtcagtttatctcacagcacaaaaaaagatgaaacatgacatcttttagtattatttcataaatcataaaacaataaataagatacacgcgtatctgcacgggctttcttccttcctagtttgtttaaaagccaatggttcaaaatacattacgataaaaacccaacaatcaacttctaaactaaagtttaggacttaaacttctagccaatgggtgttctagctactggagttgatcggaaagttacctacttcggtgattgtttttttgggttccggtacttcaaattttgtcgggagatctaggaccatcagtggctaataaaaagaaaaggtgtttcaaataaaattgtctaaaaggcaggtctttttttctgacaattagtaaaacacatgtcgctaaactaaacagaataattttacggatagatcaactgttatatgtaacctgttatttcaagtttgtttgatgcaaaaactgattgtaaattggtatatagctaagacagaggaaagcaacaaattggttcttaaattagcatctttaaatacatggttgttgattatcaaaggcaaaagaaccatagactatatatatccaatggattacctactagctcgatgaaaacgaacatgcacagacaaaagaaaaagactaggcctcaatcaacctaccatctgcttca

SEQ ID NO: 102323 - DNA, 577 bp, Oryza sativa
aagcatcaaagaatcatccgcaatcttccgctcaggatgttgttcaaactgtttcagtgctgagctcgtatgcaagatcaggggcaaacatcgatgggttactgcagcttgataccatctccattttaccgacgcctccaaatccaacatgcagagctatacacagttctactgtctatgttctcttgtcatctttctttacttgattcccccaaatccaagatgctgggatacatacaatttttcttactgtgtatgttcaatagcaatgagcatgcatccaggcaaaggactgaaggaaatttaaggaaaaaacaagagtagctggtgtttccaaatgggaagaatctgatatgtattacatatgttccctgcccttctcaggtcgcaagatatataactctacacacataacattggtaatatgggatactgggaacaggtaaccaacaacaattttaccatccaacatttggtatctcgaggtaccacattttacacacaaattttaatatctcgatataccaaattttacacttaaaaagtatctggagggatcaaaaattaatggtacctt

SEQ ID NO: 102324 - DNA, 1566 bp, Oryza sativa
aaatagttaactgcatgttcagaaaccgatagcgatgacagttttgaattagcaatcaaagtgtttcatgtggtcactgctggcatatgtgcgagtcgactctaatgccaaatatgctagggaaggggtcaaaattaaacacctggtaacactagcacatggtttttttttccctctcatcatcaacttacaggtggactactccattattcagtcagagtgtaatagcatataatatgttgcatataacataatactcggtaagttactttcccgttacagtcatgaacaatacgacattctaactagaggttccctggctataattgaggtgcacatggtaatctctctgacttccggtctgttaatattgtttacgcaatgtttccataaaacactcgtcaagttacctgatgccaagagaagcactcagtaaccttttgttagaccctgggagagcatcccgttctgctagcgaactctggtcttctctaacgcctcccattctcaacctgtatggctcaggctgtgttgggacgcccatttttccaccctatctccctcgttttccgcgtgcacgcttttcaaacagctgaacggtgtgttttttacaaaaagtttctatacgaaagttgcttaaaaacatcaaattaatctatttttgaaaaaaaaagctaatacttaattaatcatgaactaatataccgctccgttttccgtgctactgttccaagttgggaacaacccatggcaaacacagccattatgactttctcctatcttcttcctggatgcattcatccatatgctagccagcttatgttatcttcatctcgtgctttgttctctggcataatttgggtagagcgaacttatatatacacacatgtacacatacttacttacttttacttgtctatttcaattttgaactaaaattacaaccaaaaagtaaaatttttgaagtacctaccaactaaaagggagccaacaggaaagtggtacaccatgcgctaattaatgaaagaagaaagttaatattcaaacgaaaatgtataaatagacacatgtggaccttcgtatgaattgtagtagagtttgaaatgttggaagagctcagcatataaaattttcagctactagctagatattgattggcattacatacaccgcgactgtagaagttatcagaggcaaaaagttttcttatgacgacatgattagacttgggatgcatctggaatataaaaagaacagtgccatagtggataacttgatcgtttgtgctccctggcattgatgtaatatcccaattaattcattgacgaaggtaatgacgcaaattaatccctggttttcgtgataccctatgaattgctgttgtgcaatatgatatataattgggaaatattttgactctgagtaagactttgtacagatgataatgatgcagaaagagaggagtgaattaaacatatatgttctgaaaatagcattcaggacagacaccagcaacattaattagctcgtcatcagttcatacttatgaaattagggcagcgtgag

SEQ ID NO: 102325 - DNA, 628 bp, Oryza sativa
aatagttattttatacagaatggagcgggtggtgagaatcgaactcgcatcgttagcttggaaggctagaggttatagtcgacgttggttgattattattaacgtctctaattcaaaaccgaacatgaaattttgatttcattcggctcctttatgggtattctcaccacttaacatctaagtcagctttttttgtatgaatggaaccaaggctctctgctttctagatgatccctaaagagtaggagatagaaatttgcctaaatctatctaatctaattacttcgttctctaatttcatttaagagatcatgaggaaaagaattgggtttccaccaagctgaaacaatatgctgatggttcttgtaaaccaaaactaccgttttttagctatttggcttccatttcctttttttaacaaaagaagatttagttatgattggaaataaatttttttgtatcttcatccatagatcctttactcatattttaaaaattggaatccatgcttcgtgactctgtactcgtaatccaaatccaatttgttttttgcatgcaatttcaattagtctttgggtacaaatcgcgaaaatgcatattcttcctcaatatgctattgagagaaaaa

SEQ ID NO: 102326 - DNA, 708 bp, Oryza sativa
tccataatttcgaaaggaatttgatatcgggtaccaaccgggtcaaagacccggatccgtttgtggaaagctgagagagacgcactcgggcccactcccaacggtcggggatgcgaaaagttgaccttacctgaaactttgcagacaagcccctcaactttcctgacatttgattaattcgtgaaatgtttctctcattcaaatttcatataactgaccactcaattttatatggacagaaaacagaaaatgcatagtatttttttaagataatgaaatataacatagtatgaaaaacaatggaatgcacaatggcgaattcatgatgcaaattgagggaggctagcgtaaaaacatagcatgagtggagcaatattaactgaatatttcccgatgaaatccaaatgctcatatcatcaaaagaaaaaaaagaaatccaaatgctcatatcatcaaaagaaaaagaaagctttctctacattaattcacagctaaattaacatatccaaagaataaatctatgaaaaaattggaccttttatataaaaagatatggtcttgatcttttcattaaaaaaattgatattgtctaattagaggcaagtcttccaagtggggctggtgtctcaactagccccaacaacctatccgccatcagaaatgtacaaaacatatatcaaattagaaaatagtattgtctcagtttta

SEQ ID NO: 102327 - DNA, 681 bp, Oryza sativa
tgtactttactctgtaatctccaaaagttaatattgttttagtcaaaaagaagttaatattgttttaatttaaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatatgatctaccctgcttatcccttgaaatgacaaattgaactgcagtctgaaaatgagacataattttatcaaaatactaatagtaattagagaagagtggcacttacattgtactcggaacaattctgcaagcctttctacatataaaagcatccggtcaaatatcaatggttgatatacatgcatgca

SEQ ID NO: 102328 - DNA, 863 bp, Oryza sativa
aatataaaacaatgaacaaaccatgtgattaaaaatcaatttagtatccagaatcattgcacggttcaataagaaaagaaaatatgtataatatgttcttatttacaccaaagcagtagcctgaatctaggggcaaaagtaactttctcatccactttgtactaaaagtttggctaaatttatataaacaaaagtagtactgtactctagcaatctttaaccttttttggtacaaatcaaatgaagtatggcctcaaaatctggaaacaaaagccattaacctgtcaggaccacatcagagaattactaattaactgtctacaatccaaagttgcagaaatgcataccatgtgtgcacattttgagatcattaagaagcatatttgatgggtgtaaagttatgttctaaagccaatggaataaccagcaaaaaaatatcatgtgctttgcacaaaggaatgcaaatgactaatgagaacagaacatgaaatttacctatttacttgccaaaagccatacatcaaagtttgcaccaaatgatatggtctaaacaatcacagtggacactaggcatcttttcctcgcaagaaaaatattagcgcaagtcaatgaatatgcacgtaaatacacaagtttctataaaaaaatggataaggataaaaatagataaataaggcaaacaagaaatgtctactacattcatatgctcaccttatatctcgcaacaatattgaaaaaggcataggctaaacaatcaaaacgagtataaagtacttcatcacatttttaacatttttaatagatgacgcaatcaattaacggatatacgtatgaccattcattttattcaaaagttctgtgca

SEQ ID NO: 102329 - DNA, 818 bp, Oryza sativa
tttgcataagtgtggagccacagcccagctaaccctggacagatgcctaggagtggtatagttgagtttgtctaggcctgaaaatatttttggctctatcattgttttgcatgaagaacaacaattgatagccactaagggcctctttgaatcgcaggattgaaaaaacagaggaataggaaaaacacgggattttggtaggaatgcatgtgtaaaacagatgattgcaaaacacaagaaaaatatagggacgaccgtttgattagaccgcaggaaaaatacaggaataagatgagagagatagacccaaggaaagttttccaagaagttagagtagatgttaactttcctacgtttttgctctagaattgtaggaatagggaagtttcctacgtttttccttttcttattcctacgaatcaaaggcatgaatagtgtaggatttcaattcctttgtttttcctctatttttcctccaattcaaaagggtcctaaatctttttgattcatactatctaggtctgttaagggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaatagaaaagtttcctacatttttcattttctcattcctacgaatcaaaggc

SEQ ID NO: 102330 - DNA, 538 bp, Oryza sativa
tcataattctagacatctcctgttgtgttaggtgctggtgctagaagtggtgagattttggttaaacctgatactaacaaaacggtgtttaaatctgctggtatcatgtctactatgagtgcatcttcttcaaaatccaatgttgtgcatgcaaaatctcctgttgttgctcatgttgctaaatctagtagtgctaccaatgtgtctaatcatcgtgaaaaatatacttgttctttttgtggcaaagatggacatattgttggtttttgtttcagattagctcataaatagaaaaaggagagagagattgcttttgcaaaatcaaagtggcaaaaatcgggttttccctcgaggaaaccggtcagaccgcagtgggtcccgcggtcaaaccggctgaacagcctcggccagaccgaccactggtcaggccggcggtgaagcctcggtcagaccggtccccggtcaaaccggctgcacaccctcggtcagaccggcctcggaggaaattttatgaaaattctaaaattgattttgcacg

SEQ ID NO: 102331 - DNA, 601 bp, Oryza sativa
taaagttctttcgaaattctggagacatgaaaactagcacatatcttttgattgcacattctctctgtgtgagaacgttgcttgccttctaatctctcttcctcctgtgtcacaggaacattttgcatctataatttcccaaataaaatttgttatcgggtacaacaagttagagacctgcatccatttatagacaacagtgagacacattcaggaaatcaggaccaggggtaggggagatgaaaagttgattttgccagaacttttcatataagcccccttaatagtttctgaattactgaaatgattatctcatttgaattccataaccgaatcgaaaatgcatctggaaaagattgaaataacgtttcctgttacacgagagtacaatcaaagtacaagggttccctttgataagagccaatttatcagtaagtgttgtaatatcaattatattatgggaacacgatctaccagataagcttcaagaaaatgttggacaaacgacttgacttcttcggtttgttgcattagagaatagctaagtcgatccgagagctgacagctagaagctagtaaatcatgcataaccataagcttc

SEQ ID NO: 102332 - DNA, 596 bp, Oryza sativa
tttttaaaatctttacatcaaaatcgaagtggcaaaacgtgtacatataattaatcgactcatcagtcacatcaaacgatcaagatgacattgatactgcaatcatgctagatcaaattaaagctggtgaataaataaccaacgggagatccactatacgagtatatgacttgctgatgccttccgtccagttctgaaacttacgccgaccctgcacaattttcatttctgataccacccgatccaagttatgtatatgtatcactggtgcagaaagcttttttactcccggttggtaacccccatatagtcacggttttccaaccgggagtacgaatccagaactaaatatcgctatttttagtcccggttgataacaccaaccaggactaaagagagtagcgcttttttttttcttttgccagatttaatttctataatttctcccgaatttagtgccatgtatatccctaaatcaatccctaaatccccaattcaaagtaacatccaaatattaagttacttataaacataaatcaaatacatcacaaatcctaaaaaaaacactcaaatcaaatacatcacaaatcctaaaa

SEQ ID NO: 102333 - DNA, 714 bp, Oryza sativa
agaagcagtgcctccgaaaccacaccttcgcctgatatctgcaccgggtaggcgggtgatcatgtttttggggagtgcctcctgcacgactgctcatcgccatgtctggattgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaagaaagtggaccgaccatctccaatgatggatttcgaaacactacggaagtgtgtaaggcccgcgacgatgtccttccagatgatcgtgtcaaggcgcaaaagatcgc

SEQ ID NO: 102334 - DNA, 567 bp, Oryza sativa
gacatcaagcactaccagcacgccaagaatgtcaccgtgctcctctccattggtggtgaaggtgaccagtactccctccccatgcccaggtcggccaagaacgtcgccgaccacctctgggacgcctacctcggcggccatcgccatggcttgttccaccccttcggcgacgccgaatgaaaacaaacaaaagggaaaaaattgcgccacgtgttaggactgcagcctcctcctgcacggcgacctcgcgactgcggctgtgggcctctcctccccctcatcaccgacgcctgcgggcctctcctcgccggcgcctacagcccccgcaccgcagcctgcaaccgccgtgccgtcgcttgcggcctcctcgccgcgccccgtgccacctttaccgcggacctcctcgtcgcgtgttgccgctccaccgccacaccctaccgcgccgccgccatggacctcctcgctaggatcaggattggtagggttagggttataaattttgtttcatctatctttttctttgacagtgaaaattgggtatattttgcactgtgggcaaaatggtca

SEQ ID NO: 102335 - DNA, 833 bp, Oryza sativa
acagggaggtcattggtttcaggttttgtccccaatttcagagttttgtctacctctttagcttcttggaaaaatggttgcagcacgttctgcctggagtttgtcgcagagtagatcatggttgttctcacagcagatcgtagatggggtcaaagtttgcgaggaggtctgacttgcatggagatagcaaacccagagaaggatcctcctggtaaaggcatgtccatctactgtgctatcaaccacaagtgtttcaagcttccgaatacctcctaaacctatttttatcatgatcccaaaaaatgtatacacatgattattatgggcaaatcttgaattcaataaaagtagcaaaagcctaatgggcgagcaatgggagcagaggcttgcagatcttactttggttctcactcgaaggagtactcctaactttggtttgctctagcatgtatccaagaatgctaatatctatatatagtcggcagtagttgaagaaaagaagcgaaatatatacatgcatggttgttgcatagtaaagttttgatatggaaatagtcagcaaatcatgggcatttccaaaattttgataaagttgtgtttggttttgtcgccgaatttaaactgaatttcttgtagggttgctaggcctattgttttgtttgaagcaaaccacagtatcaagcattgtgcagtaccaaagttttagcattagatggggacacgttaattaactttataaagataatacgtacatatccacgtatattgccctcaaacatgtacaaacatgagagaaaatttctattgtgttctttcttttttttttccatttg

SEQ ID NO: 102336 - DNA, 581 bp, Oryza sativa
tttcttccataaatcccaagtcattacttccattccatgcttcattgttgtccataatgaatattttgttgctgcaaatcattgttaagtggatgcggtatgtctatacatctggcactgtggtactcatcgtcccaaattgcagtggatctgcaatgttaagtttatgatgaagggcccaaaggtgatgagaaggcaagggtttaagttttgggtgccagcccgaatcctgctaacctacagacttggctgctttccgtttcatacccctggaccatttttttgtttgtgtttcgaagcttatgcatatgatgccacagaactagcctttctcatgttgtctcacattgtagctttgctatttatttgagatattttaccaacagctcttcttgagtagtaatttatttttatttcatatacaatgtttcttctccccctcacttattctttccctaagttgtcattctagtgatagttattcctgcagtgtttttctgtgaaccatgttctgtaggttgcttacagctatggccgccgttcatagctgacctcttttgttcgtctttgcaggatgagtc

SEQ ID NO: 102337 - DNA, 1409 bp, Oryza sativa
tcagaccaaatggaaggcattgggtttgaattcttataaacagagaatgaggattcacttatatgtcttccaaagtttgctactctactagagaagaccgcctcacagtatgtttcattgtaataaccctttaagatattgcacgcttgtaggattctacaatggaatttgaagttcctaagtgcagaaaatcaagaaacattacctattagcaaaatggactagagatttgcatgctagacttagagcagatacaatagcagactattagccaactataaacatattttaataagataaaagatgagagagaagagaagcgggctacaaatctgtagccagctgcagcacggactataagacgcaatatgtgtatgacgggtgggaccatatattaattgtatagtaagcaactactgtattaattggctattagattggctatagatgaattggagctattagtgggctatactattaaacttgctcttaggtgtaacatggaggatccctataggttgtgtgcactgtatgcatgactctcttggttgctacactacaatgtttgacggccacatctgtcctttttggaagctgtgtcactttctcttttcttggaccatcaaatttttttaaatttacggggtatataatagggttcgtaggcattaggaatgcagggtcgagcttgcaagtgaacacgatatcaatcattccacatatatatagtaaaagtagtaaggcccaccatgattatctgctaggttgtgcatcgagagaatggaaggtgaaattggtgaggaaaaataatcgaggagggagacgagtaaaaataaaaagtgagagagagcatatattcctaaagcctgggaacaagagcattatccacaaaagagatatgtattgagtattgtctactgatgagatggctatggggttaaacataccagggttcaatttgtgaaactcaatagatggatgacatagttagagccgtacataattccaatcgattttgctatatatttatcgaaaaatttttctctaaaaatttgacagatgtaattacagtacaatcgtagtgtaattacactgtaacttatatgtaattacactgtaactatagtgtaacttgcatgtagctttcaaaaatctctccgtaacatgttatttcggtaaaatggaggtcgtgggaacaaattctttcacatatgtgtgtgctatgatttgttttcttcctcaccaaaacaaatcgtgtaatagatttaacgattcaaaattatgtgaaacttacatataagttacactgtagttatatgcaagttacagtgtaattacatataagttacagtgtaattatactacgattgtactataattacatctatcaaatttttggagaaaaattt

SEQ ID NO: 102338 - DNA, 591 bp, Oryza sativa
cgctttttcccgctccttttactttttttctcattcttttttattttttacgaactattttttcgccactttcttagggaatcagatggagcttttttagatgtgaattttttaagtagggccggacggaatgaaatgttttgaattttttaagtagcagtgatagagaagcatacaaagcttatatacatgcgtataaaaaaatatacagtttacaaagtttgtatacgtgtatataaagtttgtatacatatatagtattaggaaataaaaacccaaaaaaagaaagaaaaaaaagaaccgaaaaaaagaaggaaaccagaaaacccatacgtgggaataggattatataggaataggattttcccccctttttaaggggaattagatctactgtttttttccggcttgcaaatcggacatgttttttttttcgccacttttttccgccttgcataggaatcggacatttttttttgttgtttttccctttttaaggggaactgaatctacgatttttttattttattcgctattttttctcaagctttgggaattggacttctttttttttttgctattttttattta

SEQ ID NO: 102339 - DNA, 629 bp, Oryza sativa
attcacaaaatacttcttacaattttttcaaaaatcttcgctacattacatcttttcctaagatatttgtcacagggtacgagtactaccaagaggccaacgccagtccatagactggaagatcttctcggctgtaacattctgaaaattcgaccaacaaaatcaaagactccaaaaattcaaatcttcaaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattcggtgggtttggaaataaataaaatgttatcgcaaccatattaacaataattaaattttaatacgatggaatgagaattaactttaattaaaaattcaaatgaattatataaacaaaatatgagtgatattaaattaggtgaatcttcaattagaataatataaatatggggtaaaacttcatttatacaaaaaattaagaatttcggaatgaaattcatatgagaaacactctaaaatcggtttattggaaaagtgcattgttcattg

SEQ ID NO: 102340 - DNA, 584 bp, Oryza sativa
ctgaagcagcagggaaaaccaatgacgagatgtgtcgcttcgttgtaatacaagagatagcagaggaatgatgactactaatcaccacgatacaattaactccatgctgccttcttttcttcgctaccaagctcaaatcttcactcctgtgctcctttttgttactgaaacctcccaatcccatatatatatatatatatatatatatatatatatatatatatatatattaaatttgtttggtgctccatggtgcccgggcaccattgttgaaattgagtatataaccaattcaaatgagtatgaaactttttcaattatttaggtattaacattaactactttactaactacttcaaagcaagtttgaactgaatttgaacttgtttttgttagattttgattctaggtatatagcatccatacatataattagttaggtatgtaatcatgaattgtgaaataagttaaatttgagttgttttgttgatagatatatgtatgaatcgaattcttataactacgtatatactccccatttaaaaattttgaaaaatttgagtaattttctgcctttgaaacca

SEQ ID NO: 102341 - DNA, 1233 bp, Oryza sativa
cacactgccgccgccgcctcgcttcgccggagccgtcgccgccgccgtgcgcccagggcagcgcgcccctgcgttaggccgtcgcgcctcctcctctcctcctatagggcccgcgcgttcccgcgtcctccctcgtcgcacggcgcgtgggcggcacgcgcggcaggtggtggttggttcgggagggcggcgtcgtcgccggtcaccgggtggtgcggcgccagggcgcagattggggcggtcaacgtaagttaggctcatggcatacaagtaactccaaaattttttgtggcacacaagtaaccagtaaattttttaatggcatagggataaaagacttttagatgtgccttcttgggaagttcactgggactacggttatctgaactgttgaatcatcaacaaactaaagtttggtgaattatgctttaccatagttttcgtatcacccacgtaataaacaggttcagaaaagaaggctaaacttcagcagaagagccatttagtgccatttttacactataatggtaaatttcacatgcagaggccaatcctaatgggccaggggatctgtggataaggcccaggtgcatggctggggatggccagtggctgaggccccctcatccgcaccgcgcagttccatctccccacttatgttttatttttgttttctccatcgcgcgcctcatttgctctgatcggccatcgcatgtatgctcttattttattgatgtgaatcaagtttgaattgatgaatttaaaccttgtttgcatttacgtgcataaatgctttggaactttactctcaagagatatatatacagacactgaggcaggtgaaatgagtgagaccaaaatcataaacatcctcacaccgatatattttcggggttctgtatgacggttttacagttcaccagcacacatgtataggattgggagctgatctggaaatgaaaatggtgcaaattatattgagatacgtatataggattggaaggtattagagcaggtacaataatcctatgtaagcaggctataacaacaaacaagttatatttatgttgagaaaaaagagtgtgtgcgtgaagagagaagctagtgtgggcacttattttgtcgccagagctaacaccggctcccatgcatgctgtggggtccactagtgctcagcttatgtgggtgaccagctaaccttcctcccgctagtgtgaaagttgctcattcagg

SEQ ID NO: 102342 - DNA, 713 bp, Oryza sativa
catgaacgtagtcacatgtggatatactactaggacggggatgtattctggctttgtttccatatactgtatgtttcccattaggccccgttggattaatcttctcaagatgaagattaaaagcgggcacataaaactagaattccattaatacgtgattaattgagttttaatattacaaacttaaaaaataatatatttgatattttaaatcaacttttatatagaaattttctgcacgaaacatatcgttttatactttaaaaaaggtggtaacggaaactgagataaaatctttatcttcattagaaaataacgggaccttactagtagaagtcctttttttaagagttaggtcttgttcttttcttcaataaaagttgaatgaaaatttggatattcgtggcacgttttttaaactgctaaatagtgcgtttcgtgaaaaatttctatatgaaagttgctctaaaatatcagataaatatatttttctactttgtaataattaaaactcaattaattatatgttaataccacctcgatttatataaaacaattaatcttcatcttcatttacgtgagtttcgaacaacaccttagtagaaaacttatactacttgtatagtggatacaggatgcctgtctcctacagtatatcaatgttttatccccagtgtatgcacatattactccggctgacgcttgcctgaaat

SEQ ID NO: 102343 - DNA, 653 bp, Oryza sativa
tcatctggtctctaaacaatactaacatgtcaaatatttaaaatgaaccgattacctctttttttttatccataggtatgattgattattacttaaatggcagacaagacgcagttttgttcggcgccgttgcatgattaatttaggtgcatcctgaccggtaccaaacatagatatacattacaaagtttgttgaaagatacatatatgcaaatacaagtatagaacaatgataatttatttatctttgattcctagaacaaattagtgtcaaagtgcatgcatgtaattaaaattttattctgataccttttctttctgcacgaatgcatagagtacacatttagagttggataatttagatgagaaggcaccaacttttgtagacaagagagatttgtgaaatgctaccttagcttctctttctttctctctttttgtctcttgtctccataaaagtatagtagtgcctacagctagctgctctgccatgtggcctctcggttttcgttgcaacttttgggcaggcaggtacatgaatccttattagatatagctttcatgtgcaaaatttaaataaatgtaggccttttcgctaaaaccgtgggcaatcaagctattttaatattgctgagagacatcgtcaatgaaag

SEQ ID NO: 102344 - DNA, 849 bp, Oryza sativa
tttcttggttagttcatgaatgtttcattcaattggttgtgggttcaattctcagtcccctttgctgtattctctatattttcttctttagttattgtctatcttttcttatttgggtatatatataatgttaaaagcatgtttgacaaagcttctgaaatggagccgcctgaatcccactctgctatctagtttatttttttaagatcactttagtccacttcaccttttttagtgcagctaaaactgttcggttggacttcggttttaggaggggtgaaccaagggcggagctacatagaagggcgggattttttttttttgggggggggggagggtaggcagaagggctcgagaacccggtcaaaacaatttttctatagttcttctattttcatcatatgtataacccccttaatccaaacttagatactcgtataatcctaactctaggtgtaaattaaagtatagtaaagcaagtggcacctcttcatttcattctatctccgtaaactggagccctactaaatagatctagatatacataaccatcaaaagaaaaatatcctatgttcgccgcgcggcgtagggatcagctaactagaagtcttgatctaatcctctacttgagaagttcagttgtttcttctctaaaatatcccccaacatactcccctttttagcttacccaataaaagggacaacaaattgttgtctcttcacgtggatgactcaacggcacggccgtttgccgcccgtgtgcatgcatgcatgcaaagcacacgtggatgactcaaagtcacatactacatgtacactgttaaattaatttaacccacaaataattgg

SEQ ID NO: 102345 - DNA, 818 bp, Oryza sativa
agcgccaaatagcgtggcgctgaatatgtgttggcacgctctccaaacacatgcaaacacagtgaggagggctcacaccgaaaaataacaccaagttcacagaggggaactcaccttgcctcccatgcagacaaccacaacaccagcaaaaaatttcacaatttgaccctttgcaaaaactatttttacaaaagaaccgtcaccaaaacttatttcaaaaataacccttggtgttgaatttagacacctcagcgccaaatagcgtggcgctgaatatgcgttggcacgctctccaaacacatgcaaacacagtgaggagggcccacaccgaaaaataacaccaagttcacagaggggaactcaccttgcctcccatgcagacaaccacaacaccaacaaaaattttcacaatttgaccctttgcaaaaactatttttacaaatgaaccgtcaccaaaacttatttcaaaaataacccttggcgctgaacaaaaaagtcatttttaaaataagttttggcagcggttatttgtaaaaaaagtttttgcaaagggtcgaattgtgaaaatttcagcaacaccaaggagcctatataaacaccaccacagccatgcacccctccatttttctcctcccctccctgatcaagctctgtaactaccaccactccgttccctcgcgcattggctgccacctctgcgcttgctccgccgtggccgggtccggctgggcctcagttgagcaagaggacaggaagtccgccgcgccattgatcagtgtgagaatgactaactttgaacgactaacccctaacatcta

SEQ ID NO: 102346 - DNA, 765 bp, Oryza sativa
tcctgcagccccggaccccatcctcggcgatgtcgcccacgttgtcgcccaggttgtccgcgattcgctgcccacattggattcacaccccccttccaaacccttttttaaggattaattttttttggaaggaaggaaccaatgggggtaaatttgtaagcttcccaaacttttaaacggttttttaaacaatccatttatataaaaccatttaataaaatcttcttgtatatataatttctttcaaaaaaactatttcaaaccaaaatcgatctcaactctatattttctccgttatatgttatacaacgttttggcctcttcatacatcatctaaattcactaatatctatataaatttgcgcacatatacatattgtacgtatctgaattcatgcataaatctattcaaattatacccaaaatatcttataatacgaaacgaaaagaaaacaatatttagttcattcgtttgtaacctcaaataatcattacaaatattcagatattgagctattcagtcaaaagaacaatccaaagtggatgcatacacaaatcaactgccaaaatagatttgtttcaatcgatctttttaaaaagaaagttggtttgaattgaattcacttaaatttctaagtcaaattcagtttaaatttgtccacaatttaaatatttcctagcgagaccttttaaataattccttttctccaaacaagacaataaattttcaatctctctcctatatttctatgaataaatccggta

SEQ ID NO: 102347 - DNA, 1590 bp, Oryza sativa
aaaagatatcaacattttcaacataatacaaatacactataaaaacatattcaatgatgaatttaataaaactaatttggtgttgtagatgttatttctttctataaatttgatcaaactttaataagtttgacatagatcagacccaaaatgtcttttagtataagacggagggatgacacgaagtaaattatactgataaatcatcgagcaaacacctattgagatcacccgtttcttctgcagtgagcaaacctcaactcttataatttctcagtacttaattgacaaaattccctatctagcatcagaaaaaattgctcttccctctatagcacccaaacttcaaaagatccctatctatgcaccctcaaaatttttgttccctatctagcacttccgttagttttgatggtgacggtgttaaccagcatgagaaaagacggttttgcccttctatattttatacttttttcccattctctgttcactttttttttcttctttgttttttcatttagtgtccagccgtgttcaagtctgtgcatacttcttttttggccaatataatatgagaaaattagatcaacaacgtacttcttttttagagaaatttgacagtatgtttgcaacaacagcatgtacgcaacacaataatgaaccaaataaattttagagagcatccaaattcacatccatagataaccataaccatccagatcacattaaagttttctaaaccaaatttgcatatgtagtcctagatagagaattttctctatttaattccatcctacctacatattccactacatattccaagctcatcaaaccagggctgagattatcatggacctcagattatccccattatcctccacagcacagtcctgtacagcttctctgaaatcttacaaataactgtagaaatatattggtaatatgcatatataatccaaaatatccaacaatgacctacaatttacctgaatcagtcactgttcatcaaagcagccgaactgaacatcaatacacataatgtgaatgtcattactagtattcatgctgaaacatcagcaaaacattgcaaagcaggtttgtggaacaatcagaggggcaagttaccaagttacaggctgtgttccaaatctctcacgcgctcgcagaacaaagcaagtcattaacatatgattaattaagtattagcttaaaaatgaattaatatgatttgtttgaaacactttcctataagatgttttttacaaaaaatgcaacatttaacagttcgaaaaacgtgtgaaaaacaatggagtagatggcatgagatatgctactaggctgctaggcaacatcgtgtagatggcatgagatacaggcaacaatgtggggacatgaatatcaaacttcgttcaaaagggaccaatcgggctgaatatgacagttgtttaaattaatattagcatagttcagccagccaaaattagggttaaacgccccgacaaaagatcgtgtcaaagaacattcaagttactaacattcacaaaattatcatctctaggtaacttcagtcttgctgtacatcttcaagcc

SEQ ID NO: 102348 - DNA, 1753 bp, Oryza sativa
aattagttacatatataagcagcatctgtatttcttatatttatttttctaaagcgggacgacaatgctgatgatcagagaacgtgagcagcgtcatcgcactacagattagttatgccaattaataagaaataaagtaaatcaattagaaggcaggagatgttcttaatcttatctattcgttgccggcacacatagtttcaacgcatcactttttttacatgacctcatttctacattgtttatttatgttaagtccagtgacgaagttaggattttttttttctcaacagggctcaagtcttaggggctgtttgttcccagccacactttaccattacttgccaacaaaagttgccacaccttgcctaaggtgaggtgatcaaattgttagccacaacttactaagcctaagggaatcttgccacacttttttgagccattgacacgtgggacccaatttgttgaaggggaatcttgccacaactgtggctacaatcaaacacctgtcaaatttgcataaccttaggcgtggcaaactgtggcaaagtgtggcttgcaaccaaacacacccttacctacagtcttgccacatactccctttctagaataataagttcatttttttccttccgtttatctcaaaagaggttcattttgagcaattgtatcagaatttgtaaaagtatgagataaatatattgagaatagtaaataattacattgagacttgataaagtgaggatattctattttttattttgtattggtatgtataggatggataaaatgagcttattttagatcggagagactaatatttgtggcaagattctcatctcactttcgacgagggtcagtcgcaaatatttcacaaacgtagacattcttaaagcaaacatgtgacattgtttggttgtgaaaaatctgtatatcacaatattgaatgtgttgaaggcacgcaaagattgtgctaaaaatgtttgttaattttgattctgcaatttctacacctaaagcttgatgctcgatatgggcctttcatgagtgcaagactccaaagtaattacttgggccaaacaacaaagcccagtcgagtcacttttctattgggcctatttgggccaattggtatgattgatgagtcaattactagtttactacccatcccccatcattttggacattcatggggttgattggatggaatccataatgagatggtgcttattttttattcctcccgtttgtccaaagataagtttatttttgagtaacattatattggagtttgcaaaaatagagaataactgcattagaaagtgataaagaaagagataattgcattggaatttgagaaagtgaggatatctggtccttttcattttgtattggtgtatatgagatatataaaaatgaaattattttggaatggagggtgtatattcagatacatcagtattcaggaaatagagagcaagcacatacagatcatgtgacagcagacacgagcgtgtgaccggctgaccgctgctgtgcactactactctctgatttctgcttctccatgcaacagaacagaagaagtgaagaacaatatatgcaatgcaatcccaagctagctgcttcatgaacgtagtcacatgtggatatactactaggacggtaatgtattctggctttgtttccatatactgtatgtttcccattaggccccgttggattaatcttctcaagatgaagattaaaagcg

SEQ ID NO: 102349 - DNA, 784 bp, Oryza sativa
agtatatacaatgttttatccccagtgtatgcacatattactccgtctgacgcttgcctgaaatctgcaatgcagtcttacgttcctactgctatcagtatgttctgcatatctatgatgatttgtcacttcatttcaggatatcagtgttgctaatcagggtctgattatcaaaaccagtgcaaaatcgtatcccttttcgaattgtgtcccttaactataaaactggatgtattgtatcttatgactaaaaaccggtgcaaattgactatttcggtggtttgggaagacaaaacaggttgaccgtggtcagacttgctgatcagcataggctaccgtagaactcacatgtcaacgcccactcttcttctaccctctctttcttctcttttactcccaaccaagccaagcagtatgggaggtggccacggtgagcccctcggagcacgttcgcctatccaccatcgttcttgtagctcggagaggcctctccgtctcaacaccgtcatcccttgatccagttttcatagttgagcgagtctctgtacctgattttgcaattgagggatacgattcgacgagtacaatagttgagggagctaaattagactaattctcaattaatatagctcagtgatgtcaaaatatgcaaaagtccaaccatcgagtcactcctctattggcccgtcttccattttttattttagcacaacaaatttgatcttttttccttttatgcatttatataattggaaatttggaattacatttttaattttttttg

SEQ ID NO: 102350 - DNA, 570 bp, Oryza sativa
ttatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactaactcaatactttcattctaacattttctatatt

SEQ ID NO: 102351 - DNA, 554 bp, Oryza sativa
catcatagcaacgatctggcctatcatgaacgcctggtaacccagctgctttcttaacaaaatgtgactgggtttaaatctacctaataaaaaaacacttatgtgtttacatataactaagacaaagtgatttctgttagaatatgatagccattttcatttagtgcatatctttgatctatttaaatatttttttctttaaacattatatattaatctagggctcttataatgaatatagcaagatatgatttcttttagtattctttttatgaacaataaataaattgcccacacatctgcataggcttcctctgtagttgctaaaaaaacctccaaagtgtttgggccacgtcttttccccctaaaacgtaccccttctagccttccgtctcataaaaaactcaatcctaactacgaaccttgacacgcatttattcagattcgtagttaggatttattttttagacaaagttgtatatgctaatgtcataactaaaaattatttttcaagttaattttgatgggtaccgagctcgaattcgccctatagt

SEQ ID NO: 102352 - DNA, 641 bp, Oryza sativa
tgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctgtctttgctttcttttttgtcattggatttttgaggtgcctttagcgtgcagccttcgctcttgactattgcaccccggtaccacgtaccattgatgttcagttgggagaagttcatgatttggtggtagttgacgaatgctactacaattctcgagtgtaattatatatttggatcgtactttctattattgcacccttttgatgcaattctttttttttccaagttccaacctaatggtacttggtgattttgatatatattcattctagtgcatgagtatctaggcccctaggcctggacacaattctgctggttcttctgtactgcttgctgaatgtgcctgctctcaaaaatttctggatcctttccattagaggggttttttaactgcatactcgagtaatacattg

SEQ ID NO: 102353 - DNA, 1080 bp, Oryza sativa
acctttatacgagtactcactctgtctccgaatataagggatttctttttttttcgagaaacttgctaagaatgaagatagaatactataatgcctctcgctgtgtggtgagtgaaaagttggatggggtaaggctggaagaaaattagaaaatagataaatgattgggccaatagtactccaagtcccttatacttggagacaaatttaagggcccatttgaatcgtaggaataaaaaaaaaggaatagaaaaaaaaaacaagattttgataggaatgtaaatataaaatagaggactgcaaaacataagaataaccgtttaattggatcgcaggaatcggttgagagaaatagactcgaagaaaaattttcaagaggttgaaactctttctaaatttcctccataatctttataagattgtccattctataggattttcaaaggataggatgggatgggattcgatcctctgttttaaaggcatcaataggttttttttctataagattgaaatccttcaaagttactatgtttttctccaaatcaaatggtccctaatgtttatatcccttatatttgaggatgcagagactagtattccatttctaagtacttgtcacaaagttactgctagtataacaactcgggttactcctatttactaatactactcctagttgagaaactgcccgaaataaaaaagacggatcatgcatgatactcctatcttaaaaaaaaaatactccctccgtcctataatactataagagcaggtacaatagcaggctataagccagctgcaaacatattttaaggagataaatcaggagagagaagagcagcgggctacagatttgtagccagctgtagcacggactccaagacgctgtgtgtctatgacaggtgggactaggtattaatagtgtagtatgtaactattgtatgaatgagctattaaattggctatagatgaattggagctagtatttggctatactattgaacttgctctaagggattttggaggtatatgaccgtctaaattcattgtcctaagatatatcacgtccgtccaaaa

SEQ ID NO: 102354 - DNA, 1356 bp, Oryza sativa
ctcggtcaaaccgccttttcttctctcccctatcctccgctccgagggagaaaaaaaacaaagaaagaaagaaagaaagaaaaagagtactagtagcacccggagagtggaggaaagggagtaggcggagccaaatctcgtttctctttagttgttgttagtacccttagtggaagaatctctccccttttcttgtgtttcttgggttttgaagttttttgttgttgggaggtatgaggaatgaaggcctaacctgaggcaagatcttcgttttccttcatttgtgggggtgtttgttggtggaaacggatcaagaaaagccggaatttcggttctgaaatcgtcggttttgatatcggtttctctctgttgattggagagagagggagagagcaaacgcatgatctgtgtctgattctgacgggccttgtcgcggtccgtatcagttcatccatcccaacttgctgttcgttttgtgtggtggtgtttcgcttttttgggaagagaggagaggaagcaatcattcggcggcgacggccccgcccacttgaggtaccagttggaaatttccccccttttctttgtgcttttgtttttgctggtttgtgcttatctcttactacttgaggtacatctttttgaccaggtttttttttgtggtaacggcgatttttggggataaagtttgcatcttaggtcgggattttttcttgtttcagtggtggaatgtctccattttgagcgaaattgcgtcttttgtgggttcatgtttggggatttgggggaaatcgtgcggcctggtttgctgtggtggggaatttttttcttgtttcagttgattggtttctccatttcatatcaaaccgtgtcttttgagtttctcgtgcatatatggagaggatatccatggttatctagaaaaaaaatgcaaagttttcaacttgctctgtaatggactcttccaacgttttgcattcatttcttgagctcctcaccttggttttcttcattattgtgttcaaacctactctgatcttggttctgaacttctgatgtttgtctggttactggtcatgtaggattgatggctttgtggtctggtctcttgctaacttcttgtgcttctgtgattctgataagcttttcttcgtgttttgtgtagagataacagtttttttctcttatcaattatgctatgagatattccatgtttaatcaggactaactaatgctgtattacctgatactcgtttcagttaaacttgattgctctgtcgcatggccagcagtagcgaccatggatccctcatggaggactggatgccaccacccacacccagcccgagaacactcatg

SEQ ID NO: 102355 - DNA, 631 bp, Oryza sativa
attggggttatgatatgaaaaattccgtacggaatggaggtatataaaataaacttttaggattttgtcaatcatattctctcgtgcaaaaggacgatctgaaaattgaaaaaaaaagaatgaccttatagaaaaaaatcccaaggattgaaatcgtccaaattaaatttctgaaattcaaaggagacctaaaattgtatacatggctctaaaagcatgtcctaaatataaaatttggtagtactatttaagaatttgcatgcttcatttggaaggaaattaggttttctttagggttcctttggagcgtatgaattcaaaaatacagaaacaggaaaaatgtaggaagacgtggcatactagctagttgatccataggagttttagaatgcagaaattgtgtgtaacttgttgttggatgctccatagaaaaagtataggattttgggagagagatagacctgagaaaagttctcatgagatccaaccctcatgttaagggccacattgagggctccttcggattgtaggaattttgtaggaaatatggatgatttcaatttgtattgtatttggcactattcgcttgtttggaatgaaagatttgggcataggaaaggtagagggaaat

SEQ ID NO: 102356 - DNA, 526 bp, Oryza sativa
ccagggttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtatgcaagtaaaatccgatcatccag

SEQ ID NO: 102357 - DNA, 649 bp, Oryza sativa
aatttgaaccatagatctatcatccaatggctaaaaataattggagtgacgtgacttaatgatagaagagagaaataacattaattacacttagtggggatgaactatataagcatataggattccacataaaacaatggtttttattgattaactatgcaggatattctagtaactggtaaatcgccagaatagcagtatgcatgcgtatgagtgacgctttcacgtttcaactttcaagcatttcactaccccacaatttaaaaggcatgcatctaacaataatacaccaagatgagtaaacaccaatgatgttgggacagtgaagaaacctataccttttgacctttcactcttagtttgtactaagagtttgtactaaggcttattcactttgctatcatttttaactttaccaagttttagcattgctaaatttagataaggttatcaaaattttggcaaggttgccaatttggaaaatttatatgtacttactaaaatttgacacaactaaatgtgccactttttgggtattttgaaaaaacaaaaggtaaggtgaaaatggtagcaaaatgaacaagccctacaattaagtggatgcgcgcaacaaacaatataaggatttagtatgagtgttaaacatata

SEQ ID NO: 102358 - DNA, 592 bp, Oryza sativa
gatttatgttacttgagattcaacttgtagctacactcaattatagagtacttatatttgattattaaacatttaaacttagttatagagcacatacactcagttacaatacactaaaattaggttttacaattgtgtttgtctctagacttatgatttttgacatggttgtccttctgtttttgttattaaaatggtttgtattcattggttgaaaattatgtaatatttcaagcttcaaatctatcgaaaaatcaattggtagtcactttttttattacagtacatctacatagtttatacgtaactacgatgtaacatgtatataactttaaaattatgtgatacattgtgaagatgtcggattaaactccctcgcgtatgcatacgctatgatttgcttctttttttcgcttatacaaatctcaaagcaaaatctaacggtttaaaattatatataaaactacccccgtttcatattacaagttgttttgacttttttttaagtcaaatattttttatgttcacaattttatagaaaaatgtagcattatttttcgagaaattcctcgaagtgagaccagagtgagaa

SEQ ID NO: 102359 - DNA, 644 bp, Oryza sativa
gccgcgaacatggctgctttgaactccatcttctcttctcctctgatcctgatccctgagatcatttaagcaatgtacattgtacagtgatcaatgcaagatgaattttcttgatcataaaaaccaaaatgtttgtttgttttttggctgagatctatctgtatttgaactgaactgcttagtgacatcacgatcattagatctagtttaggtggtcacattatagtagtagtctgatagtgtcacctaccaaaatcaggacacatgataaactggttgcttcaacaacaaaaaagatacttatgtcttttagatctcagcacagcacaaagacaaaaagagaaggaccaactaccaaagctgaacattcaagagtctacaccaagcatacacaacaatcttcgcttcgacttaaagaaaaagagataccctcatgtgcaaaaaaaaatcttaatttctcaagatcattcaagaattacatatgaaaaagatcaaaatataccataagcataaaagtacattcaacaataagtagccccaagctattaaccacaatgactcaatgagatgaaactatgaaatttgcaaaagggtacaacaacttcaaattgctttgaaatgcacgggaaaattcaaattctgca

SEQ ID NO: 102360 - DNA, 634 bp, Oryza sativa
agaaatttctatgtactcgttggttcacatcctccttcgttcatagcatcaccgtgcgtcccacccggacacatgcacgaaaacgatcctggcttgtttgtgcattcaccgtagcagggatattcttctggcagagcgcactcgtcgatatctgaaagggagaatttagaaaaattttgtaccattctgttctaaattccactaatcatttgaactatggttggtaagccatagaaaaatatactaaacgaacaaaaataatttataaataaaactattaatagcggtttaaaattttaacggcaaaagattgactataataagaaaactaaaatcaactttaaaattaggttttaaattttagccgcggctcataatctagcaagcaaacgatgagaggctatacttatgcaacttcaagtgtaaatgactaatccgttaaacacacttataagctaaatattaggaaatgatttaatatcaactaaatagaagggtgaggcatcgaacccagaacagctagcccaccaccttgtgaagctaatcagaagaccctcagttgtttcttcacttacatgggtacacccttatacctccttccatccctaattgttgacgccggtgactttttgaa

SEQ ID NO: 102361 - DNA, 627 bp, Oryza sativa
ttgagttttgttttttaatgggtttgatttgattcattgattgtgatgccctttaatcattgtagtcttataatgtcgtcgtactcacccgtgtttcatattagacgtcgtttcaaccatttctactaattattttttaaagtttcatcaagtttaaaaatatatagcaatattttaaacacaaaacaatgatattattaaaaatatattcaatattacatttaattaaactaacttagtgttatagatgttgctaaattttttctataaacttgattaaatctaaaaaaaattgactggataaaaatagataaaatgacttataatatgaaacagagatagtacggtgtactttactcctttagatgttttacagtcatacttccatgcggatattttccttgtaaaattcatgttgagcatccaaacaactcatttgacaaattacaatgttttaaattttcatataatagcatatgccatgacatttaattaatatgttttcttctttttttgggactttctactcatgtgttcgaaaggagcaccaaatcaaacagtccgcaccgcacgttaatactgctagtctcgcgagggatttggaagtaaatgaatcaagaacctttt

SEQ ID NO: 102362 - DNA, 620 bp, Oryza sativa
acgtatggtgggttaggtgtccgcctccaggtgcccacctacccgcatttatggcatcccgagcggtcgcgccacgccgcatgtaatacggtgtgcagtgcactcaaccggtctgtgaccgatcgaatgaatgatgggacccaagatgtcaggcgcaccatcgcgtgtgtcaggcgacgtgtagcccgacatatcccatcaaataatgatggtgagaggttctcatcctcttatcccagccggagtcggtcctcccgctttggtcaaagcaaggctcctgtttcccggtgtaataggagcccagaagtcttcacccattaaatggtgactgacaggggcaccccccgtgtcaggcggcaagatttgacaggacccatcatcaagacgacgtgtgcttggcttcccaagtcaagagacaagacatgcatttaatgcaaatattataatacttatccaccggagctaggttaggttgttgggcccatatggtaaccccttgatgtataaaaggaggtccaggcctagtggtggaggggggacttccgagcgaactggcgtttgggtctcataaccccaagcactggtgttctacattcaatcaatcatgcacaggagtaggg

SEQ ID NO: 102363 - DNA, 543 bp, Oryza sativa
aaaagatgaggacatttgtttcgcggctatcttagaaattagaacgtgtagaatgccataaaaaagtcactatctcaccaaaccgacacctaaatagtaccggagaaacattgcaaccagcagcttagctaacagtatcatcagtcctcgtgcttctaatgatgatattaacaaaagaatatttacacaaaagcaattgctactttgttagcccttcatctgcgtggtgtgtactgtgaaaagggcacaccctcttgcgcattggaggagaaaaagggaaacaaaagaacaaggccaaagggaaggaaattaagcaagcaaagcgcacgaggcacgctcatgaactcacaccacctaggtcaacccaacaacacggctcgaccaaattccagcgaggaagcgatgcccaaacacctgtaacaccatgtgatcccgtgcgtgatgcacgggcataccagactgctactacttcgttccaaaatattgtacctagaatgtgatttgaccgatcctaaagataacgaatgggtaccgagctagaat

SEQ ID NO: 102364 - DNA, 653 bp, Oryza sativa
caagttgctaaattcatctaaattcatgatctacatgtttctttactttatatgtactgtttatgcttgttttttgtactgtttatttggtttttattagtctttttcttcgttttgcgtgttagcttgttgtttccatcgttgcgaaggttcgtgagtgcgtcgggagtgttcagaagattaattgaagaccgattattgcaaggaaagtcacatagatcctaaacacaatcctttgagcatgttgatcctatatttaaattctctctttatttcaactgtgcatttattttcgaatgtcactaggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaataatagttcacgatagtcaatcgtgattggttaattaattacttgccaactaaaacttgataatggtgggttgtgagcatatggttttgagactcgtgctcatgacaattaaggaccggataaaaaactactattgtgaaacatta

SEQ ID NO: 102365 - DNA, 585 bp, Oryza sativa
  unsure (1)..(585): unsure at all n locations
atatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcaacagtacaagtacgccttctccggcttcgccgcgcggctgtcaacggcggaggccgccgcgctccgacggaagcccggcgtcgtctccgtcttcgccgaccctgtctaccacctccacaccaccaggtcatgggacttccttcagcagcagacgacggccgncgtcgacgt

SEQ ID NO: 102366 - DNA, 674 bp, Oryza sativa
atatcgactaaagtgtgtatgtatattagaagtataggaaatgattttttttcatattttttccacttggcctagaattagtatgtatgagaatagtgaatgcttctgattcgtgtcaccctaccctttgaattaaactgacccatgcctagactttgattattacaagtaacatataaatattagctcggttctctctattataattttctctcgggattaaacacatacgatacccttggaatacttttaggtgaaatgatataattgtatatccgcacgcttgcagatgaaattgtaaccataatataccacgagtgtttctgcgccattgctggtaattatatttctagtaatgtcgttaagaaataccaacataggtaaagataaagacaaataaaaccctgtcacctgtcaacttatagaaggaaacccaaataacaatagatatataaacttaacgaacaagagaagataaaataaaagacgagagtcgtataataagataggagaaggcacctacgccgatggataaacaagcaaacacaacaacacccccaaccacttgtggagagagaaagagagggttgaagaccatcaaatcgaacaaccattggcggaatggcctcattcgaatgttcaccctgcttttggttgatgaggacgagtttgca

SEQ ID NO: 102367 - DNA, 661 bp, Oryza sativa
atacagatggcccgatcgaagaagagtcgtcggaatctagtagtgctaagttacatatgagatatgatggcctaacattaacactatcagcagcatctgcacgacaccaacatggctgcagcagcctaccgaccatgtacgcctggctttgctcacaaaacgcattcccagctgcagcaacacaggcataggtagcatggagatggccaaactagcaccggtctctgttgttgctgctgcagctggctcctttcctcttcctcttatgcttggatctcctcctccatggatctcatccggcggcgccccaacgtccacctaagctgctgctctctgttgtctgcacactcagacgctgctgcctgcctgcctcccaagtcaaggtgatctcagcaacaacaaaacacgacgatgaaaagcaaccggagcagacgaggaagaagaaacaccagtggcacaaggaaacaacaacaagatacaccatgaggaggctggtggccgcgcgcggccaagtgcggcttctcgctgggcctcgccgtcctactcggcctgctcttcagcagcgaccacggcttctggtcggggctcatcgtggccaccaccatggtcgccatgaccgccatgggtggaggtggggagggagacgagtggattcgccatg

SEQ ID NO: 102368 - DNA, 526 bp, Oryza sativa
ggcagtagtcgaatatgatcacgtcggatttctcgccggtgcacgccttggacgcgtcccgcaccaactagtcgagccagaaccgacagctggtgccattgccgccgcagacgatgccaccacgtctctgcgcaaggccgtacgcagtgtccggcaccgcgccggtcgcgttctcggcgaaccccgatgtcaatgccgccacggctgcggaaagggagtagaggagagcgcaaaggttggccccaaagccacggtcgtcgacatgcctggagtcggcgctgcttgtagttgaacagcaggtcatcccggcgttctccgtgatgccggtcagcagaagaagtagtcagaagctcataagggcgcgctcgggcttactcgcgcccggcacgcagtagaaggcgtcggcggcgccattgatgcggtgttgccacgcctccgcagggcgtcgcgtcgcgacgcgttgctttgtttccgttcagctcttttgaggagaaagctacaactcgttaatatcaatgcgtgtagc

SEQ ID NO: 102369 - DNA, 884 bp, Oryza sativa
tcagttgtttggcagattttcaatccatgccatgccaggttcttcttacttgaggggtaaacaatttttgtcagttatactctcatggaataaaagggtaacaacgagtaggaactgatctggtgccttttatgttctaatgatactccttgtgtaagtttttcttttttagttaatgactcctcgtgtaagtgttcactgtgtatagactacggagtactcgtgtatatatatatatagcactgcaagaatatgtgcttaatcatgtttttgaaaattgtaatgccagtatgtaaatgaagtatacttcagttctgatatctgttagtattcaatgtgttgcttcctgttagtttcactcactgttactgtaataattttactgtagaatcaactccgtttatcctgttgcttctatatttttttttcattgtagtcatgatacttgtataatagaacttgaagaagctaatatttagttgtaacgccacatgtaaatgaagtgtgtttggcttctgattcggaatcggcactactcagatgctgactctattactgataaactgttctgcctcagctagttgcagatgctgtttagtgcaatagttcaatgcagagatgattctggctaaactagtgttcgcatctgcaagacctttctttattcagcaattgctttacaactatggaaatataattaatcatgctgtttatcctgcagaagaatataaaggatgccacccaacggtgctgaaatgctgaggacttaggactgagtgtaagccttctaatgatgtgagaatatttgccacggttgtggtttgtacatctgtacaaagtgttcgctattcatttattcaatacttatttcgaagtcaacttta

SEQ ID NO: 102370 - DNA, 653 bp, Oryza sativa
aagttacagcgttgatacattgagaacatgacagaggatgagacattggcacacaaagggcaccaataagttacacacactcatatgattgatgcattccaatatgctccttagacagcatcagatttgattaattaactttgattagactcatgaacaacacatagcattttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcatgcatctggtcagtcagccgcgtgcagaaatgggcgaagaaactgtacaaagtgcatggctagctaacatttactgtcacttcatcgatcgcactgagtacgaaagacgagtagacgacgaccatcattagtcacgtccacgctaattaccctctcgagtcaaacacaggtgcag

SEQ ID NO: 102371 - DNA, 650 bp, Oryza sativa
aaaaatattctcaatatgttagatgagtgaatccgttcaatttggccagatgaagccatttatgttttttttttgggatgagctatatatgtgtcgcatgttttttttggttgaaaatagtcggatctctggccgttgatggtttgatgtacggtggataaacgcttgagggatgcagctttcctttttatcgttattaatcctttgctttttttattagcatcggatttttcatgtatggatgatgacacgttggttacatcatagttacatactatttacactataattacatatgtaattttaaaacgtacatatgtaattttcgaatttacatatataattttacgacttatgttacacatacactaaaattatatatgtaatttaggtacttacaatgtaaatacatgctgattattttttgataaaaaatatgatgccataaatatagctactctttttttttttggtgacgtgccccattcacttggtcatgattggttcaattttctgttagcaagctacatgaacatgaaccaaaaacacccttggtgattaaggtaaagccatcaccgacacaaaaaatagatactgtacatgtttgatgcgtttaactaaacgtctgacactgatgtgtaatccatcat

SEQ ID NO: 102372 - DNA, 1843 bp, Oryza sativa
tgctttattgggccgatgagatgtcacgtgatcctcacctgcttgggcccacgaggaggactcatttgctcttctttttattaccacgactgtccaaatgcttaatgcttttgttttgttttgttttgggagggttgcctcaattctacgaaagcacaggttttgaactttgtttgtgtgtagggggagtagtatgtgtttttggtcttaatatatatgttggctgaaagagcatgatatacatgtgcttttgaaacaaaacgttgccatcatttccttgctaattcaggagaaaacagtaagcatatactctacgtttcatcgtagtaagtcgtttagactttatatagttatttttttttatttttgccaagttagtaaaaaaatatagcaatacttttaatacaaaataaacatattatcaaaatatattcaatattacatttaataaaactaatttggtattttaaatgttgcttaaattttatataaacttgatcaagtcaaagctacttattctatcttactacaaagttgatgaccaatcaggatttgaaatttcgtttcgaaatttttgaaattttggtaatttcgcccccaccgacaagctcatatcttgcccgaaatttttggttgttttacatttttttgtgaatttggtcaaattttatttaaattcattcaaaatcagtcaaaatttcaaatattttcggccaaaattttcgaaatttcggtaatttcggtgctcccggcagaaatagcaatttcaaaatttaaaaccatgttcccaataactcctaaagcttcacatgcaagtgtgtcacattattacccgcgagtaattattatctagagtgttttaaatcgcatgcacgtgtaacatatcattatccactagcaattattatctataatattttcaatatcatgcaaatataacatattatttacaattttgttgtatttttagaacttaatatgtaaacaatgtcaaattattatctccatattatttaacatatacatgtatcatttctatagggtataacatttattcatccacatatctcacagtaaaacgtgaggtatcaactagtataatataaaactgagaaaatacttaagaaatgcagctactagcggggtgggacgggaaggactcccgtgaaaaacatgttaagtcctaatggtgcaaccaaacagcccctaaagatgctaggatccatctgccatttaggaaaatcaaaagaccaatctcaggttgacttgcatagcatcttaaaactgcttcgtgtgtagtgatgagtaagtttgctagatcaagagcatcttaaactgatctggaaagaacgtgtttggttctatctctgtcctttttaattactagtttttatatcagtacatgtatatggttgtcttttactatactactaataacttaatgatttctttaaatgaagttgacgtcctgcagatgaagatacagtaggaaagatcagtcgatcagaaaattcaatagagcgttaagccgcttaacgcctttaaccactgataccattgcaggagcaagagcaacataaatttcataagaaatacagcacaaaatggaaagaataccgaattccaaacatgtcatcaagtgtgtttggttggatgaataaaattggatgggagatagtcgtctaattctttgattaaaaaaaagatagtcctctaattctttatcgtgtttggttggagggcatgggcccataaaaaaagaagagtaaagtttacgggcggttcttaaacttatagcggtatgtcatctaggtccctaaactttcaaaatgcaaatccatgt

SEQ ID NO: 102373 - DNA, 601 bp, Oryza sativa
tattcttcatctattataaagacattattctctcccaatacaaaacttgatagtgtataatgcataggttctcttgttgaagctgtgtcttgcatgagacccagtttcttcctctcttcactctctctcttaattaatataatgccatataagctaaaagttctacgtagcaatgtagttaatgccatagacactatcctaggtggaaggttgggactgcacttagagccttcgtttctcccaaatgcagcacccacaccgtccgttctgtgtagctgcgtgcgttttgacgtggccttcggggaaattcacgcttgacgtgacgcggtcgtctcggctgatcggctctctccgagcgaagagattttctaagcgggcgaacgtgcgaagaagatcgtttattgccagaatgcagatagactttgtgattgggtggagagccgtgtcgagtcgacactcgagtctcgagcgtcatatgcgagtgcttccaagcgagcacgacgtggaggtgaagttttacacgatgaccctgcttcttccgtggttcacaaatcacaaagttcacatcgtaattagcacggtgtgttagctaaatgagaaa

SEQ ID NO: 102374 - DNA, 540 bp, Oryza sativa
tgatgccaacgttgaagctggtgaaagtcagaaaccgatggtcgtagggagtggattctaaattctcgagggatcacccctcgttgtttgcatgtcattcattgggagtatgacttacgtatattcatcttacatgtttgtagagtgacttatcacatattaatatatcttgtaaaaaaataaccatttaaataatatgtataaaaggaaaggatgtcctctcgagttaaatattttcccacctctaaatgcaatgtgaacggcgatcctagttaagcacttttatcttgaattcttcatcaaagatgaggcgatgagagattcgaccgcgacgtgacgccgagaatcgtccggcaggccggcgaaggaagctgattgcgagctcgttccaagatctcgaatcgaagcactacaaaccaaggtagctcgctggttctcgcggacactaagcatcgatcggagatcagcagatgctggtcgggttcttgtttctttcacaccgtcgaaaaaagtacagaccacatcgatcgaccgccattg

SEQ ID NO: 102375 - DNA, 815 bp, Oryza sativa
aaatctacatgtttttttaaatcaatccatcggagatatacacatcgagaaccctagaaaaaagaaaaaaaggagaggaaaaaatcgcataaatgggcgagcttaatgtcaccgaatccgattgatccgagctcgttgccatagccgtccatcgcactcatgtcgtggctgcgcccgccgggcacggtcacactcgccgccttcccaaccacactggcaccccctccctctaaccccccatcctcaggtgctctcctcctgctcggaggcagaggagagaaagagagaaggatggcccgcaccgtagccccaccatcgaggccgacggggagaggggaagagaggacggtcgtcgtcgccgctgtacccccgtcgagcactcgccgacgcggtgccatgccggcgatacgggagggagagggggagatggagcggcgccgccggtaggggagggagaaggggagtggcgccatcacagcggagggggagaggcgccacctacgctgtcgttttgagagagaggggaggggaaatgatttaaggctagggtttaggttgcagaacttttatataagtacagatcaatcgggattgtcgatcagatcggacggctccaacttcttccgtgtcgagccaccattcccaggccaccacacaattgggccgcttcataggccacgtgtaagcgcacggaatatgttcagtttaggtcccttaaggctgagttattttcttttcacctctctcattttttacgtgcacgcctttcaaactattaaacggtacattttttgcgaaatatatagtatataggg

SEQ ID NO: 102376 - DNA, 1141 bp, Oryza sativa
cttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaactttacaagctttggatgagggatgttctccacgtccccatgaccaagctgaccatgtgtacctcttccccaagtaaatacttcaccatcacctgaaatgttgagtagctgttcaaagaactgatgcatattgctcacgtgaaggcatctgatgcagagactaaattcttgaggactgacggaaatgggacaaggttgccaatttagggcacatacaaaatttctgcgtgccattgcactaatataggcacaaaaagattcagatttacaagcccatctcaaaacacccaagaggaaagaaggcaaaaatgcttaggttgccaatgagagaattttcttcctggtaaatgatcaagcttcagcgagcaatatatcttgataatggaacaagaatgctttgaaaaaatggccaaggatagaacaaatctgtgaaacatatccaatcactaattactggaaagcggaatttgaactgaaaaggaaaacactcagccccttgttagaatacaagtatacaacagagagatgtctctccacttaatggcactaagttcaaatattcagaacaaaggaactagcgaaaaccgaaaagttttaaatttgtgaaatagaaaactgttctgattaatcatcaagcccaacacagcaacacttcagtggtgtttggatggaagtgattattctagacactagaactggtgcaaactgaagtctctgaacatctgttgctatggtgagcaaaactacatcgccgtgcacaaatccattgtcaatctaggtatctaactgagttcagttccggcaa

SEQ ID NO: 102377 - DNA, 3010 bp, Oryza sativa
tctttacaaggttggcagccctgaaaagtattcgtgtccttgtgctttcgtcattaacgtcttcttcccctaggggagatggtttgttctggtcaggtcaacttccaaacctaaagggaaggggcatagcatatcactagtgtactcgtataactgtagtattatccagcaatctgttggtttcaagcttctagtaagaaacagtaacagaaaggggttcaaataggatcatcgcccggaaaagtcgttggtaacaaaaatcgtcctaaagatcatcaccacacagccaaatgccaatacactacacactccataaaactcttttgagtttcatagcactgctgcatctgacgcaggaaatttcgctacatatgcttcactgcatcatgtaacatgctgtcatgttaccgggacaccggcgcacctaccctccatactccatgacccatgtttcctcgtctttgacagtgcgagcctgcgtgatgtgcgaagtgtaaacactagacttttgcctctgcacggggtgctcctagtaaattcccggtcgccgtggcgtgaaatccgtgaggattctgagacaccaagcaacgctgcaaacggcctccaccgaatccgaaactcccccaacaacctaggaatcagaaccggcaacgtcaggtcgcacttcctatgcgcacttgcagccggcgcccagcaaaggggacgatgagaagacgagattttctttcacggttcaagctttcacaattttacttgttcacttcttcgtgattttactttggtcgtatgggaagtgaggcaaccattggccggatacttgggtggaatttacgaaacattactgttttctcttttgttttctgacggaaggcagtagtagagagttggagaattattatagaacagtggtcgatactgcttaactatggagtttcatgatctcacaatctcaacttttcttgtaactactttgtttgagaggccggagtgccggacacatatcctctcaagtctcaactaggcttaagcaagctttcataaaaccgttcaggctaagctatcaaggtttgccatttgccaacttgctactatacaatgtaaaaaacgaaaaacaaaatctatttgatctctttaaaatattgggacgtctagtcaaccatctcagactttaagggtgggaaatattttcttgggccgtgtttagttcacaccaaaactcccccaaactctcaactttccatcaaaactttcctatttacataaactcctaactttttttttccaaactaccaactttccccaaacttctccttaatttcagaaactaaacacagccctgatgtcacgtataacaagttttgattcaaatgaaagttttctaattaaggccttgtttagttcgcggaaagaaaatttttaggtatcacatcggatgtttgaccggatgtcggaaggggttttcggatacgaatgaaaaaactaatttcataactcgcctggaaaccacaagacgaatcttttgagcctaattaatctatcattagcacatgtgggctactgtagcacttatggctaatcatggactaattaggctcaaaagattcgtctcgcaatttacatgcaaactgtgcaattagtttttcattttatctatatttaatgatctgtacatgtatccaaatattcgatgtgacgtttttgggaaaaaaattaggaactaaacaatgcctaaattcgcatgagtccgggatagtagattgtaaaaaaaaaacccaaggctcatgagttactcgagctcaatttaagctcgcctcgagttctagttgagtagagctcgagcctatgccaaagctcacgagctttgtcaagctgagctcgagctcatgtcgagttttaccgttcatttaataaagtagtacatcatgtatgccatatatctgtatccatgcggtgaagtatcttgcgttggcacaatatatttatcttattatttttcatcaatcattagcatgattaaatataaataaattatttatttcaagagattatccttgaaatatactatgttgcgctacttataagccgactttgtaggaaagctcaagcttgaaccgagcatgtctaaaaactcgaaggttactcgggctcggtttgagcttgagcctagataggtaagcttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgc

SEQ ID NO: 102378 - DNA, 896 bp, Oryza sativa
ctacccagatattgaaaaggagggagttccttcctcaattcaccatctccattctaacaaaattctcatgtctctcaaccaaacaaaacacttaataaccttattcctctaaacttccaatcccttctaaaaactacgctccaagccataacagctataatattatcatctctttcgtacacatccattctggtctccaggagaacgccgtacctggaggctggaggtgatcctggacgctaaccgattgcttcgtttgcctggtacctactgttctaggcttgctagtgcaaatcttggcactatgccactatggttcatgctctatctggatatcctcattcgttgatttgcctgttgccgataaaagagcggaggtcagggtttacctttttgtcttcgaagtgaaaaacgctcctcactagtttagcaaaaatcagtaaagaccaatgactttgggtcaacgccatacgaaaatagactactacagattaactcccacaaaccaataactagcggtttcacgaaaaccggccggtttacacgaaaaccgattggttttgtgaaccttggcggaggtgataatggctcgatgagcgcgtggaggaccgagcaggactttggtcatcctttcgggccttctccttggcggcgacgaacaaactcttgggaggcacttgcacgaacgcgcaggtgagatcgatcaatcagttttggttaaacaaagaagtgttttggtcatctcgtgagcataggagatacacaccggttagtttgatcatttgtacataatttaaaattatgttgttattttaatatagaaaaaagtacgaattaccccatgaactatcatggtacattgaattaccccctttaactatacaaaccggacaaat

SEQ ID NO: 102379 - DNA, 548 bp, Oryza sativa
ctaaggtatagaactttgagttgtatttgattattggtgtcctctaaactttcatatgttctagcggtctcagtgctaacttctggtagtcctattaatataaatttcacatacaatgcttaatatacataagcacagcttgatgttaatcaggactgaactggcaagtacagccactttaaaaatatctatctttgcttgctctaatgatagccttggttgataatatggaggtataattgtgattcaacagtttggcacccttcaactcccaacacaccgacgtgtacaggggtacttttaaatgatattcattgacggaacatagtttatttagtctccttccttttctccacctactgtgcttaactgcccctctgttaatacacaataattggtgccaaaatatttatctgcttgtcatgtagactgtagaggggtacttttaaatgatattcattgatggaacatagtttatttagtctccttccttttctccacctactgtgcttaactgcccctctgttaatacacaataattggtgcca

SEQ ID NO: 102380 - DNA, 630 bp, Oryza sativa
tttattatctgatatactgacatcaacaatggaacacgctataggtgctggggcactattacctttcacatgcgctgctcaccagtatgagagataagagtgatagcaaacaagataacccagccctttcatcaactctttcaattaccaatatagacaacattgaagaagctgatatcatcatctgcgttcatagcatccagtgaacattcatatcgaggaaaaggatagatacatattcattaatagcattggttatgcacgataacatgatagtcagattggctgcctagcacagtagtatggaaactcagacacatccttttttttctctttttgcctatggttaatacttcgatgatattaaggacattcaagtaggtgaactgcattttttgaacatgaactacttaatacagttttttctcccaatggactcgaagcataaaatgacaacatatcaaaaaaaattccaagtccagaaaccatggaaaacaccacgaaataagtaaacagtagatggggaaattacagaaagatgagatatttagataccggcaacctgtcccaaattaagcggtcatcatctggtttgaggtgatagtaagccgagccaaatgctgctgctac

SEQ ID NO: 102381 - DNA, 564 bp, Oryza sativa
cactgaataactaccatataactagggtgtatttattcagaattatcgtctccatgcgcagattgaaaaatcagcatgccaccattggagcgtgaataccttttgttcaatattttttgtccaattttttaaactctccatttagataaaagcctattatattaaaattctctacacacaaactttctacaaaagaaaagtttatattcataaactttccatagggaaataattttattaggagactttctgcagtagctaaagaagtgatggggtttaaaaaaaaataaaaaattgtaagatatgatggcttggatatgttcatttcatgagctaatcggcgtgttatgagctaaaatttatcccatatacatatttatagagtactattgtctgtcgtaataattctaagagacatgcatcaaagtaatatcagatttcatgaaaacacattaatctcagctaagattcttaaaaataattgtggctatggataggagaatatactattgtagtcgtgtacgaacctagctaggccctaactactaaggccttgtttagttc

SEQ ID NO: 102382 - DNA, 653 bp, Oryza sativa
tttttttaataatcgtattcaactctaaagcttgttatattctaggatggaggtagtaaattttaaagaaaattatgtgtaaaaaaatagttatataggcgctagccatgtaattgcgcgggccacactattagattttaatggacaatgctaacaactcggcttaggctgagttcgtttgtggggtggttcctaatctccacacgctcgtttcacatacacacgtttcccaaaccgttaaacagtgtgtttttttaaaaaataatagagaaattgcttttaaaaattatattaatctatttttaagtttttgaagctattatttaattaaccattcaccaatctaccacttcttttttttttgcatgggatttgttcccaagcacaccaaagaacacagccttaagatcaacagtaagtattagtacactacacatcccattctcaagtttatggcacggcaaaattacagtgctggagttctaatgaccaaatagctctggcaaaaaaaaaaaggggggggggcctaaaatgatataatcactctggcccagaaggcctaaaatgttcaagacagcaaagaggcctaggccgtcggcgttggactggttcacatacagccaaagcccatggttcaccaaattgacagttcc

SEQ ID NO: 102383 - DNA, 702 bp, Oryza sativa
atgtgtgcttgtttaggcagggcagggtcgccttggaataaggaatggatgctggctgggagttcctttcacaggctggggcattgttaggtttgctatgattagcagcagctggtatagctggggtgattggccggctctgaacgatcagcagttgttgtttctggtttgttaagggaaaactaacatgcgcaggttcaagtgccaactggatgatggccccgcgaaattcgcagatcaacttatttgctattgttaaacaatgaatgaaatgaaatcgcagaaataatatatctaacggccggccggttataatggttgttcgtttcgcagaaaatttgatttgttcgccgaacacgttccgtcttggcacgtggatgatccgcgtgcatgtttgatgtggtccaattctaccatgcatccgtgccggtcgatgcaaattggtgtgttccgaatagcatgttccgatctattagcgcgtgattaattaagtattagctaattttttaaaaaaatagatcaatatgattttttaagcaactttcgtatagaattttttttttgcaaaaaacatatcgtttaacagtttaaaaagtgtgcgcgcggaatacgatagagaggggttgagaacccaaggttccaaacacaaatcaagtttcgtttcagatttcagctcatggttggtcacgcgcgcggtcgaaa

SEQ ID NO: 102384 - DNA, 790 bp, Oryza sativa
cataacgcaaccctaagctactgacaaaatggatctttttttctttccaaacaagtgctgttatctggttaattattttattttgccaaatcccactttattagtcaacttgtcattccgatttttagctaaaattttccatccttgtagtccatgttttgttggccagttatattagtcgagttatggctaaggcagcattccttaggagaataaaggaaaaaatatctctcattgtccactcgtacgcttctcaaatgattaaacgggacgtttttcctaaaaaagaatttctatataaaagttgctttaaaaatcatatcaaactattttttaagctcaaataatcatatgttaatggtttatcttgttttacgcatcttctcaatcttttcatttcccctccttccaaacacacctaagtcaaataaccctatggatttttgtgcgcttatataccacttctacttttttttaccgaatgaactaaccaatgtctggatgaatttagtattattgttccactggataaaagaaaattcaattggaacaacttatgttccaaaaccacgaatgcattcccggcgcttatgtgaagcaaaaggaaataagaaacaccacatgtatctagaaatatatagtagtactagtaattactttgtcctaaaatataaaatttaatattaaatatgcatttgaacagctataaaatataatgtgtaatcgtagttttttatattttggaacaaaagtagtttatgttttggaacaaactgcaggggtgaaacgc

SEQ ID NO: 102385 - DNA, 715 bp, Oryza sativa
ttttcggaaaaggtcaaattatcaaaatttgtgataaaaatacatgtgtttatttgtcaaggcccactgtagaagaaggccagcatgagtggatgcctagaagatttttttttctttttcctttttgcatgacatggctgactaacgtcaagtgcctccataagctgatggaacattttgctgggtcttgcaagaaacatttgcttgctcatataaaaatttgcctatacatttcttggtcagtctcctaaataaatctagcctttctttttaaagtagcaataatattttataagactatatatataaaatgagatacagtatgcatctttcgaaagaccattcaatcttaaatttccttcctgagcgacgtaatccatgggcgccttcaccacactccagtgtgacgaagtatgaagtattttttattactattgtaattgaaaagaaaatatgcaaatatagtgacatataagtacaccgtaagtcatacatatttaatatctactatctctgtcccaaaatatatctatttgtagcatagtaacttgtccaaaataaagtaatttcttcacctactttctgtttaccaatcacaatcctcttttaatcatctctacttagtttcttaatatccgtgtctacttaaaaaatatttaaattctaggatggaggaagtagataaaattcaattaaagttttaaaactttgacat

SEQ ID NO: 102386 - DNA, 607 bp, Oryza sativa
cccccaccatttaccatcggcgccgccgtatggggtcgtgggctcactacgcgccgccactagagctcgccgtcatctagctggcaaccgtagaagcaccagcaccaggtcaaaacaagctcttcttgcccgtctccaagtcgaattgttcccaactccaacgccaagccgctaataccgtcgtgctagccatcttctctccatctactactttgatttgctagctgagccaaacaagttggctcgagctttcaaatgagacgagcctcatcagctcattatcctaacgatttagaccgaactgagccggggtgactcgctatccacccctacttgcagccacacgagaaaatattgttggccaaccggtcagccatgtggagatcaaaaccaagctaattactgctgctgctgcatgctgaatgcagtaagatgtactccgttgtctcctacgtaataatacatctacatactagagtatagtaatacgttgaaaaatataggaacatttatagtactaaactagtcttattaaatttagcattaaaatatattttaatagttgatttgttttatattgaaactatttttatatttttctataaac

SEQ ID NO: 102387 - DNA, 819 bp, Oryza sativa
ggatcccccatacatttatctatctctctgtcttcctgtctatctatttatatattctgtcttaaaatatagatattttgaacggataaaacacatcctactattttaaaatcacttatattttacgacagagagactactaaaaatttattaaactttctacaaacgctctcgagctgctacgcgacaccctataaatacatctaagtcaatacgtgatactctaataaagtatatcactatatctattttaccaaaccaaaacctcccaccatccccacctccttgcggcatgtgcacgcacgcaagtaccgactgttgtacgcaccctccgttcctttctccgtttttttatccatatcataattaaaattaaaattatctttataggaaaaaaatcccacaagtagacatcatacgtgttaaagtccattaaacattctataaatgtttctaaaccgttatatggcggtcttaagtcaaagaaatatccaatcattggtttctagacacataattttacgtcattattagatctatttttttaaagaaaaatctcaaccttcttcccttcctccccatccctgtgggcgttaaagtacataaatgctcttataagttgcttgtacttgtcttgcttaaataatttctcacaaacggatctagctatcaggtctagctagttgtccctgtgtctcttatgatctatttgaactattatattttctattgaaatcaataatttaatacaaatattgactatatttaaatgctaatagaaaaattatattctggacccatatatgtattgaggcgtcc

SEQ ID NO: 102388 - DNA, 626 bp, Oryza sativa
ctagacaccccacagtgcattgccttcccatctttagagccacgtactgctggatctaccaccttctatcttaacgagtcgaccttttaacccgacctaaccctgccgactattatatgcttcgttcatagcgctaccacattaaccagaccaccggctcccagtatataacttgttcatgcatttaattaactttatcgcgggaaactgtttaacagctcgagtgaacgtctacccatttattgcatgtcatttaaatggtatgaaaaaaattgaaaaaaagaagaacaagatagatcaatatgtaatatattaatacacaaacatgcaagttaaaatttaacttctacaaattgtaacaaaaataataaacaaaactcaaattactatatgtatatttacaattaaatttgttatttttgttacaacttgtagaagctgaatttgaacttacatgtttgtagagtgatatactacatattaatctatgttgtcaatttttttgaaaatttttcgtaattaagtagttgacatgcaataaacggatggacatccactcgagctattagaatccatctccactctatcgcgtcaaaagcaaagcacagggatggaaaactagaatg

SEQ ID NO: 102389 - DNA, 523 bp, Oryza sativa
ctgctgttcatgcctatcaacggcacccgcaacagcaagggccaaagcctgccggccatccacatcacccgccaggacggcgaccagcaccgctggagcagcagcacccgcgatgcgtttgatggcgtgaaagcctattggtccgacagcgtgaacggcaagcgcagcggcgtggtggccggcaagaaaaccggcaacgtcaaaaccttgaaggaaacctatgccagcgagcaggacgccctggccgccgcccgggccgagcgccaacgcctggagcgcggcctggccacgtttgagctgacgctggccatcggtcgcccggaggtcacaccccagtcacctgtgaccgtgagcggctggaaagaagagatcaacggccagggctggctggtcaaggaagtggtgcacagcctgaacgaaggcagcggctggaccagcaaagtgcagatggagatgggagttgatccagtaatactagctaacgaaaccacgaatagttaatcacaaattctgtgcatgatct

SEQ ID NO: 102390 - DNA, 581 bp, Oryza sativa
acatgttaccgagagattcttgaaagttacatacaagttacattatagttacagtgtaattacatacaagttacagtgtaattacactacgattgtactgtaattacatctgacaaatatcagggggagaaatttgatgacaaatatctagcaaaatcgttaattaaatacacacatcttaatccgattagctacaattcctagcaataaagtctttaagggataaattaattttggagtgaattgcactttgggccaccttttattgctgtagtttcactttagatcaccctagtcaattttttcactttgtactagctaaatttatgcttattgcactttggatcatctcaactctcttcattagccatgtctacctatactccggcaaatgtacgacctgctcatagacggagaattttgctagctgttataaccgatgtcttcaaggttattgatgtgataaagaagtgattttaggtggtctaaaataaaacaaatgtaaacttagttagtctaaaataaaaagattagaccaaacgtaatccaaaataaaactacgacaataaaatgcggaaact

SEQ ID NO: 102391 - DNA, 504 bp, Oryza sativa
aagtgaaacatatggtgctgctttttccattgggccagttcggtttttttctattgtcatggcacatcacatgccttgtcgtactagttaggaacatcccatctgcaaactcatatatttttataaatcaaatttcaagtattttccataattcatctaacaagtggtcaagtggagctgaaccaaggattcatatcttaccctgagtacttccgtggccttcttcatgccatagccgttgcatagttgatactctccttgaagtttctccccccggtttatggcaaatactgaaggatcatcatcaccccagcttgtaccctcaccatggtctgccgtcactgaaaccgtggtcttcgcctaacatttccgaaagaaatttcgaccttttatttagtgacaaaaccctatctttcacaaaaataaatactccatatgtttcaaaatatagctaacttatacttcatccgtttcatattataagactttctagcattctccaca

SEQ ID NO: 102392 - DNA, 842 bp, Oryza sativa
  unsure (1)..(842): unsure at all n locations
cgacgtacnngttaganctaccctccttnacatccnaccagaagcannacaantttggcagtgcatgacgttttttgccctttgcagcgcgactcggtgcgtccctcgcccgccatcgacatttcgtctaacaagtggcgggcatgtaaaactgcctgtgtggggaagaaagaataagttcaccgggggttcctcaacttaacagcgagattttttgagtcccttaaccacaaaaccagaaatttacacccctaaactatacaaaacccttcactcaaggtccctaggcagtatatataagtggtttcgctgacactttcatcctaatcaacaaaaattttttaaaaagtatgtaggacccaaccatttacctggccatttttttcttcccctctattctctattctctcttccctctccctttcttcaataaagaagccctgcggcggacataccagacaatggcagcattgctttctcccgcggtgcccaaccaactttcttcccgaaaggacacgctctatcccttcgtcgttgaaaatgcgctggccaccctctgaaccttccacgcaatatttgtggccgttcaaatctttattcggaccttctgaaggcccctttgaaaactaaaatacttacctgcgatcaaaaaccagaatacccgtggcttcattttgctcgaacagaccatcaggataagcgagataatttttcctccccatgctacgagtcatcttgcccataatacaacataatctttatccttttcccactcttcataatatctggcaatacacgaaaatttttttttcccgatattttcctttttcagtgggtacccc

SEQ ID NO: 102393 - DNA, 627 bp, Oryza sativa
gcgtcatctattaaaaaacggagggagatctatttctctcatggaatacctaggactggagaaaatgtgagtggactcaaaacctaaatcagaaaccagacgggtccttgtagaaaaattaagatggttttcatcaatttcgtccaaagtacttcctggaaacgtttattcatagcgcagccattattatttgactataccagttctcgccgtacctaattattcagagacagctgtctatataattttgtcaaagaataagaatggattgaatgcatcaactgaaaaccaaacttggaagccagctagtatgtatctagatgcatggatcgttttcaagagattaagagcttttcccatcaacagtcatttcccattggactatggaagccaatataaatatcactttctgggaattgaacagctgaaaagttggtatactaaagattaattcaagttggtcaattagtcttttttttatgttcaatcttactggtttgtggttaaccaagtcaaacatattttacttcgatcataaggatatttacattaatatttcctctatatttaaatatacaatactattaactttacacgttaattatgtttgattcttgtgatttattt

SEQ ID NO: 102394 - DNA, 811 bp, Oryza sativa
  unsure (1)..(811): unsure at all n locations
agtaataaaacgccgcgggacatctcatgatgatagttggacagaggcaaggtagttgaagtacccgcacacgncagatattgatgagaaagggatggggcggtggttacaagaaaagcgggcccggttagagagggaaggaaaggtcctctcatacttaaagataatcataggagggtgttagtttatagaagagtcctttgccctttcnctancccncaagggnntngnntggtnnnngnngggcgcgacgtcatcgctgccagcagctgaggccacccccgccaccaccttggctgtgcccacatgacaatacaatcgcaacagggctaaacaaaactacctcggcaatcatacccgtagggtaagacgtcagtgcatcatttgtagggctaacaaaggtatgttattcccataacctacaaaatatatgtgcgactaataggtaggtccaccggtggcgttcgccaaccgaggccaaacaatttaatgtgtaacctatgcaaacaacataattttccacctattggaggcaatattgtcaaaggtggcttgccttggtcctgcggtggttcttcctcatcgagaacaacttccggaccgttctaaggtttggcaactatacgcgtaaaaggagaaaatcaacacaaaagctaataaagtagctaaaacagtgagagatagaacttccattagatagatatcatttttataaaaaatatgaaagttgaacggagtcaaatggagctacggtttgcaagatatgaatttttaagattgcataggtacaaagtgcaatntcaaacacacc

SEQ ID NO: 102395 - DNA, 671 bp, Oryza sativa
ttgttcaagaaaacaattgatttgacataaacatccaaatctctaacaatacccggttaactaatctttaacagttttgaaggcatgaacccactacaccatgacttagtatgatgaggacatccgcaccatgcatggatataatcacgccaacggcaagcacacaagctgaaccagtgattaaggatcaatcgctcgagctcgtgtccgtcaacttaattaccatgtagggttgcataagaatgatttactgaattgggtagtactactaaatgctagtggtgatgttattgtgattaggaatgacggtagagatgaacaaaagctcaacgaggatgcaagatagaatatttcggttcagtttgctgcaccaccccaaattcaaacgagcatacccgttgatctaaaaatccatgtggggatttgatagaaagatctcggaattctctttccgacggatccaaccaatctgaatcgtaagagtggtttgttcctagaaaccaaaaccaatggtgttgcatcacctccacttgggcagatgggtctggtttgtcgtagggcgacgtgccatgtcatacacactgtcctagatcacttcatgtataaatactaagccacccccttaagttcatttggtgttttgttagatcataatttaggcattgttactt

SEQ ID NO: 102396 - DNA, 770 bp, Oryza sativa
gattagtttagagaataattgcgctaaccttgtggaggtaaaatgacatttctcctacttccacgacgacatcactctccagctccgtcatgcatctcctggcgattgacaagattaagattaagcatgtatttggaattgacgtgtatagattagcaatgagggataatctgaatcgacctagtatgtgcatgggagtttaggacgtgaatgtgttatatcaaacagaatgtaagcgtttggaattgacgtgtatagattagcaatgagggataatctgaatcgacctatgtgcgtgcatgggagtttgggacgtgaatgtgttatatcaaacagatgaacatactgtgccatgaaagatttccagccgatttgccagtgaacaacatggatcagaggttgggaatgacatagttcatgcgtgaaactcaatctgttgttacgttacggtgcagaaattaatttgattgtgttttacattgtttgagaacctacgcatctccatacaatctgtcacagaagtacccatggttttaaagcactagttgacatactgattactgatatggttagtaaatgaacatcaactatcagatctcttaaactcaacatatgatagagatcctttaagagaattctgaactagaaaaaaaaataaattcaacatacagaaaattaacacaacagaaagaaacgaggaattcaggataaccatgtgaggccttccagaacaaagattccggcttggagcccaacttcatagtcgccat

SEQ ID NO: 102397 - DNA, 716 bp, Oryza sativa
aaaccacgggtttttttatgaagaaccccagataatcttgacttgctcgatgaattcccgtgggcctacagacagcatgaatggggtttggcttcaaccaaccgcatccatgtgctgtgccatccttcaggtctcgtaccaccgaacatccgaacagcagtcagatgttgataccggaaccaacaaccatcagtccaacacagacgttgctcccgtgagctcgcatgcggcgcgaaatctttacacgggagacaagcgcgcaacgcagatcagcataacgacgacggggacgagagcaagcgggtgcagccgcaggcccgcagcgcagctctgctccgagtcgacaggacggtgcgcgctacgggcgaaccaaaaccaaggcgcgatcccgagaactgtcgacccgcgcggcctcgtgcagcgccatgatgcgccgcatgtcaccttgatgagaattttaagcggagcattggcggtttgtttaacaccagcgcacacatcccgggcgctagatctgtttgcctaggttgacgggctcctttggcagatctgatcctgtgctgaatctggggatgagatcagaaaagctgcatgcatggatggatgtccctgacggaaacattgttcgatggcgcagcatgggcagggggcgaaagtgaaagtatccgatgactcacgcaccgaacaagtcagaaaatgtgaggtcgccatgtgat

SEQ ID NO: 102398 - DNA, 1083 bp, Oryza sativa
gggagttcgaggtatggttcggaaaaggtcattctggtcttcaggcagattccagcccgtgtttcttttgttaattagtttgacgtttctccttaagagcaaattttgatatcaaatggagaggaaaaatggagtctttttgtaggatgagaagcattcagagattcaattaggattattgatgcccgcgaactgtctgaagaaacatgctagaggtctatgacaacatcaactgaaaaaagcatatgatccttgtgtctctgtttccatatgcaggagtaaactgtgtaactgaacccattagcaccctattttctgactgctgtacaagttaaggcgtggcgattacatattgcccgggttccacggctcaatcaatccttcattatttggccgggtacccggaaaacaagaatatgtaggaggaacaaacaacaaccatgcaaaacgccattcttgtattatttcctacaaaagtctatgtgtggcctgcacaacttcaagtttggtagtcataaaaactagataaatatctataaaatgttatggaagaagaaccttgtaattatactctctcttctgttatcagttgccaaatacagtcagttgtagctatgaatcctgcagaagatacgtatatgccaccatggtgtattggcatagtaaagtgttttgcttctgatcaatacaacatatgagcatctctggctctttagtaaagcaactacattgtgctgaatgttaataactacatgcatgctttatggatgcagattataatttttggtgacaaaatcattcttgaagatcctattgaaaggtatgcctgatagctgtgaagggagagccttctatgagcttgaattctttagttctcaatttgttgttattggcaaaatagaaaagcaaattatgcaggtcaaaatatctgtacagatgtacagacatgaatgatggatcatgctgtcttacttgaaggataagacctaggataaatatagtcagttcacaaatgattgctgtagcataaccatatttaatccttgatagagtgattatgaatatctgtctaggaaatataac

SEQ ID NO: 102399 - DNA, 3652 bp, Oryza sativa
ccttgaccggaaaccaaatacaccctactaaaatgcttgagctcgcgatggatcgcttggatggatgcgctccgtgagctttggtagaaatgtcgcgagcggcatgcgcacgtagcatggggatgttgtccagtgatggcgatattattcggggtccccctaccgcggcagcgctggttgcagggcacgtcacaccacccacgcggcgccaatgaggcggcggtcgtggctgccgcgcgcggcgcgcgcgccgcgggatcattcgcgcggccgcggccgcggcctcgcgctgttgcgcactaggcgtctgtctgtcatacgtcgcgcgacccccacgtctctgctgcctttccgctgtggattggttggtgttcgcgctctctccactgctgcgcgcggctggtggcccagagagccggcgcagagagcggccgcgggagtttgcccttgtcaacttgtcgcttgtccgcgagcggtgggggtgaagcgacggcgtctcccgaggccggtgtcctgcacgagtgatgaagcgacaccggcttcgtactggccggtgtgtctcaaccctggtgcgtacggacgcgctgtacgatggttcaccagctcagagacgtgccatgtactgtacgatgtggctcaccggctcagagacgccagagcagagactagtactccagtactagtaggttggtttcgcgtataagacggaacaaaaagcggttagtaccgagtacacagtgttaacgccggctcttcctgctgtgcaactacagtggagggcgcgcgtccgggctccggggtaaccaccacgtactacttgagcagtggaaggcacgcgacggatgtgacaggaggcacggtggatccagcaagagattcgctcgcctgtcagccactgtacctataaatcatttatagtcaatttatacaccaattaattaacaccaattagttataaacatatattactttattaatatttgatcccacatgtcatatacacattgcgtcttagagttcgtgctacagctagctactccctctgtaccataatataagagattttgagtttttacttacactttttgaccactcgtcttattaaaaaaaataaaattatatttatttatttttacttactttattttattatctaaaatactttaagcataacttttattttttatatttgcacaaattttttttaataaaacgagtagtcaaacggtacaaacaaaaactcaaaatctcttatattatgggatggagggagtacaaatctatagtcagcttctcttgtctcttctcttttatcttgtaatgtgcttatagttggcttatagtctgctactacatgctccaatactactagctacaacatccatcccaaataagtttatttataagtttttatgtccaacatttaactatttattttatatgaaaaaaaataaaaataataaggccctgtttgtttcagcttaagattattgtaatctagattattaaatcagattactctaagctggattataataacctgacataaaataagctacgagttgtttgtttctctagataattagaggcatctaagcgtagtgggtctttagccactcaataatctagaaaaggctcctttaagagaagattattggattatagtaatctggctttatagattataataatctagcataataatctacttgtttgttttagcttacttctaataattcatattataataatcctaagctgaataaaatagagcctaaatcgcacatacgttggacacataaaccacgaataaatttattttggatggaggatgtagctgccactgccaagatcaaatactagtacagtggtacgagtactgcaccgggagctgtggcgtctgggctggctagatgatgcagccgagtttgctgacgtgggtgagtttgtggctgacaaaactctcgcgttcgtcaaaaagttgtcataaaaaaggcggttcactctctcagcctcgcagcatcgatggtgtgcggtgcggtggaatctcgccatgcaccgcgtcgcaacacacagtagttgcacaattgaagcctgcctctgcctgcgccagcagagcatacatgtaccgatcgatgtactgtacggccacacccacacgggactacggatggaccgacatacatatacggatcaccagccagcaattgttacctgctaaagcgccaaggactctgctgaacttgcagcatggatcggcagcctcagatgcgtggatctagctggacatgcgcgacggagggagacactggccaagcgattttctagcagatgcacggtagtgaactgtgatcatggagggaccgtcagggtctaatggtacaactgtacaagcgtacaccactacaactagctacaacgactatctgaacctctctctcctaacaggaaggtgcccgctcattaatgtgtgaaaatttttttacgaatgcccatgtgaggatgtctttctagtaaaaatatttcttttactatatcatgaacaaaattaaatttatttaatgtgctttgatcagctgttatgattttttttcaattaccttcgcagcatataaattctaaactaaaatcactttaaatcgcataatttttaatttatgagaaacttgtgtcaaaaaaatagatctttttcctatgaaagtccaatttgtttttgttatattatgtttgaaattttagatatgttcattctattagtcatgctaataaaatgtttgaaaatttctatttagaatgggtttaaaacccaacagttttcattcttttcatcttcattttttaagaaaatggagaattccactctatgaaacatccttgaaatgattttgatctctataattgaagataaaaatataagtgggttaagcctacaacccaacataggataaatatgtccattctaaattatctctctaattaagtaaggaaaaataaaatagaggttgtagtatttttttagcaaattaccactaaactgaagtgtcatgtaacaaatatacatttctatattattcaatgctaaatgtgaggaacttacgatgtaccatagcaagttttaccaaaaagaaataaatggatatggtcttttaattcctatcaggaattgacttatatattgccgaggccacatcatgtctgtttcactgctaagatttattggtgcaacccacgttcttggtatgattggtatgatattcaactggccacatttttatttttaaaatgttgtctataaaaaataatgctagatggggtacatgttatgatgtaaaaaaagaatatcatttcaatatttttatttaatttatcagtgacttcatagatcatatatataatttagatggtataatcatcttaagattatttatttatctcctaaaaagatcatttattgataaaagcatcaatatcaaattgtatgggtaaatagctcctatatacatattgagaaataaattaattaagttgatagaaaatcgttagatgtctaatgggatataagtaataggtcaaccaattgtataaaaaaatcatgtgggatattttgatttttagtgagaaattttagtagtttcttttatttagtggacgc

SEQ ID NO: 102400 - DNA, 741 bp, Oryza sativa
acagtagtccatcatgcctcagctgcatttctggagcaaaggacctgacgactcgatcgatcgagctagcggatctgattggatgataaatcgtgcgagatacagactagtctggtgcaaacgatttatacgatccaacttaccgatttaaagtgatttctgacaaacaaactactacgaattttgtttctcgaatcaagatgcagcatgaacatgggagttcgagagcacgaactcccagtagctaactattgtcaatcagaacatgagcgcactgtagattcaaccttcacttatactgtgaaactgcatgctgggtctatatttgcttcgactctttactattgataaaataggatctacgcagctcatgtgactgactcgactatcaactccttacgacatcaaactatactacaaattaatatcaacttgctgaactctatggcaaaagctggtcatgtgatagagagtcgcaagtcctaagtacctatccatgaaatctaaatatacctctaggatctgtcttttctaatatgtgtcatgagacgaattcataacagtgccggattgctagcatatttatgtatgtgcatgtgtcacatttatcaccactttggttctcgatgaacggtaaaatccaagcaaattatatttttcatatacatttcaatctgattatattacctgttcaccaagcaatttctagattcctaccagcttgactgatcaccatgatga

SEQ ID NO: 102401 - DNA, 614 bp, Oryza sativa
accgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtacagcttcagaaattgttctttgaccctcggttccttacagcctttacgaaccattcttcagcccttcactgattcggagacttcgatgatgatgatgatagaggcccttcacaaactgttcttgggcctttactattagatgatgatgatgatcagctttgacatagagctgatgaagtgatgataaccaactctgacatggagctggtgaactgatgacgtagaccaactccgacgggaagccgggcaagttggagatagattggcatgacctcaacgaattgaaggataggcactgactttgatggagtaaatgggaactagtaatgacacaatgatacctagaggatatgtggctggactgagtggatagactagataggaaaggaaatcgatttgtagagaatattgatatgctagcaaaag

SEQ ID NO: 102402 - DNA, 798 bp, Oryza sativa
aaattaaacaaagcacttgctttggtcacgcttcatggcttcaagccgtgctagtagtgatacaggcatagtgataaacaaaattaattgagcatactaattagcacacacatttgctagttttgacatatgttcagccatatatctctaacaagaattaaaataaaatggcgttcattttctttccgtggtcagagataggaaatagatgtacgcatgcatatattttctccttccatctgttcatgtataaaatgatggataaatcacaactggcccagatttgagatggtcggccataaaattaaccaacactcacttcggttacgcttcacggctttgagccatgctagtagtaatacaagtggagtgaaaattataatctcaaaatcatccgcatacatatatttgcttaaaacagtgtatactcgctgcaccatatataaagtgcagtataaaaaaaaatctgatatacgcatatgcatgcatccatatactctggccgtgcatttgctatcacgtatagtttcttcccaatagcaaattaatccatatatgcatagcaagcgacaacattgcccacttcgattacacttgatggtacagtgccacgctagtagtaatacaggtggggtggaaattaaaataggcaatgcaaattgtcacgccctaaaaaaatcgattaaattaaaaatgcatgttttaaatcattttctagacattatgttaaaagcctacaagctaaaccctaattttctaggaaaattttcaacataaaaatgagctgggctgcaggaa

SEQ ID NO: 102403 - DNA, 715 bp, Oryza sativa
atggaaatcgcgagacgaatttttttagcctaattagtccataattaactataagtgcaacagtaaaccacatgtgctaatgacagattaatcaggcttaataaattcgtctcgcggtttctaggcgagttatgaaattagttttttcattcatgtccgaaaaccccaaccgacatccggtcaaatgtctgatgtgacaccaaaaaattttgtttttatgaactaaatacacccttagtcatgcatgttgagataaaactggtcccaataaaatttgatatcaaattaaagggttctctgaccaggaacacaaacacaaaccaacagccattcctttccatccaatgtgtcaattcaaggtatgcagatgcatcaatcactgcatttctaattacacacatgccacaaacaacaacatgtatcacacaagagtagcagcagtatctatgtctttggcatattgcacatagcatttgttcatgagagcaacagccacaaactgaccacacacatgcacacaaatcaattcagcctgagtaatcttcagtctatctcctcctggacaatgccatctaccaaaaaacaaactcagcagaggccaggagacactgatgatagatcaaagctagtagctgcaaaggccaatacactcgggaacaaaaacccatacaacaacacagatgctgacgtcatgcatgaagccggggctgcagga

SEQ ID NO: 102404 - DNA, 664 bp, Oryza sativa
ctgcactttggcccttgagaaaaggaaaagtgcaagactcaaaacgagctatacaccaactctgctgagatgatagtctgacctgtcatgcattctataaattgtgtagtgggattttcaaaatataactaattgtgtttagtttaaagctagctgtttgaacgaaaagatagttccattacaagttactccaaaataagagaaaccagattaattaggcttgcaacacgagaacaggaattttctgatatactagatgtaaatgaaactttccattcattagttaataacccaagtgtgttatctaacaacttgaaaaatacagttattctcctccctccgccccaaagaaaaaaagacgatcccttctctgaaaaaaaaaactgctcctaaatcctccccaaaacccaacctatatatcgtgaaaaaaccagcacaaaagaaactggaatatattgatatctccgaattcgggcatataactggtaatagaaaaacttctcctcatgtaggcttccctagttccatttatgtgattcttgcacgtgtattccttcatgcatgggtacctgttttgcttcccataaaagatgggcgagttcaaaggagctgctcagctgagcaacttggcagcacgctaaaccgtctatcccttcattcttgg

SEQ ID NO: 102405 - DNA, 691 bp, Oryza sativa
tagtgacaaaagagagctgagaactaactgaatagtggcaaaagaaagagttccaaattcttgatggtctttttgttggatatttgcttgcaaattctatatgttttttttctgagaaatataaaatttcaagttaagaattatacatttagagatctattgaaacgtatgggtattttgctagtaaataccttttggtttcaatgggctacactcgcatgccacacacatccataaagaacatcgatctggttaaagagatttgctaaacacgacagggatttgtgatatctgatgttgactgccattacatgcaggtgtgcgttgggccatttaatttggaagactcagaaaacagcatggtttttaaattatgtgatttatagtcctgtaaaaatcttgtttatatgtacgttacgtgttgcttaatattggatttctttggtattaatttgtcattcatctacagaaattggagaggcggcgaagttaaaggcggctgctagaattagacgagtgttagtagtggagggatcaagtgaatcagattcatgccacgtactgtgcatccatccagagaaaattgctacaagattaatctgctatgcccctaaattttgtgtcatccgttacatgcaccaggacttttttcttattggtagttgattgttatttttctttaaataactac

SEQ ID NO: 102406 - DNA, 1555 bp, Oryza sativa
cggcgcggggctcggcgcggctcggcacggtgctcggcgcgacgatgacggcgacgcgacgggcgagcggcgcggcagtagcgcggggcgcgaggcggcgacgcgatgggcgagcggcgcgcggggcgagcgacgcgacggcgggacggggcttgaggcgacggtggctcgcgcggcgcggcagcgggatggcgatggcgacggcgcggcaggggcggcgcgcggctcggagcgacgatgggacgcgacggtgacggcgcgcggcggcacggggtgcgagacgaagggcgcgcggagcgaggccgcgcggcgcagtagcggcgcggcagcggcggtggcgacggcgcgacgggacggcgacggcgcggcggcggcggcgcggggctcggggcattgccgggcgcgcgacagaggagggtctagggctaggggaccacgtcgagcacttagagtgcaatgaacagtgtctttttcctatttctctcattttagtctatttcttatataaatttggttccacgattcctaatttttgcacacatgcattttactcaatatttgtgtgttatctcatctaatgaattcaccctagattaatattactcatattttatttatataatttatttgaatttttaattagggttaattcttattccatcgcattttaaatttaattgatccaaacatggtcgcgataatattttatttatttctatccacacctaatctttattttaatttatatttattttaccagtttgtttttaagttttattcctaattatctatctttactcacgattaatgaacttcgaaatcaaatccaaataaaataggcgaataagaccagcatggtgcaattaatttaaaagctttttggaaatccgtatttttagagttttgattttctcggtcgaattttcaggatgttacatcatagatcaacattagtttttcgcagcttgtcagcagcgtcaaatgattcagggtatcttctccctgattacagttactgagcacagtacaacatactccctccatctactttttatagttatatttcatctaggcacacagaccaattataagtaattctacttatcatctatttaaacatgctactagttattcctcataaacaagcgattcattgatatttacatttctcgatgcccatgtagccaatcttgtgtggaagaatggagagtcacgcattaaattcgagaaagtcattaagatgataggtcgttggattgaaatatgcctatcaaaaataaaattttcagatttgaaaatatgtctatcaaaagtagatggagagagtacattattaattcttccacctccggaatgcaatttcctaattatacacttgtgtaaaaaaatcaaacaaaaatattatgacgaagagagatatgttataacactggtggagaaaccatctttgatcggtcgaccagatttcacaatagtcccggttatattaaaaaccaggactaaaaatatctttagtcccggttttaaagctcttggggtactttccaatctttag

SEQ ID NO: 102407 - DNA, 877 bp, Oryza sativa
actggaaataatttgtttagctcctggtttagaatggtatattcctggtttggagatacaactgtgcagccgggatggttgttcagaatggttgggcctatgcaacagagtatgttgtatagcgttggattaatattgtttaattattacttaactgttttcttaaattcttaaatgtttgctaaatgctgcttttgcaaatgaaaccctactatgccatcctttggtatccttgtgcacttgcatatttgctgcgtggcttgctgagtatgtcatatagtcaccttgcaatcattcatcagaggaagagttctacaatgatgctgatggtgtggaggattaggtatatgtcacgaccagaaataacccaacgggcgttcctgacgtgcgtgcattaatccttgtcccaggaggcaaggtacaccaaaagttgatacaattcagagtttaacgagcggaagcgtaaataaaattattacatgggcgacgaaggcccagcacacacaaagacaaacgagaaacagcggaagactagggcgacgaccaccggcgcttgacggcaggcacgagctagacaccgaagccttcatcttcaaggaactcctcttctggacttggaaaaaaattgagcaagactgagtacaaccaccgtactcaacaagacacacccacaaatgcagaataaatgcaagggagtacaagggagttataatataaaggggtagggtgcagtaatcagcatttaaagacatttagttgctcaaagctcttttgtaaacgcgatcctagaactatacaatgttattaataaggccgtgaacccacacgaacctgccttaacccaaggcctacgatgattcaaacccaactggcaacc

SEQ ID NO: 102408 - DNA, 720 bp, Oryza sativa
cccaaataaaaataatatgtggattcaaactaaagatctctcatctcaactcttatgcccgttaccatcccacctactacactcatctggtaaccagatagagatgatttcttttttaactaaccctagagacatttttagtatcggttggtaacaacaatcggtattaaaaacatctttaagtccggattggtgttaccaaccggtactaaacatgcattgttaagtactggttggtgtttatagggactttgacttttagaaccagtattaaaacatctttattaccggtttttaatctaagcgagatatttatgttttgggactaggatcgtttctctagtagtagcacacgctgcagtagcacagatatcattaaagtataaagagcccacttgcatgttggcttgggaatttttattggaggaagtaattaaacggaataaagtctgtaatcacccataatcaactcgaattattggatgaattattagatgcgaagagagaaaaaagacagatacatacatactcgaaatatgacgtactggtccaaattataattgcacatataactcaatataatggaaactatgtggtcattgaaaattactgttggttatttgtgtgtgaattgacatcgcgaaaacattggttgacgctcaatttgttttagtttcatgggttatccatgaaccatttttccatatttcttttcgaaat

SEQ ID NO: 102409 - DNA, 669 bp, Oryza sativa
tttaaatacatttccacaaaaatgaaactttctacaacgatatctatatagtcccttccccggcgcccgcctccgcccctggagagcacggagacattggtgtaacttcgtgtgatgctatgcctgttttttttttattctcgatgcgaaactatgtcttctctctcttttcgccgatccgaaaatattaaaataataaagacggtgtccagtgacaaattatgacatttacagagtgtcttcttctaaagtttaacttggtgtcttacatgtaaaactgtaaagtgacaatatcatatagcaaatttaccaattaactgcgcatataaaattaattattttatatccactgattatactgaccagccaattacatattgatctctattacacgcatggagacgaaggagagctagcatgacccttattgcatatatatctcgcatgcattcaggttacatacgtttagacgtactactacgatatagcttgatcagtatacagctttattctcggcacacacatatatagtatactcccatgcactaatagtacgtaggtacatgcaagggtatatacaatttaatccattttatcaacgacagttgctgtgctttgctttgagcttcttatatatggtttccagttctgcatactctttgtgcttag

SEQ ID NO: 102410 - DNA, 666 bp, Oryza sativa
aaattaatgtataaatcaaatgcagcataattgcatgggatttggcaaaaccaattttcgatactcaatacagacgcatgcatatgctcatgtacacgcaacgcaactcctcactaacggtatttgaggtggatgcatgcatcgatcatacaaaatttgttgtttaattttgaacatgagcatcttagaaaactacatgttgagacgaatccatccacacatcagtaaattaattacaatggagaacataatgcatatattacttaattagtagtcctgccactcttcatgcgatgtctatttaagcgatgttcagggtctctgataggccataacaaatgaactagaaagctaaggtagaaggagagtattctgaaggaaccaagtgagtgcaactgatcaacttgctaccgatcgatctcacaacaacatggttattataattacttcctttcttcttcctgatcttgtcctcctcatctctagctcatatttacttacagtacgtttacagtcatatactatacccagaaaaataataggtagaattaattgatgaatttttctgattgcacacaattaatttaatttgcatccatccgatccatccatgttcaattaatgtggcagagaggacaagcaacagaggtgctagagaaaggcaac

SEQ ID NO: 102411 - DNA, 705 bp, Oryza sativa
aatataaatatggtatacaattatttcatggatcaaacaataaaaactaaacacatcagagaagaggtgaatggcagcaacaccaaaaaccaaaagtttttgcggaattaaaagttaccttccaatcgttggagatcggtctaactggctagccctggtctgaccatgcccttgcagccggtctgagcagtattgatcggccagtctgaccgcctatcgaaccgcctgcgcctgtcgctgccgcaggtctaactgccctatacccatcggtctgaccattggtaagccatcggtctggttgccgtatacttgccggtgtgattctcgaaaccgagcaaacacaaattaaataactcgtggaaatagattaacctttactgattatattagcgtttacaaagtgcgaactacaacacttctttcaaaaatttcaacctttactgattatattagcgtttacaaagtgcgaactacaacacttctttcaaaaatttcaactaaactcgaaaccctaactttttctctcagctcaactcgtacaaatcgataccaggagggcttagcccccctctctacttacactcgaggtagatagcctaaagccacgaatccaacttgtgcaagaagtcctaatccactaggaaacattcccgtataagaaacaaacttatctctttccaacttaaactctaatcttctcaaatt

SEQ ID NO: 102412 - DNA, 1630 bp, Oryza sativa
agaaccatccagtggcgacccatcacaggtaactagtcacctgtgacgggccaaaaatggaacccgtcaaaggtgaggtaaagtcacctctgacgggcaagaaatatatggcccgtctgttgttatttcttagcgacattactagaaatataattcccagcaatggcgcagaaatacttctggtatattacggttacagagttcatccgcaagcgcacgtatataccattgtagcattttacccgacagtattccaagggtattgtatttattttatcccgtgggaagatcatgtagagagaacttttctaataatttatatgttacttgtaataatcatatactaggtaggggttaagataatccatgggtagaattacacacaagcagtagctacttattctcatattaaattatctaagctaagtggaaagaaaaagagaaagataatctattcctatacttctagtatacatacattctagttatccgatatactagctaataccctctatccgatgcccctccgatgccctcctggtacttcgagaagccaccccttactgccgagttccttacgacagtccgtcatgaccatacaaccggggctaaatacggaggagtaccctccccagggaattaacttaggattatatacacgagcgaaggaatacccatactgagctgtcaccatcagcggtccacctctgatccgcagcatataaccccaaataatgatatctcataatctagacaccacgtctaaacttctagatactactataatattatcatcatgacatagagtaattgcataagcaaacattatacccgtgccaaagcatctccagataagctagcagcatatttagtataacaagaatataatgtaaagtaggcattcatatactcggaaagtatttcaataccataaatttatatagaagagtattctaaataaagtacaaagcttacaaaaaaaggaaaggaaagctactagagccatacccgaactcttccgaagactttcgaactcctgatttctactctattcctattccactagcttgatactactagactaaacttgagagaatatgagagagctcttgcttgaggtgtgtgagtgaagtgagaaggtgaggggtttatatagcctcccaatgacgattgtgacggttggaatggtcgaaaataccctccaaccatcattgggggctaatctgcacggtctagcctcaaccctgcatccaacggcgctaggggggttcagccgaacctcctggttcggccgaaccaggggccggcccaaccagcccaggttttggctggtggcctcctctgttgatcctcttcgtagacttgtgaattttggtccaattcatcgtttcaattctgagttcttggcccattcatgtataagtctgattatcgacatcgtccgattgatttatcatctgtgttgatgtcgattctcctccactttattgctattctctgcaaaaggttagtatacctaatactagtggaatattattattctaacatatatatgcattgcaagcattactatttctcctctattttggtaatattgacggtcgaaattgatcgataacgaccgtcaaca

SEQ ID NO: 102413 - DNA, 5998 bp, Oryza sativa
gccgacgcatccaggcaagggtgggcgtgatggagtttggatggaccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtagtggtgacatgtcggcgcacggaaacgtgtcgtggggctgtgtcttgtgggtacagttgtacacctctgatcagagtaaaactattcgaatagccgtgcccgcggttatggctggtcaaccaaattcgccgtgattagtctcaccctagtgtaatcttttgaatttggatagtttaggtgcatggttgggcctgtcgcaacgtgggatagcgttggacagtggatagttaatattaatcaattgttacaactgtttaaatctttccacttctgtttttaaatgctcgctttatgcaaacgaaccactttagctcttctttgataattccctgcatcatgcctctattccggtatgacttgctgagtacagtgggtagtactcagtcttgctctattttttcccaaccccagagcacgagtatgtgtcagatgaaggtttctccgaggagtaggcttcgtccgtgccgtcgaggatgcctgtggagtggtgttcccgctgcagatctagtcaaggcttagctcctgttgtctttcgtttttccgctgcatttatgtaagacttttaagatgtttgtaagacgtggacctgaatgtctaacattgtcgtttgtgtaccccggccagtcctggacgggaaatttaatgcacattctgcttggaattctattcgggaatttctgggcgtgacagatgtccatcagtaaattatataaattttgagtaacttgtagtaaaaatttgcctataatttaacggatattagaaggatagcatattaaatactgcatgtaatatttttttgcaaaaacctctccatatattggatcggcagtttagtgaaattagaatttaatacatattagaagtcacctgtaatatttttgtatgatgaaatagcacttgtaaatttcaatttataccagtgacagatatgtgttttttcgtgggggtggggggggggtaatggtgtggcattctaccaaaagaaatataatagttctagttagatagtttttactatcttctttccaaaatatagcaatttaggagcggataagatatatttatcatagaactaggatatatgagtaaattacattcacggtgcatcaacttggcatgtgggtgcaatttaatgcaagaacttgagaaatgagctttatagtgtaaacacttggcatgtgggttcaatttagtatatgaactttataagtgaacatgcaattgcaacaactagcaaggtgggtgcgattttggtacaataagttaagaagtgttgtggtaacttatttatctcaaatattttctgttatacatattcaagaagcccaaacctggtgatgtaaattggatgtgcaatgtaattcttaaagattaaactcaattttataaggtaatatccgtaagattgctatgtcatgacatattgacatcttgaaaaaaaaactcaactagtacatgcttagccaagttgatgtaccaaaacacttaattgtcaaattcctgtattcagccacctaattgtcaagttgttgcactcggacgttcaattcgtaagttcctgcactatatcgcacctacgcgctaaattgttataccgtaggtgcaatttattctttttgaaacaagttagtaattaacttcctgagaggagcttattactgcggatagagagctaccaaattaactttgttccgttcaacgtatgtgtccccagtgaggagcaacagcgaaaaagaggaatggaataaaaaatacgtggacagtactacggaggcaattgatgaaagctatcaacaagagagggcattcaatttttaggcagagtgtacgacagtccattcatcttcatgtaccggctttgaagatgtgccagcttcgaagaagccgtgcatgctagcctggtcaaggaggcaaggatagtactgcctaacaattaacaaaggatggttaggctgtgttctagctctctcatttcttacacgtatgttttctaaactattcaaccttttagaaaaaaatatataaaagttactgtaaaatatcacattaatctatttttataaatttttaagtactccctccgtttcatattataagtcattgaacttttttcttagtacaggttctataggtttgatcaaatttatagaaaaaatagcaacatctattacacaacaattagttttattaaatataatattgaataaattttataatatgtttgttttgtattaaaatgttagtatgtttttctataaacattgtaaaagttaaagaagtttgaacaatagaaaattcaaacgacttataatatgaaacggatagagtaattaatcatatattaattcatcgctccattttacatgcggaggggaggtattcctaacacctcccaatgaactcagcctactgcagtggcttcgagtattggggttgcctttttttttcttcataatggaatttattccgattttgctttaaaaaaagctgtagctaatcactccctctatcccaatttgatcattacctaagacttttgaggttttctctaacaaagtgtatttttgtttatttgtgtaaagagtaaatagcatcgtgaaatgccacagcatatatggttgcaaccaataatcaatttttgtaaatgaattattgttggatacgaatcgacagaacaccttgatcattgacaattaatttcagaataatggatatgtaacatcccgattttcgcttcttttaaaacctaatttaaatacaaacctattttcaaaatttggctcttattcatatttttatttgtggcattaaagatctcatatctcttattccaagtccacatacaaactcctagaacaattaaagtccacaatccatttacaattccaaccaataccctattcagttgggcttccctttcaatccctcggcccaacttttcctctctacggccatgacaatgccctattcatccttcacacgccacggcaatgccggtgctccaagtccaccgcctcgcgtcctcgcgctccatctcccacagccgagcgttcacgctaaaagtgtgagccgagctcaccggcgccgcgtcgccgtcctcgcgcccctgtcgccgccttctccttccttctcctttcgccaaaaccatggccacaagagtcgccatgcccgccatccccacctttcactcctctaatcgctaccacccttgctcccctcccgagcgactcattgccatcagctccaccaacgatgagggcgccgccgtgttcggccatgccggcccgcgcgggcgccgcctccgcttagccggactgccgccgtcgccgccgtcttcatcttcctccaggccaccgacgcgccgcgtcgagagccgcctctctttcctcgcgcgctgaccgtcggcccacgcctacccctccctccgaatcctccgctgagtggcgcttgcttgaaggagaaaggggaattgagtgagaggagaaatcgagagagaagaaaagagatggacaggaggacgtatgggacccatgtttgaacagaaatcaccatgttgaaccctctaattgtctctgacaagtgggccccactgtacctaataattaaataaacctcttcttaacccatgagttgtttacctgtgggccccacactatccattcgtccgcgcacacggtccatgcgcacacggtcactgcccatcgggccccacactcgcaagctatggaccatgggccgggtctgccacctcgctacatccgcgcgctcggtagacccagtctactgtgcgccgacccctctcggccgctgacagcgggctccgcaaggaatattccgagcaattaaagaaactcattttccgagcttcaaaaatccatatcttgcaaaccgtaactccgactgactccttatgcattaacctatatattcaactaatgatagttacaagggatattactaaaatcgaaaccaagaacatataattttttttaccgatttgtattaaacaatatatagcagttccattactgtttaatgcgtaacttgcaaaccgtctaacggaatctggaaaataatacaacttagatcatctagacaaaattatctacaacttttatgttgggcaaaaaatcgggttatgcttctgtaggtctcagattaaggaaaaacaaattgctgtctctatttttggtcccggcagcagcactgttttcgttgtttctcctaaaccgttcatcagaatcgagcgaaaccagcgcctttataaagatatcgacgatgactacaaacttactttatttaggacaactaacctgaatcctgatgatttaataccagatttgaaaatactattgtcagcccataatcagcgactaagaaaacactcaaccggcgatttaagcgattcccacgtgaaaattgtatttgtatggactaagggtagttacccttgtagagcagaaaaatcaaatttgagatcaatttatgaaaacacagaaaatccccaacttttgcctctcttccctttttccttcttttctcctcctgttttccctgcttcctgaaactcctcctcctctctgttcgttctagaagcacagcagcagactagcatcagcagcagtagcgaggaacgttaactgaaacagccgcaacatggaaacatatcagatcgatggcagcagcagtagcaaggattggcggcagcactcaccaagaaggagctgagcaggagtggcgttggacggcgatggctgaacttgcggcgacggcagcagcgattggggtgatggcggctagggcttgtagcagctgcagggttatggatctcttccccttttcttttttttctttttttttcagttggttaaatagatatcctgatgaagatcgaacggcccacattgatttaatccccgggagtttgtccggactccgattactataaacttatagtctattttgcactactcgacgagctctacgtatccactattcctgatcacctattccaacaaccgtcaaaaagttaaatttttgcgcatttgttctaatatttcccaaatacgctaattcgaaactcgtgatattacagttgccacaatattttctcataaattaaagaccacacggtttaaataattttagtttatagtttatatgttgaagggtaattagatgaaaatcaaaaccaacattcaaagcaatcccacacaaattattgacaaagacaagttcagaactgagtagaagaatatttcaagaaagagtggcgcgcctcctcatagctatatattggcagtagaagcaccggaggcatcatggtctgatgaggctaaagcagagttggtgatgaagttatggtcaggcaacggtgcattacactctaggacatccattgctttctgcatggtcggccgatgctgagtctcaaaggcagagcaccagagccccaagatgatgagacgctccatctccctcctttcaaagtcagcaccaatctctagccttgtgtctgcagcctcgacgacatcacctttgtttcggtacaggccgcaggtctcctccctgcgcttgcctctgcacgcgatctccagcagaacaatgccaaagctgtacacatttgaggggcagttgaacctgaccttgccacctttcttgcactgtggatctatgtacccttccgtgcctacagcagttgtctgtacatctacatgctcttctgcgctgcctactacagttgtttgcaacactgcgttgttgtccgggttcgcaatccttgacaaaccaaaatca

SEQ ID NO: 102414 - DNA, 903 bp, Oryza sativa
tgcacccctgagaaatagagatttgtggagctgcaggtgttcaaaagtatatttgttttttttacttagctcaaatggcatgaagtcattaggcgatagtgtgaattaagaaaatgttgtgctaaattcgtggagattttttttccccaaaatggatcatcgttttatgttgagctagacgatctttgctctgaaattagagtgttgcaaatgactttgccagagatggccatatgtctgctaacgagatttctgaatttgttagagatgtactgctatccaaatgtatactgcctattaaatacttcctccatcccattttgatcatcctctaaaatttttgaggtcttccgaagttgcatgtttgtttatttatgtgcgcatgactaaatgctagttgtatgtccattcgtttatcacggaaaaatatatagtgcaaaccacatatagagtggaaagctagaaactaccgttagatcgaaaaatagacgtctgagattcatccacatcaccactagtaaaattttaacccaatacaatttttactgtgaataaaactacgagtaaaatttttacacgtgctatgacgtggatgaatctcagatgtccattttgcgatctaatattagtttccaggtttccactgcatatgtagtttccactatatatttctccgtttatctgtgcaggagtaaatggtatcgttgcatgcctactttgatcgatgaggtttaatttaagaaggaatgatgttgatgtggcatctgttgaaatctaaaaatgtaagaataaatcacttctggtaactgacgtagccatgagcccatggatggtttgtttggtttgcttttgcaggtgatacaagatatggttttggcactcctttatcgtgtttgggctgat

SEQ ID NO: 102415 - DNA, 636 bp, Oryza sativa
taatcgcatgtttttggtaaaaaaaattcaaatgtaaatatactatataaactatattccctccatttcattccaaaatataaggcacagccactcttaacctaaggaacaagaaaaaaatattttttgactaaaggtaattttgattacccggctttttggagaatgtcaaagagaaataacaggagtcttttacaaaagcaagaaaacaacagagaaaaacaagacaaaagactgggggaatcatcagttttaccctaaagcactaccacatcacattctcaagtccaacaccctctagaaaagcagcaaaattaaactccctcccacatacatttcagatgagtactggatcaaagactcgctgagataaagctaattaatccagatctacctgcaggagatccacgggtcgcaattgctccatcatctgcatcagcttctccaagagtttatccagagcctcacattcttttcttcctaggagtagcttccagcattgcattagcgccccgcctgtctatgacctgtgcaaaggattctttataaacttattttcaaaagccgaatgattcctattcacccacaaaccccaacatagaccagcaatcagaaacattcccaccctcactccca

SEQ ID NO: 102416 - DNA, 1229 bp, Oryza sativa
ctaagaaaatattccattccatttccatattaccaccaaaataaattctccatgcttttaggtgctttcttctcctaaaaagaaaattccttttaaaaaaagaaggggggaaaggcatggttatgcttgatggagcatagcattctcctaaagttatgctccatcaagcatgagcatgacattgaagaaaaaaattgtagccatgcactctcctaatcaataaaagaaggagttttgggataagaatgtaagcacaaaggagaagcattttctttattttccttcataaatcatttccaccatttgtcacacacacattgcacgatcttgattttcagtatgtttatttatctgctttagtctaagcttttgacttagtaataaatgtgaatgcaagtatgacatgtttgatccctaccgagctccacatatcaaaaccttagagtaggaatcaaagaggcaaatttggtgaggaattcatattgatacacttggagagactgagtagatcatttgaggaacttggctttcttttgcaaaatcatttgaaaactttcggaatgagagttgaataaagattgggtgattggtgctctaattgttgttctgtctttcaacttctcaaggcaaggagaagcagtgtctcgtggaaatcatgggtaaggataagctaccgtgccaaagattatttaatctgagagatagtacatataccttgcacctgtatctttgtgatatacagcatagtagcaagtcctgatgaacaaccaagtttttgtttccttttgtccttcactcaggatgagcaaaggttcaaacttggggggttttgttgacggtcgttatcgatcaatttcgaccgtcaatattaccaaaatagaggagaaatagtaatgcttgcaatgcatatatatgttagaataataatattccactagtattaggtatactaaccttttgcagagaatagcaataaagtggaggagaatcgacatcaacacagatgataaatcaatcggacgatgtcgataatcagacttatacatgaatgggccaagaactcagaattgaaacgatgaattggaccaaaattcacaagtctacgaagaggatcaacagaggaggccaccagccaaaacctgggctggttgggccggcccctggttcggccgaaccaggaggttcggctgaacccccctagcgccgttggatgcagggttgaggctaga

SEQ ID NO: 102417 - DNA, 696 bp, Oryza sativa
aatgcttaattaagtgcacatattcatagtcaaatgttgtttttttttatttttaaagccggtatgtgctagcatacgaaagatgtatatgtgcacgccatcaaacacacacactatacctatacacgagacaagccagatggttcctatttataggttccgttcgaatccactaaaaaaagtggataaacttttggataaaagtggtacgctttttaaactgctaaacggtgcgtttcgtgcgagaactttctatatgaaagttgttctaagatatcagattaatccattttcaagtttgtaataattaaaactcaattaatcacatgttattaccacctattttacgtgaaacacctaatttttatctcatctttcaaacaccaccgtaatgctactacttcctccgtttcacaatgtaagtcattctagcatttttcatattcatattaatattaatggatctagataaatatataagtctagattcattaatattactatgaatgtggggaatgatagaattactttacattgtgaaacggaggaggacctactaaaagctgtagtcccgtggtagtactaccagatgggctttaaggttacgtggggttgaaagatgattgatgattttagtcttgaaggcttgaagttggctctagctaagaaaacaaaaggtgaaccttttggactaaa

SEQ ID NO: 102418 - DNA, 563 bp, Oryza sativa
atattacaggtgacagatgcaatagccacattaatgcaattaatatgtccaaaaattgcctatatctaacaaattctactttgggttaagccaataattattcatattagcgatattaagatccatagcatatacaaataattgtaatagagggcttggatatttcaatacagggcatatgttgtgtggtgtgttttgttttgacgatgataaactgcctatggaaaatgcactatcaatttcagaaagtatgttttctacacctagctatatgcatgtgattcaaattattgcatagaaattcgaccaaatttctggtaagaaatgaaaacccaaaactattatcaggtgcatatattatcttaaaagcttcctgtatattctgacatactattctttttcttttgcaatagctttgttatatatctagaaataaaaatatatgtatatatgattgattgtaccttaaaaagagacaatctgttttctacaatactctcctagtctcctccatatactctctttgaactaatatatggcgccattgactttttaacaaacat

SEQ ID NO: 102419 - DNA, 758 bp, Oryza sativa
tcctgcagcccaacgttgaacgtgaataatgtaaaactgtacttattttgggacggagggagtactagtaattgcttgctgattcagctgaaaatgtcttgtaactttcttctcgtttgatcattgattctacctaactgatgcaagattcgtcatgcattagttagaaaatgttgagtggggaactgttgtagcacaggaagctgtctcatgttggacggctagaactgttgattactactccctccgtcaaaaaaaaaaaaaaaaagacaaaccctagtttccgtgtccaacatttgaccgttcgtcttatttgaaaaaaatatgaaaaaaattaaaaagataagtcatgcataaagtattaatcatgttttatcatctatcaacaatggaaatactaattataaaaaaattcatataagacgaacagctaaacattggtacgggaacccatggtttgtctttttttagaacggagggagtacttcattgactagggaagccaagttgcatagaacaaccaagtttccaactgtttaacacgttggagtttttttttattgttttcttatgaaactcccagacgtcaggtttttatacagaatctagcttttgggtcactaccatttcgcccctcagatacaccctctgttaaaactaatctaacttctgtttgtgtttcttaataagtaaagctttactaaattcagctcattacgttaaggtgatacaagtgtatcgagaacactctcagtctc

SEQ ID NO: 102420 - DNA, 511 bp, Oryza sativa
tggtcagacgttggtcgaaaagtcaacggcgtcatacattaaaatacggagggagtaacatcatgtctctttaaactagaactactagctattaagaagcgtgattaagctgaacagagagtgaaagcgggacatatcgatcaatcgaaactactgatgatcaaataagaaagaagacaattatatcaaattttgatcttacacagttaattacacaccgttatcaaaattattacacacagttacgttacacagtgatgttgtgagagggctttggtggtctgacctgtcattgcttgattggctggttgcatcgtgttcggccaccacatcaacccgacttatcaacgaaccactggtcgaggtcagcaaatttgtgccagcagtgccagagatagaatagtagtttcgttctttcccttgaagaattatacttatctcttttttaattgacgacgcgttaaccatttattttagtaaagaaaatgcaattatcatttgcttggttatg

SEQ ID NO: 102421 - DNA, 905 bp, Oryza sativa
ggtccatccagcaactgaaatgaactgatcgatcgatgatgaccatatatgctcgcgatcgaaggcatgaattgatgagtcgatcgatggatggccgacccagttggagagagatcgagatcgggactggatacgagagagccatatcagctagcggcagcagagagatatagctaagctgcgagaggctcaagatgaagccttatccgtcagagagttggagtaagatcgtatcacaggcagtacagtttcagatagggatcgatcgagctgcaggatatatctctatccatcttgccggtgcgtgcgtggaaagccctgcacagggatgtgggtgtctgggaatttggctagtgctgtgctgcatgtgtgcattgaggagctttgctttcaacaagatcaccaggagatagagaactgtacatcatgctggaagcatttaagatacgtagtatatagttatattcctttgtttcattgatttttggtatgacgtttggttattcatcatatcaaaaattaaaatacatgtattatttattttgttgtgacttgttttttattaaaaaaattaaacattacttgtacttttttagtatttacatttttttgaataaaacgagtgatcaaacgttgtgccaaaagtcaatggtgttatctgttgagagatggaggcattaattgacaagtactactcttcacaaagttattattccatgtaaaagtaatgcatataatacatgtgaaaatcaggtcaccgagagaagtagtggctgttgaatatattatccgctggacaattttgcaatttagggatacctgactgctactactgcttacaaagttattattccatgattccatcgcatataattcaggtggaaataaggtcgggctgcaggaat

SEQ ID NO: 102422 - DNA, 527 bp, Oryza sativa
ttggctagagtgatgtggagctccgtgtgctgtgtggttgtactggccacggtggaaaggcttggcgagtctctactcgccgagaggttgttttttctttttctgtagcccatctgagtttttactcctatttaatgaaatataattggcagttctcctgccggtttagttttaaaaaactactagtaagtagtaaccaatatgcatttgttacctttttatatattcacgtggtttacttaattaggaggaggattcatcatcaacttgttcatatcatctgcatacattgtagaccaaccacttagttgcaaaatatgaaaaagaaataattatctataactgacacattgtagtcgaatcacatagttgcataacttcatagaaaaaaatatatatggctaaccacttagttgcaatatataatttttatatcatccgcgacacgttgtaaaccaaccattttagttgcaaaactttgttgaaaaaaatatgaaaaagaaataatttgaaaacaacgcgccagg

SEQ ID NO: 102423 - DNA, 690 bp, Oryza sativa
atatgaagcataccatgaactgaaagaggcaaaatccatctttaccaaagaacccatgtgtggcagatagcggcaatctcacgcggagcagcacgataccataccgaaaggatccatgacatgcacgggagtagcatagaaagaaacagagcccctactcacatttcaggctttcaacaactgcagcagatagttccatagaagcctgtgcgtggctggaaccggagggagtggagactgtgccgagtttggggatagccgctccggagccactaagccactacagagcttcatcgtcggcgaggtcagactggcgtacagtggcgcgggaggaggataggaaggaaatgctggtaggaggaggcgatgagacatggttgtaccggcctcgtcaaagggcagtgtactaggagatgactagggtgcataggtacttgtatagagctgcgacaaatcttagcttcgggggctaggccgtgccacatgtgtgtgtataaacataaatgactcgagggctatgccacattagattctgctggggctgctgcagttctatattttatgtgactcccgaggctatatatatatagcgacacatcgctcttaccgttaggatggccaatgacagacgctagaatttgatgatgtatcggtctattcatgcggacggcacatctttgtattggatgg

SEQ ID NO: 102424 - DNA, 985 bp, Oryza sativa
tatatatatatatatatatatatcactccctcccccgctcaccacttttctgctctcgtcttgcaggaatcgtgcagtaacaggacggtcatcgtacagtaacaagacaacattattacagtaacaacgtcaaaaagtagccatgatggatctagtttcgttaagcgtttttttatgaacatcatggtgcaaacggattggaaatacaagatatgatgtgagagatattgctctctaaagattgagatttacctctttttttagttctcgtctcactggaacagcgtagtaacacgatggccaatatgcagtaacacatctgcttttcgcagtaacaacgttaaaaaatagttatgatggttctagtttcattaagcactttttttacgaacgccatgatgcaaatgggttagaaaaataagatatgacgtgtacgttagtaatctttaaagattgagatttaaaatactctagatctaaaaaacattacttctatagggccactgttactatgcatgttctctgttactgcaaattttatcatattgttactgccaaaagtgcagtaacaacctataaaatttacagtaacaacctatatatttttgcagtaacatatgatgttactacccttctgagataatgttactgtcgaatcatagtaacaaggtatgattgttacaggtacataaccgatttgttctcacacaatttaaacagacatataaaatatgcaaacaatgttttctattcatataacatcatgcaatgaattggttaagagagcttgccatgaactataagatcatgggctcaagtcttggtttcaccaatttatttttaatttttctaaaaaaggaaaagaatagaagaaaaaatgagagatgggagggagagaaaagagtcggcagagagagatcgagagggggagggaagagagaaggggcagagaggaatcggagggaatacgggagggagggaagag

SEQ ID NO: 102425 - DNA, 1897 bp, Oryza sativa
gtaacttctttggttttattcccctcaaaaaaacttctttggtttttgttaacaagtttttaactgctaaacaccgtattttacgcaaaaaatttatatataaaagtcttaaaacatatcaaataaatctattttcaaattcataatagttaattgagtacctaattaatcatgcactaatgagacgctccgttttgtgtgctgctaatatgctactattgtaatatggagtttcaaaagggccctaattccaaaccttttttaaagcacacggtttaaaaaaatacatgaataggagaaaaaaaatgtaaaattgaaatgtcacgtgttaccgaaacttataagattgtaagtcaaaagaatttaacagatgatgtgtttgaatggttaataggaaaataaaactcattttgatataatctagagagaagagaaatatgcatcggacttcttaaagaaaaacatataaaataaggtttgcgatcatgtgtaaatttcttatggagttgaggcataggatgcaatccaaagcaatttacatactacagtcctatataaattccaaacatgcagtttagagagagagagagggggggcactctttaaggatttgaatccgtacaaatccttccatccaaaggaaccctagcttgccaataaatattacttattgtcatacttttttttacaaaaaatggtcaataccaaaaacgtgtaaaaaaacaaaatgagtccattatatatgtatatatattactcgtatacggctggaaaaatatgaagatgaaccaaacatcatattaccttccaaacccacggaaaaccaaaaaaaaaaacatttcgctcactggtggtacggtggtggatctttatggcatgtacaacagcctttattagtggtctctctctattgccatgcaagtaaatttgatgacatggaagaaagagaaatgagtatggttgttatgcatgacaacagctcagagtcgactcttagcatttattagagcagattttgttgcatggtgatgaaagaaagtaaagaatagtaagaaaaagtattttgatacattaatgattagagactatattgtctctaactgttgtagaatgctagtctctagataatatagagctaatatttaactctacctttgtaaatgcccttacgaggaaacgcatgaagataattataaacagaatgaagacaactaatagtgtagctgccaggcattttgttgggccatcctgaccaactcaggcccagcaacaactgtactaattgggctgctgtcctgactgactcaggccaagttttttttgttgaagagagattgttacctcaaatagctagctactagctagtcatcagacagaaagctaaactgttgaaatatatattccgattccacttaaaaaaacaaatatattagatatgctccctttggtttttaatatataacaccgtaactttttgatatacgctcgatcattcatcttattgaataaaaatttatttatctatgttatttatttatttattttgttggaacttgatttatcattgaaggtacttatatttacacttttacacaaacgaatggtcaaacagtatatttaaaaataaaatacatcatatattaaaaacgggatggattaatacatttcggatggttaatcaaacgatgatacgaaatacatatattattagccttttaggcccaaaaaaaaaaaaaaaacccccggtcataatccatcgtaaacatgtttacaatctgattaattaattagcacggaaaataatgtcaaaacgatgctctctcttgcatcttgttccatcccgttataggtcgtagtcgcccatgcattgcattgcatgctacgatcgatcaatgga

SEQ ID NO: 102426 - DNA, 1395 bp, Oryza sativa
  unsure (1)..(1395): unsure at all n locations
cagacaacccaccaccaagggccaaaccccatcccctcaccctctcgagttaggtacaccggatcaaggtgtctcccttatcatccacaagggccaagggaaccaaaccaaatgccatattatccaccacgcccacttctcctccgtcgtgcaatgcaactcgcccatatggacatgtcgccatgccttgccagagcgaaggataaactccgcaccaccacgtttaagatcgcattgtattggatcgagctgtgaatttgcaagaaatgagccaagcagactgaccatgctgctgctgctgcacaccaacgcttggcattactctttgttggactcctagtgtgcctttggaccgaacagaaacagctatgcgatgacaaatttcactaagccatcaaaagcagtaaaaagaccaccgaaagcaggaaaaaaaaggagtgtactttgcacaaaactccttggcaattgtatccttccaaaggcaaaagctggaagaagtttatctcttagaaaaactcagcaaaataaatttgtagaagaaattcgaagccaagaagatattgctgaccttactgcatccggggaccagctccttgagaagctccatcctcgcattgatcttctcgcgtctcgcctgtttatcacccaaaaaaaatgataataataatgtcataaaaaatccaagaggaaacgaataattaagtaattaacgaggaaagcaacccctgaaaaggcactaaaacagcgacgtcgccacgtcctaattacccaatcattgcctaatccacagctcgttaaattaaattaaaccccacaaatctaatcccgcgaggagattggcttaaggtttagcgagtgattaattaagtgggtgattagcggcgagcctgccggcgacggcgaactcacgaactcacccgctcggcgaggctgtggctgtcggtggcttgccctcttctcgccctcacgtgcacgtacgccggcttctcgtcctcgccgccgtcgccaccgtcctcgccgctcgccgccgtcttccccttcttcgcagccgccttcccctgcagcggaatccaaaggagagacgaaatgagaaacgaagccgaggggaaagcagcggagtgcgcgcgcgcgcgcgacgcgacgagacgagataccttggaggcggggtcgggcttgcgcttggaggaggaggaagggggagggggaaaagagcnnnnnnngaggcncnaangggaagcaaacgcngagaacccggcttgcgcgncgacgaggtgcggnntcggcgggaacgccggccgnggccgcngcccngangcngcggcggtggggagaaggagctccatcgcctgggaggtcgggagccccagcagcgcggtgaaggagcccccgctgcct

SEQ ID NO: 102427 - DNA, 2435 bp, Oryza sativa
ctcccatcgttctgattattcgctatggttcttcgattatctttgtattgttttccctcttttattagataatgtctttttacttttgatataaagttgaatcatttatcttatttagaaaatagataactgtatttattttattgctatatgttttattaaacaatctttaagtatgatttattctcttcgtttcaaaataaataaatttaatataggatgtgacagtaatacaaatatgatcttcacggtagtaaaatgtgttatattctatatatttgtttactacattttagtatattcatattaaagtttaaattaagatgaatagttaaatatcgatttaaatgtcaatagcatcacctattataaaaggaggtggtagtagttttgtaatagtacgggacagtgggacacgcacagggtaaaggaaaggaagcttctcccaacatcctgggaggttagaggtgaattagtgttcagtttagtgaggttatcttgaggcaatcgaacacgtggcgtcgtggccgaagttagtggagtactaaacacaggatcaacaccatgtggccttttggtaaaagaaaactcggctaccgtgtcgtgtactcgtgtcgtgtgaacgtgcggaagagaagggaaaagctgactagtagtagtaggacgcatggcgcagcacgcacatcagtacgcggggggagtacgtgctcatgctactttagggtcattttattatcaattttaacgtaggggttattcatattataattaaaacaaatcttatcaaattttaataatattaaatttttgataaaataaaaatagttttaaaattttagcagggttacttatgtatttatcaaaatttggcaacaaactaaatataggcattttttaacaattttgataaaattggtatggttgaaaacaacgtcaatctgaacagcctcataatgctaaattttagtaaattttaatgttgcttaattttgatagcattaaatgtctttacaaaatttgatatcattcttatgataataagaactatcaaaatttaataggctgatgttggtaaggtacattctttattatcttaaaagcattattttagttaaatgagagacatcttaacatatgttaaaaatattttatatacatattcatagcagcggctagcattaaaatgtgtcgcatcccttcaaattctcttataatagtattatgtaacacaagaattattattaatataaaaaattatttgattttcaaaataatttttatatgaaacctttttgtagaatgaattatttaactgttcaaaaaaaggtgctaaaaaaaagaggaaaggtaggatttgttaaaaccttttcacgggagaagaaagatgagacgagacgagacgtgacgagcgcggcggcaggcgaaagcaacgcctggatttggaagcctccgatacgatacagacgcatcggtagcaccgccctcccggtgtacccgctgtgctgcagcctgaccacttctctctctctctctctctctctcttccctttgaccgcggcagcgtcacgccatcaaaaaagcccaacgttgaaactttcagccgtcaatggctcatggcccattatgtactatgggccgatagcccacaaacctcaggcagcgagtctcggcccatctgtctagcccaacccacctcgcttccaaattccaatgctgggcctgcaattgtctgtcactcctgtctcccgtgtgttttctgcttcctctgttccactaactagtgctcgtctgctttctttttctcgaagaaaatgagaaatgccggcggctgcaggcctgcagccgaccagtagaataacacagaaaaatatatataaaaaaggattggactggtattaagaaaatatgtgaatcacacagatacaaatggtagcactatactccctccgttagaaaaaaaaactaatcctaatatgtctaggttcaaatctagaattattttttttgacggagggaatatttgcttcgtgctcgtatttataactaattatctttttagtggtaggtgacgtatccgtcgacagtgagatgtcagttgtgacttaatcaatctcaaatatgccgatccaattttttgaatgcactcatataagtaagttgtgcgttatgtattaataaggatgagtttgcaagtcttatgagcccatgaaacttgtttctataaaaaaattgaatgacagtgaatatttgtttatatggctgaatcattttatatctgacatgtaagaaaatgatagtacatcccttcgcggactgaaatacagaaatagtttccccacaaatgcagaacccaactgcacttctttttttcatatcggagaatatatccaagtgcactagatgaaaccgtgaactgcatctgccttatatgggcg

SEQ ID NO: 102428 - DNA, 550 bp, Oryza sativa
tcagggaagtatttttatgagttcatctcgtgttgtttcttacgtaccatttaaatagttactctctctgtctataaatataaggagttttagttgattatggcgcattttaatatttcaaatctagacagtaaatatgtccagatttatagtactagaatacgtctcatccactcaaaattccttatattttgggacagatggagtataaagaataaataagatatattgtactagaattaataacataaaatacatcactctataatagtttatctatacagatctattctattagaaatacatcactctatctattctattagaatgcgtcatatctatatgaaatcccttatactatgggatagagagagtatttacttaatacagaaatcgtgattgttattaagcgagaaggtagaaacatcgacagtagcacttggcagtgggtgacacgagcaggtggtgagtggcgccaaatgaagccagcgcatgcagctgtactagtgaagtgatcgatccaccggcatcttttattttctttttctct

SEQ ID NO: 102429 - DNA, 500 bp, Oryza sativa
tgatatttttaattttttattattaatggttaaagttaaaaatgtttgacttaccactattatattttaggattaagatttatattttaggacggagggagtagcatatactccctccatcctataatatagcaacatagtaccggacgaaacacttcatagtacaacgaatccgaatatgcttcctgtccagattcgttgtactataaagtgtcccatctaattctagattgctatattatgggatggagggagtagtatttttttttcttttctttttagggtgtacaatatcctactcccttcgtaaaaaaaaaacaaaccctggtttccgtgtccaacgtggcatgaaaacctagttttttttttttttgttggacggaggtagtatgtatactcactacgttggcggaattgcgttggcgtggggatagaggtaaaatgtcttggtgttgactttaccgtgtttaggcagcgagcgtggaccgtggatcgtgtgg

SEQ ID NO: 102430 - DNA, 2899 bp, Oryza sativa
  unsure (1)..(2899): unsure at all n locations
ccctcttctctccaccacacatgcttcaagtgactaggagggcatcctcctttttaaggaggtccccctctcctagaataagcaaggtgatactaaaatccacatgcatgccatcccatgaggtgggctcttgtgattttccaaagaattaatcttcgagtgggctaaggcccatccattaattccaacaggatccacggcccgcggctacacgaatcaaccggcttttgctccctcgatcgcacgtacgctgccgtgccggttgcatacattgcctgcttattttaaagtatactccggccgtgccctgcagccggccggcacggcccggaacagtttgctcgcgatcgcgtgcacgagtatggattgttccatcatcaatcgagatagtactatggttgtgtttagtttagcgcaaagtttagattttggttgaaattggagatgatgtgactgaaaagttatgtgtgtatgacaaattgatgtgatgaaaaagaactgaagtttagattcaaactttggatctaaacacagcctatatataattaattaagctgatgatttgttgatctaagagaggtcaatcatgcagctaattaatttccttaatgagtaaattgcaaattgggctggttctttttaccagtgttgcaacttaaaccaggcataggacaatgttttcactttacaccaggaaaatttgcataatggttcagtttggtccacttcttcttcaatctgtgtctacagtctccactactactatccccgagcgactcgcgtgcaccatgggtctccaagctcaagcagccatgcacacgcgtcaattcgaggaggacaactcatggatgcatctcgtgctcactcatctgctgttggcatcctcctcaacggggagagaaaagcacagcatagcagaagaaggggggcggcgcctcggcggtggcttgatgctctctggcagtcctgcagcaagtggaaaggagatggagtaggggccgggcgctggccagcccagcagccactattttctaccatcaggggaaattgatgagctccctagattggacaaagtcaagatcagggaattctaatgaggaagaaggctgcttgacatgcgggccactagcccaaaatgccaaattggtaacaatgtttagtccaaaatgaaaagacttgctaatgtctggtccaatttgcaaattaggtaattaaacctagtccaaagtggaattcactcttaattttatttgtcagtagttaacctgttgtgtgtaatactgcatttttatatatagaggtggagatcagtatccctatgaccctaatatatatattcgacattttgcggtgttgcttctgtttgatatatactaccagaggatgtatagactttatatatatcccttgaatattatcgatagtcactactaanaaataattttcttttataggtagctagaattggtttgtttattgggtgtttttagaattgttctgtttggcgtatggatgcccctgcttgtattatggagctattgaaccgtgaatctcaacaagttgttgagtaatcaataaagctttctgtttctcgaaaaaaaaaataaacagatgtaccgtatgttaagagagaatatttttctcatttcttaatagaggaaattgcacgcccccaaacccttacatccctcgccaaccatcctttcatttccaccagtcctataatcgaacactatgcatatgagcatttcctggatgtacaaccccaccctctaaatacaatgtaagttgaactagttcatatgaaaatcctataaaattattgtattttgaatgaaccctaaagttatcatagctgcctttccactttcctaaaataaacataccttgtataggatgtggcacattctagtacagtaaatctagacatatttatgtgtgctagaatgtgtgttacatcccatacgaggttagtttatagtagattttcagctgaatctgaggttttcacaatctttttttttcactccggaaaaacactgtacttaatattagttgttttaaaaaaaaattccaaaacgtgccattccgtgattttagcaggaggcttgaaggagaagaaagcggatagacatggggatcaaagagaaaagcaaaagataaggaaagagaaggaaaagatcatttcttggcctcttccctttcccccctttacatcaaaggacaatgaattgaagccaaagaaagctagccaaggaacgtggcacacacggccaagatcctatagtaccagccaatcgatctcaaggatcccataatccaatagatagatatgtcatagatatatactccctccgttttttaatagatacccccgttgactttttctcacatgtttgactattcgtcttattcaaaaattttatgcaaatgtataagatataaatcccacttaaaatnctataagtgataaaacaaattatagcaagataaattataatgacgtaaattttttgaataagatgaatggtcaaacatgtgagaaaaagttaccggcatcatctattaaaaaacggaggtagtatatatagctataggttttgtaggataatagaagagaattgaagtagcatcactatatgcatagattggagaggcaccaaaaggaaaacatcgaggcttatatgccctgtggtcgtgtccacgaaagtgagcccatgtttaaagcaaaagcaataccagcatctccttgaaaagacctgagcttagctagtgggatttatacatactttgggttaaattcccctgcatgattcctgaattttttttcccttttctctgccatgctaatttcataattagtgtgtagtttgacgtccaatgtacgtatagatcaatg

SEQ ID NO: 102431 - DNA, 1547 bp, Oryza sativa
  unsure (1)..(1547): unsure at all n locations
tttattttcagggatagaatcattctccaagctgggggattctatctctttggagaataagagacaagccaggctctcctttttttaaattttttctcgccccagagggtttaaaccaaatttaaccccccggggaaaaggggcgcaaacccaattttttttttaacttggnaagaactgcagggtctttactgttactcaacaaagtgaagcccctcgagctcatcagatcagtatcttcaaagtctcacttttcattttttgctgcaaaggtacaatttatcttggattttcactgcatgagagagagagagaganagagagagagagagagagagagcaatcaacaatgattagtcttggatcatagtttaatcagtttgatttttgtgacacagacaaacgggcaatatgcaacactgaatgtgagaataccatcatggacatcaatgaatggtgcaaaagcacctctgaatgacaaagatctgcaattagcatctccaggtatgctcataagaattgagagagcacggtaatttgtcgcccataatatgttggaagaactacagatataactctgcctcaatctcgatcttattcagggactttcctcacaatcagcaagcagtgggatagtggtgatgatcacttgctactccagttcccaattaacctaaggacagaagcaataaaaggtatggaattttgagttttattttctattcagcttgaagaaataaatcaaaggtttatcgatcagtaacaaagcccacacacaacaatatatcaaagcaatcgaatactacttgctttccctacttcaacagaccagtatccagaagtcagaatcagtactatccagtgattttgcatttcaccaacatttcggtgaatttgggctttactatcggtacaagaaatgttcatacctgccaaaattttatcccaaattctaatattgaattcagtgtcaattctaagttgacaatcaattaattgttttcacatctattttacttatgttcattatccagatcacctctaccttgtttaattttttttcctaaaaaaatcgaaatgtcaccatattaattttttttgaaaaatttgaaaaatgtacaaaattggaaatagaattcaggataatacgtgctctcatttggaattagtgtgtgtttagttcagcgcaaagtttggattttggttgaaattgaagatgatgtgactgaaaagttttgtgtgtatgacaggttgatgtgatgggaaatgactgaagtttggatccaaactttggatctaaacacagccttaggggcttgcatgtgcttagattgaaaaaaataggggacctgaaccgctgaaaaaaaaactggttgttacatggatagcaaaaaaattgcaaaccaaaatccaatgcatctaagatggtaaattggtaattactactaattaagatgaaccagaattttcacaagagattgactgcaaaatggtttatcttcatcttcagacgatcggccacaggtagcatctctgaatgcgatcct

SEQ ID NO: 102432 - DNA, 919 bp, Oryza sativa
agctgagcggcaggtggcaagggccattaccattgccattgggagttttattttgtcgatttcaagagtgccacataatcttaaaaatgttttgtttgggttgatgattggaacatatatatgtctccagtgcacaattttatttcgtgatttcgtatatatgctatctgtagcatttaatcagtcgaacaaagcatctatatatcctcctccagaacaatagttttccgtgctccaagacatatatatagggctcctagcttaatttggaacgtatggattttgtacaattttgggtaaaatcccgtaaatataacgtgctcttaaatttgtgctttcctataatatcccgtaaaactttgggtaatcccagcaaaaagaaactttgggtacctaaactgtatttctgctatttttgcattagttgtcaacttaggtacctaatgtgtctaactcatgggaaaaaaaaaagaaaaatagaagaaggtgctgactgatttatagtacactgctctcaatatccaaactagcacaaataaatatatttacttgaatgtaattatttttctaagagtattcaagctcatttatgcgttatacctttcttagcctgctcttgcttctttaaagaatcaaggttttaaattttgcttcacaatacaggtatggaccgaaattgcaaaattaacaaagaaattgtgaaatttcaaattaacggcaaattcttttgctgcccctttcaagtttcaatcaggcttttgtaacgaggaaaatatatggaggcaaagtattgagtaaattttgaccttcatctagaacatgacaggtagattgaaaagcgtatgtggaattttaatgaaattggacattaagacgtgggtatagattcatctccagctaacattttattttatcggga

SEQ ID NO: 102433 - DNA, 853 bp, Oryza sativa
  unsure (1)..(853): unsure at all n locations
aacatgtgggggaagggtaaaacttcttaagcgatcttcgcaatctcaatcattatatagaatgccaccttagtctgagaaatttatcatatgcatgagaaaacaaaaacagaagtactccaagtagctaaggtanaaaggcgtagattgnatcacaattaatccatttgaggaaacaagcatgattgtcagaaaggaaataaattaatttttcaaacaataacgtacacaaagtccattattttaatgaaatagagatccatttcagggtaatcatgattaaaagcagtattgtcagtagggaaatagattaaattttacaaatatggacatacacaagtcctttgttttagtgaaatagagaatcaagactagatgaaatagataatcaagacaaaggttgagggaagaaattgttggttttacgtgatgctgccatggagggaggaagaagcttggatcatgccagaggtggaaggataagccatgaaaaatacttccttaaactaaacagcagtgcttcaaccttccttctgaatcacttcagacatgattcacccatcttgaaatggtatctgacagcctagtaatccaaatccatctcctgcttctttcccatctgatcttctatgatcaaccgatgaatttatcgatacccgcaaactttttgttcctctcccaaacttgcctgctgacttgctcaaattaatccccttccaagcaggccctgcggctgttcttctgaccagaagctaaaggatgacttttggctagaggagtagttgtgcaagaaatggaacgggaaccagtggttaaagaaaacttggaaagcagacatacttattatcggaca

SEQ ID NO: 102434 - DNA, 763 bp, Oryza sativa
ccttggccggtcagtacagcagaagctactatacgatagcaaaaatttgttcttggtttgtactcatgaaactagcaaaaagccaaacattagaataaagttattttacaattcttaaggaggtaccgggaggtaccacattttctagtacaaaatttggtacctacggtactagaagataccaaacttgtattaaaaattttgttacctcttggtatctcttaaggaatgtaaaatttctcattagaaaagccttccatttcatgggtataattagctgggatggaagctatttacatttggtgacaaattgacaactagcttcttagtacttccttgccatgaataacaaaacagtgcttatagagcagttccttccctgcaaaattggcttgttcatcagatgcaaaaggacaagatctggaagatgacttggtgcaggtttaggagtaccagctgcgcatgcttgctcaagtagataaatctctgaatggaaagtagcggaatagtctgaagcactacgtcagtagttcatttcagtgaccatgtgctcatcttcacatatctcagtcaccattttctatactaatccatagttgcacagagatgatctcctgatggccattctgttcatcacgaggtcaccaatcaggtctcagaagttgcacaccaatcacttaactttcacatcagagggcaaaaataacatgatctagaattctagagtttagagtttggactatgtggagcgtgatcacctttc

SEQ ID NO: 102435 - DNA, 1420 bp, Oryza sativa
tagatgatgcatgatactgcgaattttcaagggttttttttttaattttgggggtatattaatgaattagttgatgatgaggaacaaattaattactacatttgcagcaagctagcagatgtgtgtgtacgtactttgttctctagaaagtactacgtacgacttgagttctaatcgtttggttggatggagatacagaaccctatagcggcttcattgtatgtgcagacttttcatttgatttggtatatggtcaaattggtgatacgggttaattaagattaattatctgtgtcattttgagaagatttatatctatacatatatatatattagagcactatatatgcatgcattcaagtaagcagggtttttgtactgctctatagctctagcttgatttctattgatatactgctgtagattggcgccatcgcatgtgttcctttatatatgttttgaaacaatatatgttaatttctttaattatatatgaaagctaagaggttaatttgtttctctacttgtactatatgtttgtactctcataatgttgcgtttgactggggaaggaagtgggaataggagtaattaaataattactagctagctatttttaacaaccctgttgaattgattaaaaatttcaaatctgccagtttaaatttaccagggaacaattagatggccaatgcaagctaattacaagctctagctagctactacgtgctactccttacgtgagccattactgttttgtttctcttgttctgtgatgcacaaaatagaaatccaacactcattgccatgcatgcaagaggttgatgtgtgttattctttggcagaacgcatgtacaaagggttttaattttaagccttatgcagtcttaaattttaaagggttatatattatcttataaaaagggttttttttttgtgtgttcaaatgtgtatgacactaacactagaaaaacatcgacctggtgtatgactggaaaaaaaatcatgtagtagaatatgtatgtgcgcccattttctttaattttgtaacatcaacctagctatttgtgaaactcgattctgcaactattggacagtacacattgttttcctgaatttgtatattttgttcaaaataataaattgaaaatggctataaactaattaagaacatttttatgataacagtgtccgagctatgatgcacaataaaaactgagatttctttctgaaatgtaacagatctgtgggtgcatgcatgcatgtatcttcatgcatgtaattgaaaaaaaataattaaccaaacatagttgagagtttcgtttgcaagtgttttctgcattgcaaatttttcaaataatgaaatctctatgctgtttgctctggatagctgaactcaactgtttttttttttactgga

SEQ ID NO: 102436 - DNA, 895 bp, Oryza sativa
tgactagactaaagtttcaagctaaggaattcgtcaggccaattttcttgttgtctcaatttcctttaaacagcactgaaaagccatccttttggacacatggacatagactgactgaactatgattaattcctgatgcggagtaattgagaaaatgattgaattagctagaagcactgataagtgctgagttcaccataattagaataaaaaaaatcttttaagggctgtcttttgcttattttcttgcttcgaccacaaggggaaaaaaagaagtctatctgttgtgaagtaatgtgtttcaattctttggaactttctttgtcaatatcaggacaaatatcctctttgacattgggcactaaaacagaatttttgtcaatgacagagttgttcaaatttactacagatctaagccactgtattactcagtagtttaatatcttgtacacatgaccacaagagtggtgccatatttagtctcagaaacctacagtcaagtcttaagccttaagtagtcaagtcttaagccttaagttattaccatggttgcaatcagtcatcagtggtagaacttgaaccacagacaggccagctttgcccagctaacaaactaacagacccatcgtttcgcttattcggggaataagcgaaacggcatatttacaaacgaaaaataatttgtaaataaaacttttatatacgtgttcttagcgatctaaaagcaaatgctgaaaaataaacttcgatgaaaaaaaaccccaaatcaactccaaatttaaggtcgaaaattcaaattttcaaaaagatgaatatataaatactatacacaatactttactctggattgaaaaagcattgcctggttgattaggtacaataactagcagcacaa

SEQ ID NO: 102437 - DNA, 756 bp, Oryza sativa
ctgcacccctattcatgcaactagcattgtcaataatgatttgatgctaatcgagcgatgataaatgcagaagtatctatgagcagatagcacagaccagcatctgattttagggcaacaacagaaaagacttcaacaccacgttttcgctagctttggtgtcacatcaatttgtggaaaaatatcaggcataccccttttacctagattttaccaaatgggcactactgtctaaaatgctccagtatcccaaggtcttattcaacaaatacatgacagagaaacatgtgcactgttggttcaaactttacactcagcacaacctgttcaacaaggatttccccctggagtattgccgaagagaatgatacgttaagctgtggttgctggcatggcatggcatgccgcctaagtcataaccagtagaatgccaattcattctgctggattccagcgctcatgccaattaattccgcccgatttcagtaaaatcctatctttttctgcactagaagccacacataatgaagaaagttcctgatttgaccacttcaacctacctcatcgtggaagtaccgatttttttgcactgcaagcaccttatcaacaaattcccgatctttcttcaccaaaagccctagcatgagcacccccaaacaaccaaactaaccatcgcatcctccccactaaacggatccaacctacacaagaaagccgaattcgcacccagacggagaaaagatcaagcaggggcac

SEQ ID NO: 102438 - DNA, 654 bp, Oryza sativa
tgtagaatatgccaaattgccaatgaagcatgcacgcaatagtttgatagccaccaggaaggacaaatgatcttcttaatttggaccccacatgagacactgcacaagcacagagaggaaggcagcaacgagagaaatatatatatttttcttctgaactggagatgatcaatttcttaatccatgcactgggttagcaaaagatcaggctttacacactgtcatgctgctctgctaatctctagctctgaagtgaaatagtaagaacatcgttgaagccatcacctgctgaagataattactccatgggtcatggatgacatcattaatagtttccaatggaaattacaagccactatggactcctttttttataataagaatgactaattgtcacctgtgctattatggctcatgttcagtagtgctgctgcaagtaggatcaccgaagaagttaagattgacagtgaaagtcaaatccaaacttgagagctagttgtgcttaatttcagaacccctgaaattcacccccatgtagtatcctgataattgcattgtctcatccctgaaatgaaactcgatcgatcgatcgatcatcagctgatcgatcgactgtgtatccaaactgaagaaccaatttagtacagtaacctc

SEQ ID NO: 102439 - DNA, 953 bp, Oryza sativa
ccgtcgccgtaggctgcacagcagcaagaggctatgtaccgatgcagatttgttggttcgttcgttcacgttcgctacgacacgatcgtactatacgtgtcgtggtgacgtagtaggtaggggtgatctctttgtttttccgtacaccaactctactgtttgatgatggtatcgacgttgactagtcgaccgatgccatccgtcggcgatggacttttcgggaatcgtgacatctgtcacgtgctgatgcgctgatggggccatcttacacaggcagccctcgacgcttagggccatcttccttgaagaggttagaaacgtattaggcctgaaaaggggcccgagtacagcgctgcaagagaaaagaaggtagcagcaacagcatttcggccctgtttcgctatttgaaatgcatgattttttttattttatttttgtgaggattgaaatgcaggattttttttactttggtcaaacattgacatcatactgtatctcacacgttttctttgagtaattgtctatatgattcacatattctagaactgcactatagtaaaaggggtattttttaagagaaacagtaaaggagtaataagaaggtcctttagaaatttatggattgtccactggaggttttcactgatcttttctggaactagccaggttcccttggcttgtaattctgcatccaatgtttttggagagcacgcaaagtagtgttgatctctgtgaaaaccagtttcttttgacatccttaagaggaatgcgacaaatgctaactcaatgttcggttgcaaaaccaaaagaaagcaagaaatggtaagaaaatgttcagttacaacggcctattcagaatgcgagtcttaagggcctcaaacaaaattgctctctatttcacctgaaatacaaaaatggactgtgacctgatgcatgttgcaagcacagttcag

SEQ ID NO: 102440 - DNA, 1196 bp, Oryza sativa
cctcgaacagcatctactgcttgagacgtcaaatcgaatctactcctatgtatgtatatggccgtatccgtatgagcagaagtattagaagcttaggaataaaagcagtagcaatacctgttctgttcctaatccagacgaccagcattagcaaagtcgaaaaaaatccttatccccaggtttcatgttcttggcaaaccaccgaagttgatcaattcctggttgcttcgagacaaacccatgtggagcaaaatagcaagttagttcatggtttgtccgtacgtttttcagcaaccaaacttgaaacaaaaatccgtcatgctttattataaaactatttatgatcataaagtacagatagactaacaaggcaagtgaacgggtaaaaaaaaaacttttagagtgttggcaccggtgtcattagcttcaagaaaaatgatttacttctagatgcttttttttccaagcctatttataaaattagtttttaaaaggctaaaatacagagacatacacatatatatccaatcacctttaaaaggatcattcctcaatgatcatcttgatcttggattctcgatgggaaatcctctaagcacctcggtgactgaacccataggttggccactgggtgttggctaaagccaaccacaagagttgtgatgaatagtggagacagtcggggctcttcgtagagggagggggatggggttctgcaactgaactgatagaacaataatagatcacccacaaatcactttgctttgagctatgggactgtctactggtagaaaaaaatccgtcatgctttattacaaaactatttatgatcatgaagtacagatagactaataaggcaagtgaacgggtaaaaaaaactttcagagtgttggcaccggtgtcattagcgtcaagaaaaatgatttacttctagatgcttttttgcccgaagcctatttataaaattagtttttaaaaggctaaaacacagagacatacacatatatatccaatcacctttaaaaggctcaatgatcatcttaatcttggattctcgacgggaaaccctctaagcacctcggtggctgaacccataggtttgccgctgggtgttggctaaagccaaccacacaagagttatgatgaatagtggagacagtcgggactcttcgtagagggagggggatggggttccg

SEQ ID NO: 102441 - DNA, 654 bp, Oryza sativa
tcttgaaaattttccaatgccacacgccgcacccctagacgcaactgcgatgcacgatggaggagtggagcacgggacgtcgccacattttctttgagtaatgtctatatgatccacatattctagaactgcactatagtaacaggggtattttttaagagaaacagtaaaggagtaataagaaggtccttaagaatcactgtaattctgcatccaaatgttatggagaacacgcaaaggagtgtcggtctctgtcaaaatcagtttcgtttaacatcctttagaggaatgcaacaaatgctaactcaatgttcggttgcaaaatcaaaagaaagaaagaagtggtaagacaagaacagagcaagaaatgctaagacaatatttgttggaattaatagatgggctttagcccactcaaagattaattctttgagtaatcacaaaagcccaactcataggatagcatgtatggggagtttagtaccaccttacttattctaggagaggaggacctccttaaaagggaggatgccctcctagccacttgaatcatgtgtggtggaaagaagagaggaaacacgcgtgtgcacgacgatgccagcctccttttgcagggagacctatctctatataaactgagccaacgccttcacg

SEQ ID NO: 102442 - DNA, 1735 bp, Oryza sativa
caggatgcgatcatatccggatcaccttttatacctatacctatatagagagctagatttaacctagctcgcacgaccaagcacgtgtacgcactacgcactctctaccgtgagttaattcgcgcgcgtgcattaactggagtctggaaatggtctctgctggcctggccggccggatcgacccgggcggccccgcgtcgcatcatgtaacaactctcacaagtcgctcgtatccccacccgccaaccatgtcttgtccctcacgtgcgcgcgagcacgtacatgtgagaaaataccatgtcctccgctccgattccccagcgcgcgcccctcgcccggccgaaaccaatggccgaattctggtgggcgtggcgtgcggtgcagcgccgcaggggtcgtcgtcggatgggagagtgttcggaaaaaaaggcgaaaaggcgcggacgcagcgtatcctgccgcgatcctgtgcaatcgaggatgtggatggacacaagcgacggtttgctgtttgcattgatctctctcccgttgttcttgccgttaggtggcgcctagcgagctacggttggagctagctagccatccacgcaagcagcctagtatgagatatacggagcatgtgtgtgcgcaagcctgcaaggccatccagccgcagccatgccttttgttgacacactgaaaccgagatgttgaccatcagctgctgttattactactagcacactgctagttgcacatctttctcctttttagctgaagatttggtgcagctcgtactttggtaaaatgccttcctgatcccgcagaaagcgagcggattcggggtaaagctcgatgctgctgtagattctccccatctgcatgctctaacgaaaggttggtcaagatacggaaacgggagaggatctggatttcttttggttaactacctgatctcatctccctaaaaaagctagttagcgactctaagattggattatagtacgtacatttgggccttccctcgagttaacacgcctaaagaactcatctagaaagttcatcgcacatggcagcaccaggacggggagccggccgggcggcgtacatacgtcgccttagatcccatttgccaatttggatcatatcgatcaaagtgaactaacccagccagaatgcaagaggagaagtgagatcttgttatctctgaacctcttgtcgttggttcagtatgatataaattcaggccgatcactcgatccccgatttgtttcccttttttcttttgcgattggagtacggatctagttgggcgtggctagctgcctgcctggcttagctgtaattccgaattctgcaccggccatcatatgctggggcgggcgagtcaggcgcgaccgcgcgagatgtgcatgagtcgtggcgcgtcacgggagttgtttattcagggggggcggccgtgttgtgctcctgcgtcactcagctttttctctctcctatcctcctcggtctccccccctttcccactttgtcagttcgtcactccaccaccgcctctctctccccgcctctcgcctataaataccgcccccctcgcctcgccaccaacactcacctcaccatcatctcttctcctcgtgctcgtcactcgcgagcaaatacatcgccatctctcctcctcctccttgtcgtcatagtgcacgcaaagaaacacggtttgcaatggcgtggtgcttggtgttcatggtgttct

SEQ ID NO: 102443 - DNA, 654 bp, Oryza sativa
tgtattgcctacaggataagatgccgctgtggtttcctaaacactcctcacagctgtcaagattcaagtcagaatttcagaaaacatgtactccacatcagaagctatggaaggtccccaacccaaggctcaggcagaaactgcgagaagccatcactgataaggtcattactggatacaaaaggtacctggaggaccatccggagctggagaaatgcagcagtgatctacaggacatggaagacatggtcaacgagctatttgaaggatgaataaggattattccagttttagactgacatggccatgcgtatatggagtgtaaactttaaatcagctacgacgagaagagacaaacaagttcacacttgatgccttttttattgtattttgatgttctatcctcattctacttttttctaggaaatcctcattctaccttactaggaataaaatgtatcaatataaaaaaagaataaaatgtatcgacagtttaatacaagcttcttcctgtattattatctcctcagctctttaaaatttacagtggctttataatataagtgtacgtactttacactgtaaaaatgatttgactattttttagtaaacaaagtggcttcgtaaatattgtattcccttcggttttgctct

SEQ ID NO: 102444 - DNA, 660 bp, Oryza sativa
attcctgcagcccgcctctcaggaagtggctctatcagcataaaaattatcatgcaatattccatcccactcaagttaaagaatttagagtctagccaagtgtaatacatgtcccggtgctcattaaccgcgactcggctattcgaatagatttggtttactcacactgcagtggatgtacactttacccgcactccgcgactgcccaacacatgagcctcatcccaacacatgagacgcgtcacggcaaagctttttgataaccttgcattggcagtacccgctccatgaactttacatcctcatgcactctaggcgtcatacgtttctagcagtgagaggagttctggcgctcccgggaagggaaaaacacacactcctacgttgcttcttgtcgttgaacccagtccatcatgattgttctcttatgggtatcctcatgtagtattgccaagccagcctctgaccatccggaacgggcatccgccattcacctggccatccgaaccgggcatctgccagcagactgctgccacatcacacacctaaaagaagaccactacgcatggatactgcctccgctcagctatctactccgctaggtctatacccatacgagaagtgcggttgtacggggggtcgtttcatgcttaacttcat

SEQ ID NO: 102445 - DNA, 590 bp, Oryza sativa
cagtattcatgtacacttaggatcgatgaataagctagctaccttgatgttttattccttcttatgaatcttcttttttatgcgatggccatgaatcaagtgattaacaattcaataaacttggaactctgatactctacacacacgttcaaattactcccttctggacaggcatggacaaaacatgacgaaactctgctatgttgttcccaacgtgatatccccttgtttatcaccacactagtacactgcagcacacatattctttccagtggaacattaaccaaaccttgtacaagtacggagtacgaccgatcgaccggctccgttgtcctcttaatatatatccaaagcagcattccaattttttccaagcatatactcctactactcgcatcgcatgcactggtcttctctgcccttcaaccacgttaacgttttggtcctcgtgggcacacggaacacgtgacctaattagcacgctagctctacctactacctctacctgcctaatgcacgtgctaattaaaaagaccaaaaaggggagtggtacgtacattgctttctgtccatcaggttttgcatgtcaa

SEQ ID NO: 102446 - DNA, 536 bp, Oryza sativa
tattgtgcactgcaaaatcaatcaaacacaaacatagcttcagtatattcaattggaacgagaagatcaaaataatttatattgttacattctactacttcccaccatgcagctgatgttacataccaactcattaagaggaattttacagtccaacaggaggaggtaccaaatcctatttgtccattgagcatgatccgacggctgataaacgttggtaccgcaaggtaccgtaatcccgtttggcggtacctcccctgggtccgcgttgtggaagggcaaataagaaacttcgcatcatacatctatttgcgctgaggcatgagggctgaagctcttcctcctcccgatccactaacccgaaggtgcctcctctgcatgagatttactcccatccagccaagggaggcggtactaaatcctagccatcaattgggacaaatcaaacgattgagatttctcgataccatgcggtaccattttagcccatatggtggtaccgtcttttgaagagaggtggaagggtagtatagact

SEQ ID NO: 102447 - DNA, 763 bp, Oryza sativa
attcctgcagccctgcacgataactatctatttcttggactgcatgaagtagatatataagttatcgtggataaaaagttgacaggcctaccaggaagcttatgaacgaaaatcaaacctatttgatttttttacctgatggaatgattaataatccatatcgacttatacgattaactcatattactttcaactggatataattatcgataacatagtaccaagtaatgaatgaatcaattggagatgaaaagtgtatggctagtttcatcttaattaccttgtcaacgaagatggataatcaaaacaaaatattaataaatctacaaaatgaaggacgaatcaactaaagttatactcccaccttcgaaaaaaaggtccaatccaagggatgtatctgtacatacacattgaccaaatacatccccagaactgtttttttttacagaggagtataacacaacttaaaaagcaatcgaatgtacagtgggtctcataattcacaaagaaaaagaccagaaataaaaatgagtgcacaaaaaaattatagaccagatgggagcatattattagaaaaaatatattagtgatataaccaaatactatgacgaatatactgcaattacatcaaggtgaatgtcgaaacaagattttggcaatactaaaagggggtggctatcaagctggaaaagtggatgggttaagagacaaggaattttatacaggttcaggccttcttaatcaagaagtaataccctactcc

SEQ ID NO: 102448 - DNA, 559 bp, Oryza sativa
aatcttgccggccaccaggggggtttttgacccaataaaatttttttcaaatggtcttgatggacccccagaatattcaagaacggttatggaaaaaaaatggtaaaattaaatggtattttcaattccttaatggtccccattccttaccccttccttttacttaaggggtccaaaagaaggtcttccttttaaatggattaaaatgccttggttactggagtttgggaattccaattgggaaagccccttttttccaaaccaaaaacctgttgttttaaaatgcactattgttgaatgggtcttcttattggattggtggaaatattcttggccctaagggattggatcttacgccaccttagtaaagcctgttatgccaaatttaatccaagtgatgttttgatgggccacttcaaacttggtttggtggtggtaacacctcaaattcacatcgtcttctatacttgatgaagctctaatgcagtgcttattatgctaccatttaccttctatttacattggttacttgtgtcaagccggctatgtccatggtgac

SEQ ID NO: 102449 - DNA, 578 bp, Oryza sativa
acatgcgtggttggcgtctgctccttcgacgatgtcttcactggagcacatgagtattcggagtcgacgtacgccgcgtctttgtagaccatgggacagagccacaacttcaaccacgactacaacgacatgttgtcccaagaaaaacttgttacaaaggtctagataagtagaatacaacacctatcctttgcgccaatgcgatgccggttgttaagcacatagaaaaacttgagctaaccaagcatgcacaaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaagg

SEQ ID NO: 102450 - DNA, 567 bp, Oryza sativa
ttatcctcgagattgacaaagtctacattgagtcataggctttgcaatatgtaaagacacggcgaggacactttaaaggaagtgagtgattgatagcgaaaatatattctatatcctcggcaactaagttgtaaatggcttactagattgttatatttaactagaaaggaagcccgcgcagatgcgcgggcattttatttgttgttttatgaaaataatgattaaaaaaagtcacatttcactgtttctaccatatatatattaatatatttaaatgataaggatgtcttctaaattaaaaaaaacactttgttccggtttcatataaacttccctattgtcactacaatttattatcactttctaaagttgagtacctattaataaatgaaactgcatatgtacgaataaaataagtctaatatattattaatacactaaaaatatccactatacctaagtgtttttgtctcacttatttccaattccatataaaaacattctaaaaatccacttgtaccaattaataggatacatcttaaaattaaacataaatgcccctataaa

SEQ ID NO: 102451 - DNA, 665 bp, Oryza sativa
ttgctgggtgaatttggaccccaaaaagctgtaccttcaattgcatgcatgcaaatatatgcaattgcactgccatgcatttccactcacccagcccccctgtgactgagagaatctactgtatcctgagcctcactgtgcacactgttggtgtcactagcaggtgggcccatgccaacatgtcgtcctctgctggtacaagctactactacactgtacgtctgtactagctgtgtctgaccgtacatttaggaaatactcctacagaacgaaatacagtgatgtgggagtacgacgtagtattagtaataagatatgggggcaattgtgattttcacttccatttttcagggtttgtgattttgtcctccctttttaaaccgaagctatcttaacagtgctaattttagagttttttttatagtggaaagacatgtatagtcttacatattattgcaaatttgcatgtgcttttatacatcaattgtgtttttattcctatttttgtctttaaaattaatactgtgaagatgacttagcaattaaggataaattgaagtttcggttaaaaagatgagggcaaaatcacaagcctaaagaaagaagaggtaaagttacaattacaattaaaccaaagtatggcacaattgtcccggggctgcagg

SEQ ID NO: 102452 - DNA, 879 bp, Oryza sativa
tcgggcgtgatctccgcctctcaagggtgaggccccgtcatcgtggagacacttctcgagctattaagggacagttcagattaatgtcatttttttaagtaaagtggctaaaaaaatatttacatttagggtccctttgaatcacaagaatagaaaaacagaggaatagaaaatacgtaggattttgacaggaatataagtgtaaaacagatgattagaaaatacaggaaaaacacaagaatgaccgtttaattggaccacagaaaaaacacagtaatcggatgaaagagatagactcaaatgaatttttccaagagtttgaacctcttgctaacttttctccaaaatctctataggattacttattacataggaattttagaggatagaataggattcaatcaattatttcaaaagcttccatagaaatattttccataggattaaaatcctccaaatctcgtatacttttcctacaaatcaaaagggcccttagattgataccaaactttgataaatacatataaaatcctgtcaaaattttggtaatattaacacagtttagtaaggcttattttggctaaaatctaaacagctcctaaattggataatgtaatccgttttttaaagaaaattttctttatcaaacatttattaatttttttttaaaaaatactagtattatactttctaaacttactttcacccgtcaatctatcatccatgagtccgaatatattatttcccaacttctatttatttgtttttcacacttatgcttcccgaactgataaactgtatttttaaaaaaatatatatatatggaaagattgcttcagaaaattgtattactctattttaaaagttatgatacttaaa

SEQ ID NO: 102453 - DNA, 1329 bp, Oryza sativa
cagaggctgacggcggcggcgaccaggcggtcggccaccaggtgcggcggggcagcggggccgggcggcgcagacggcgcaggcgcggcagggcagcggccacgcgggcgcgcgcacgcgaggcaggagggctcggctcggcgcggctcacgcgcacgcgcgcgcgacgggcgggcagagcggagaagagggagagagagagagagagagagagagagagacccggggagggagggggagatgggccgagagagattcggcccatcgaacccggggaggcaaaatagacttttgcggaggaattgatttgggaaggatttggattcgggattgaactcggcgatagatcggggatttgagatctgagatggcacggacactagacaacaagcaaagaaacagatttcgcaaatagagtttttaagagatagttttcccgctaggcgccacgacggaacgggcgctaaaaactgtacgatatactattacagatgatcgtaaaaaatggctattgcatttggggaatgccccggatcggtcgctcgggggagggagaaatatcgggcgctccctcctccacgacgcgcgctctctgtccctgagcctcaccacgtctctgctctcacctgccacttatttgcaacatatactccattgtaacaaattaattatccacatattttagaaaccctctattaagggaatttggtttatttttttttccaaaaaaatgtttcatctagtgcactcacaatgtttcactatatatagatctaatgttgcagtgaactgaaatactctattgcaacaaatcacctacatattttggaaaccctctattatgggaattcgtttcattttttgttccataaaaaatgtttcacctagtgtactcacaatgtttcactatgcatagatctaacgttatagtgaactgaaacattctttcgctatttgctgaaacattgtttttatataaggtgaaacaacacccgatttaaacgagtgaaacattttcgatctacttagtgaaacaattccgatatacctgatggaacatcgtgcaacatttaaaaataattcaataataagctattttttcgtcggaatatatccatgtgtggtcttgttttgaaattttaattgtaatgaatttaatagtgcgatcggatcataatttgggtaagtaatttaagagaaaaatcaatttaaagtggttttgcaaggatacgtgacgctgatgtcatgctgaaatcagctcccgattttaaaaaccctccatcaggcgcccgagccggagtcatttctattgcatttgtgaagtgttga

SEQ ID NO: 102454 - DNA, 1104 bp, Oryza sativa
ttcctgcagcccaatcaggctcagggcatcaagccacagtgcagtagcatcaccgtacaatctcacaccccgaattcagtggtggaggcgtggagctgaaagatttttttttagctcgagcaaacttcaatattttctatagaaattttatcatcaatttactcatcaatactaaatttaattggagtttttgccgatgagaccgggcagccaccgcctgcatccctggtgaaagagggatcgatcctgccatatcgcagctctgttcatggtgcagagaagacaaacattttcttttcggcacgtcaggcatgggaacgacgctttcgtccttgctcgactcctcgcgacgtctcttggtagagccaaaaatgccaaacagccagccactcgcgtagtcgcgttcgcgtacgggggaccggacggacgggtggagcaacacgggtgccatgtcaaaggcgagagacttcgccgcgtgggcgcatcaacggaaaagagccggtgaacctggccgcgttcccgccgctgcatgccgccgaagccgtcccttcccttgccggcgcctgttgcggtctcgctgcttttttcgtctttacgcatcgtctccgcacgcaccaaagctgggcaaatttgctgctcggcagcgggcgggccatcccgttgatccgcccgggaacccggcgtttctgttctgttcggctccgcgcggcgcgcgtcgccactcgcctgattttcagttcattgaagtcttcggtcttgtgtaatgctaaagtggacatgctccgtgccttcgtgacgttgcactgcctgacgggtcgatgagcagcttaagtgcatgaacggaagaacggaatttgcagccacggaagtaggatcttttgcagtgtggagttgggtagtatagtaccttggtactgtcaatagtttgagtactagttgtagtacaattcgacctttgatgctgtttaggagtagtgcaacaacctagaatactactgtatatgtgaggccccaacggagacaggagttacagtaggcattgctggtatggtattggtcaatggaccgacgggccaaaacacgtgtatcaggggctgcaggaat

SEQ ID NO: 102455 - DNA, 611 bp, Oryza sativa
tgtgttggcgatgtcggcgtgtgggtggtggtatatttttttcttttttctggttacgactctccagagttataatcttgtaattttttcctactctatcaataaaacttcgcaccgttcgtacgagtcgttaaaaaaaaaagtgccaccgatggatcatggatcgtatataggaaatctgcttcattccacaccgaagattggtagggttacgcgccactgactacgtggaccacgtcacatggacagtgtcagttcgggaagaaattttgtcgagacaaactggccaatttggctatcaaaacgagaagaaacgttgttacttgccagctccgcgactctcatctcatgtgcccgggcacaaaagctttgtatacatcatcatcaccatcgccatctctccaatgtaagaatggcgagcgtgtcaaatcgaggcacattttatgtgtgaagccggtttctagtgcattgctgatagccaacccgacgtatacatgctttgatttggatttggacgacgtaaagttctattcgttcgcaagacacgttgtaatattaacaactatgtttattgagaatattttacctttcctcaatcttatgggtgggtt

SEQ ID NO: 102456 - DNA, 937 bp, Oryza sativa
attaaaaaagaaaattgttggccactgtatagcgtggagcattgtaaatgctgttagagcaagtttaataatagagccaagtatgagcttatagcttatattaggttaacatatatagtagatcagccataaggttatctctatttttctcctcctctctctatctctcacctttgcatttaatgtatttatcttgaagtatgtgaatggctagctcttgtataagagtcaaccctctttattttttaaattatctttcttccatataaatttatagtcggtttacagcctactattaaacttgctcttaatcgtcttcacggctgcatgagcgtgtgaggccgtgctagcaccggcgccagattagtcgcccacttttctctcccttctcaattttttcccatccatataagaataagatgatatgtcgtattttggagcatgcatgctgaatcagtttattgtatccgctctaagtaattttcatggtgtgattcgtgcacaggggcggatccagcatgggggcagtggtgtctcgagcctcactacaggtgtgaagactatgagaacctccacgaagaccccactaaatttttttaccatacgtagatgggttggtggactataactttatatagtttgctcagatcatactgctatttttttctggatccgctgttgttcgtgcagtaggtgcgggcatgtgtccaccaagtcggacatgttctgcttcgggccttcggggtcattgtgctcatgcgaagaccgatgccgccaacccccatcacggtccaaaattgctgagctacgtaagcacacgcctgacaaaaatcaagcagcaccagtagatactagtaccctgtagatgaaacacgcctcactacacgctgttacaaactgcacacctatagatggccatatggccgggctgcaggaa

SEQ ID NO: 102457 - DNA, 2731 bp, Oryza sativa
ccgatctgcgatcgcggcagccaggcaggcaggagcagagggcaaaaagagagagagaggagacggaaaaggttggcatgcgccgaccaaactcgccacgcctgagctatattattcccacccgccggaacgagccaaaaacgaagggaagggagacaaagagaggaagcaagtggagtgggggcggcggcggcggcgggggtgcgacgcctcgccggggcggggccggcgggcggctcaaccgaaagtcggctacgcgggccggcccgggacagcgacgccaccccggtcagccagccgaaaggtagtatggttggctggctcttccttctcgtctcctcgtaatactgtacaacatttgtattttggaacacgaaatttgtttagcccttgtttagttataaactttttcttcaaacttctaacttttctatcacattaaaactttcctacacacacaaactttcaacttttccattacatcgtttcaatttcaaccaaactaaacacaccctattcacgggagatgtgatgactactactccatcattttgtttatttgagaaataagctaaacaatatatttgtaaaggaatacttactatgtcaatataagagattttaatattttgcttacactgtttaaccattcgtcttattaaaaaaattagaattattatttttttgacttattttattatccaaagtacttttagcacaacttttcgttttttatatttgcacaaattttttgaataagacgaattgtcaaacagtgcaagcaaaatgtcaaaatcccttatattaggggacggagggagtaataatttgtaaataaaacttttaaatacgtgttttaacgatctaaaagcaaatgctaaaaaataaactacgatggaaaaaccttaaatcaatgaaattttaaatttcggctgataagtataagagtcaatccattttatgccatcgacaaagcgcgggtctacagtatgccactgacaaaactcagttctacaatataccatcgaatgactcattttcttccttatatgcaatcgacgttagtcaaccgttagtcaaccgccgttaaaagatgaaaaatgaccattttacccctagcataaaattgagattttgcataatgccatatcgcggtaaaaaatcttggatgataaaaagacaagcaatttctatttttcatcaatgagaataaatagtggatcatgatcagtgaaatcgatgaggatgcatcgtaccctaggggtaaaacagatattttcttgctcttaacggaatttgactaactgttgaccgccggcgatggtatgtaaggaagaaaagtagttattcgatggtatattatagaactgagctttgtcaatggtatattgttgaatccatgctttgtcaatggcatagaatggattatctttataaacataagcgaaaagataacatcgcacgagtttaaggttatgtgtatttttaattgtttggtgcaatttttttaattgaatcgcacgaatttcatgtgctccgaagagtgaatcgcgtgttaatatggtttgactgtactggtctcaacgtacctccggatgtagtcaacaatgatgtagattgttgtgctgccggtcgttgctcgcagactatggagttaatcaaatagtaaatcagctcatattacctttttttgcaaattagtttaggccgttttctatcgtacagtgtcctgtttcaaacagtataatacttgttggatactggatatggtattctatcagtatgaactaatatatattagtactagttgatatatatcagtatatataaggctgatacccgttgatgacatttgatatccatcggcatcggttggtgaaggttttattgtgagcgtgggacgcgtattgttgccgctcaggtgatgtatatgcatggtgcatttccctgcgattggttgcaagtggagggtgttaggcagttggctctcgatagtagcacctaatgagcaaccaaacctttctagttaatatattatgaactttcattatttttcaaaccttttaaaattgtaattttacgaataaacttttcctaactaaattttaaactctaaacattttgatcacgtcacatcgccttgtgtggcaaaataaaattgtcataccccccgctagactggtgtgacgaaacaatactcacttttggcagactggcgtggtcggccaaataaaacactggcacaccagtcagttcgacatggtctttttttgtcacggttgacgtggtcaaaatgttcatattcgaaaacaagttttgggagaatttattaataaagttaaaaatttaaatggttcagaaaaataaaaaagttccttagagttccaagtttagtatacgcatagactcatgtaagcatgataattgttgatatggaaaaatatcacctgatgcttcatacaattaaatattctagcacacatcatggtttcccaaaccaccgaggccggggttaccgcgcggtaaccgcggtaactgtggaaaactgtacgaaaccgtgcaaaatttatcaaaagttcaaattatttttaaacttatttaaatttaagaagggtaccatggtttttctattatcgtacccgcggtaagtccggtaaccacggtaaccgcgcggttaccgacggtaccataaaccttgtaacacatgcatatatgcatgaaacgtggtgaa

SEQ ID NO: 102458 - DNA, 653 bp, Oryza sativa
atttgaatttccatgttctggatttgggatttatcgtcacatacctcgtggacgccatgtcattcacacatatttctagtgaaagcacataaaaattataaatagagatagcgaccatcactgttgtcatagtagacagtggtacctaaaataagaggttagaatataccacggtcacgataagaccattcacggtgtcgtgtgctgtcgtttggcccgggcggtccacgtatgcgaacggtggaaaatcgccgccacgtttctcgttgggcccacaagacacaagcgcgcgtgaccaaagttaggcacccgtgctttggctggattgagaatcggtggcatggggataggaggttgaggtgcactgggaaggccgtggcttcgccgcgccgttcctcccggcgcgatttccccctcgatccccaaattgccctcctggtcgtcctcgcgtacgcgtgatactcgctctccgtgctcgcccttccctcccgcgcgagcgccgctctctttttcgcctcccacgctcttcgcctctcctcgctcgccgtggaagtagggcaaaaccgacgccgggagctgcagcaggcatagctgcggaggtcgtcgtcactgtggatcgacaccgggagcaagagctggcacagccgtggctg

SEQ ID NO: 102459 - DNA, 1592 bp, Oryza sativa
cccgtatatagtttggccgtgttctggccagataatattagtggcgcttttgaccagagatatgcacgcgtgatttctgacatgtatggagacgatctcagtcaggttaatctgaacttggattgtagctgtttgtttaatttgtagcggtccagttgattggaacgtactacttggttaagactaattaattaccatgtgttacaagcatgtgacttaatacagattaattaattaaatatataatatttggcataacaactgtcgaaaaaggcatactatttggcagaacatcatatcgatcctaaggataacgcacagatatataatattaaatactaaataaataaataaaatagacacgctagctagactagctagcttggagtaacgggggcacgaagtcatgtttagttcccacacaaaagttctacgtcatgtcgcatcgaacgtttaaacacatgtatgaagtattaaatatagactaaaaaataactaattatatagattgcaactaatttacgacacgaatcttttaaacttaattgctctatgatttgacaatgtggtgctctataaaaatttactaatgatggattaattagacttaataaatccgtctcgctgtttactaacggattctgtaattagtttttttattagtgcctaaataccctatgcgataccctatataatactcgatgtaacacgctaaaactttacacccttagatctaaacacccccgtgatgtagtagtacaatcttgttcctagttggagtggtgcacactcccttcgttttagaatgaaagatattttggttcaatcataagtaacttttttattgaaaaaaagtaagtcatacatccattttttaagtaatagatgacgtcgttgatttttatcacgcgtttaaccattcattttatttcaaaaaaatatgtaggagtaattataatttattttgttgtgagttgttttatcattcaagatactttaagcatgatttatattttatacatttgcataaacttttgaataaattgaatggtcaaatatttattaaaaaatcatcggcgttatctattaaaaatggagagagtactaactaagcaatccagtcatatatgtatctaccaataaattgatcactctaggattaacatgtttttttttatttttaatgaaaatttctagagacatttcgctaggtgagatgaagttaaaatgacttgattgaataacagcatagctagcaaaaagaatacattttgagatttaacataacaatattcctctaattaagttttttcccttgatatatttaagtctagctagatgcgagtaaagatcgttagctttgaaataagatatataacacattttgagatttaccagaagaaaatcctcttcgtaggtatagtcagttaataaccttttaacataaaaatcattcatcttattaaaaaaatatatagtgctttcatttatttttctgttatctttttactattaaaggtgatttaaccataacttatattttcagtgattaactataccacttttcatagagaatctcccataaaatctgg

SEQ ID NO: 102460 - DNA, 684 bp, Oryza sativa
agaaatgatacagtggcgcatttgataattggtaatattatgtgatagggaggctcacggtcatggagaatctcaccgacccggatggatcgatggatggatggatgcagcggtggaaggcaaagtcaatcccctagctgggagtttggtcggcaaatctgaagaccggtgatggagtagagtagccatccagccactagtggcgcatttcgtctagaactagtagtattacgccaagttttctttttttgagaacttattacgccaagttggaatagaattacagggatttcttcctctacctcgcctatcttacaacaggtacaatagcagactataaaccagctataaacacatttcgagaagattagagaggatagaaaagagcagcaggatatagatttgtagatagctgcaacacaaactccaacatgcatttgtatattacaggtgggacaaaatattaattgtgtagtattccctccgtcctataaaaaacagagtctagaatcggatataacatgttactacgaatctagacatatgtatgtctagatttgtagtattatgatatgtaacatccggtattatattggttttttataggacggagggagtatatgtttatagatagctattgaatgaattaactactaaattgactatatgactatagatgattta

SEQ ID NO: 102461 - DNA, 1231 bp, Oryza sativa
acatcccatggtggattatgtgtctggaacaagtgagggatcacccgatcggaggcgcgccagaacccaatcgtccgctggccccgggggacggggtcaacgctgatgatgccggcgaagacgcatccgtcgacgtctggttgggacgagagggtggcggcgacgatggagaacggcaactgccattcctgcccgggcgctccgtcctgctgcgcgatgaactcggtggggaggtcgatgtgagggcgggagtcttaggtgtcgaggaggcggtgctctcgaggacctcgaggtggagcaatggagaggatgaccagccatcgtcgtacgcgccgatgtagcgtgcgtcgtgcggccactccgggaggacggcggggtggatggcgcagttgctcaggacgaaggagacggcaggccgctcagcaagcggtaggatgagaaccggaagagcgggaggcaggggcacgggcgcttgctgctcgagggacgcgcgccatgatcggcagacggcggcgaagtgcacgcggtcgaactcgcacgggaggtggttggcgatctcgcccacgacggcgctgacgaggttcgcccatggcggagaggcagccatgggagacgggaggggaaggggaggttggggtggacttggtggcaaattgcacgggacgctcaccgctgcggtgtctgttacaagtttgattcccttttgcttctggaagccacggaacggaaggaggaggagggagggcttcttatactgcaaggaagagagatggggggattgggggatggctcgtttggcccactcgagcatgttgatcaggatgggcttgtgccccaagaaagaggaggaaggctcgcttggcacctgagcacattgttcgttcctgatgggcttgttgcggaccatttcatggcctgatttgattaaacatgataaatggacatgaaggtaaaacaacccaaatatgaagccgattctaaacacagagtatatccaaatcaaaacgagtttttttttttggaaaagttagatttgttttttatttgtgtaattttatcgttttgaacaatggtgaagtcaaactataaaatatttgactatgaatcatttaaaaatatttctcttataaatatgaagaccatatgtgcatattagtcttaaaaaaatacttcaataaaattatatatttgttcatatttgtatgtatattataatagaaaatagtggtta

SEQ ID NO: 102462 - DNA, 1365 bp, Oryza sativa
ctgcagccctaatctactttacgccatctcccacgtccccctcttcttatatttcacctccacgccccccttcgtctacctgcttgagtattccctaccttcaccataggcggagatcgagttccacatacggtattttctactagtactctatttttttctcttctatcaccattatggttgaatatttccttttcaaatccttaacccttgaaaccacagacaccattgtaggttttttcgcgacctcgaatcatctccgatagtgtcggctaggcgcgccacccatgcgcgctggcgacgctccgcgcagagcaaacgggagattatatggtatcaaaacaatgacttatacaccagaacaatgacttatacaccagacgagatccacgcagcatgttcctctctatttctttctttcttcttcctactagtagatctagatatatgatttcaaaactttggatacatatagttttgaggtcttccatggcgtacggtgaaaacttcctttttgcacggccctccccaccattgagatcaccgtttttttttttttggcctatttgcggcgcgccccggtcggccgtccctgtagctcagtccacccaccgctctcactttcatacgcggcccgccgcacgggtgcgcatctcggcgtcagaaagggctacagccctacagtgatggatcggacggaccgtgcggggaagaaagagaaacacatcggcgcaaggcgcaacctcgtctccgccccactcgccgaaaatataaattccccaatccaaaatattacccatcccccccctttttttttctctctcctcccttttcgtctcgccgccgccgccgccgccgccgccgccgcagtagagtctgcagcagccgcagccgccgccgacgcggcggctctctctgctcgccatccgcgtccggcgtaccggctgccgacgcaggtgagacgctaggccctttcctcccggccgacacgggatcggggaggcgcgcgcgcgtggcgccgcgggcgctgatgagatatggttgcggcgggggactagggtttgagggttagatgcgccggcctgtttggtttggctgttggggattttttggagtcgcgaaaggaattcaacgttgtctcgaggggaggcgtacctgagtttctcccgcctgcttgtagctttgcgttccgtatatatttccagtgaaattcggttgcccgcgcttcgtaacgaagggcttttggttttatatggatggtacttgtgtgcagtgatcatggatttctgtgggtggattatagttattctgaagccggtttggcttgagttttgagggcttagcacaggtttgactagcctgcca

SEQ ID NO: 102463 - DNA, 976 bp, Oryza sativa
aatttgaaagttgtgtatcactccttatttggtttctcctacattactcgatttttttttgtttcagaatataccatctgaaaactcaaaactgcatgtgctattatcttttacttttatgctcccaattcattgtgtgcatttattgtgtaaacaacgatccgacatttattgtacctcccaattcttccctcctcccatctatccacatccactatccgtggagtcgctttagttaggacgatagcatcgttttgtattgggatgacaggaatgcatgcatatctcacacttctgaaagctcggacgcactaaactaaggattgattagaaagagtggtgagaagaggagagaaaagaaaaatgtgcctccataaagcaatatatgggccggtaatgtttctgatttataggataatttaagaaatgttttgtgtgttatggatgggtcgtaatctaagggcccctttgaatcacaggaatgaaaaaacggaggattaggaaaaacataggattctgacaggaatgtaagtgtaaaacagcggattgcaaaacacaggaaaaacataggaatgaccgtttgattggaccacaggaaaaacacaggaatttgaggagagatagactcaaatgatttcttccatgaggttctatctcttgttaaaattcctccaaaacttgtatgggaagaggcattccataggaatttcataggattccatagggtttattcctttgatttaaagggctttgtaggaaaaaaaatcctataggaataaaatcctctaaaattcctatgaatttcctttgaatcaaaggaggcctaactatacgtcgtaggtgggttaaaattttattctgtttcaaaggtgtattctttattttttcacaaaagcgcaaaagaaatgcacgtaagtatagcagtagaaatagtgttttttctgttatataacgcaattgaccagactggccgtta

SEQ ID NO: 102464 - DNA, 895 bp, Oryza sativa
cccttccacggcccctcccttttgggactctgatggtgaagatgacgatcctggtatgcaaataacactacttttgttcactgtgatgataattaccgtaataattcaaaatgatagcgctagagtttgaaatttttatagcctatttatgggaaaaacaaacagccatttctcaactaagagttatgattagttccttaggaagataatattatgttgaaatatgtgtctggcaggccagtgctggaaactgtaatcttgagggacgcgcattaggccctgtttctttcagcttgggattattataatccagattattgggagtaagcagaaagaaacaaacaacttattgaagtagcttattataatctgttaagctcatttaggtgagctttttccagattattgggtgaaaaattacccaccatgccaccccactccctctttagacttgcaaacccaataatctaggctccattctactacagattataacaatctagcttatattaatctgactcaataatctagattataataatcttaagctgaaagaaacagggccttagtatggacagagattacatgcttaaatttgctatgaagacctgaaagaactattttttctagtcatactcaaaagtatcattagtttgtttactcctattgtttcttcctcttgtacacataacacattcaacgtgccagtgcaatgcagttgcccttctgaatattgcacttttggccacctgtacttatctctacctttaagccctatgtttcactctgggttaaataactaggttaacttaactcatttcttgtgtttggcagcagacgtagttaacctaagatactgtttagcttgattagtatctgtttagctgggttgaca

SEQ ID NO: 102465 - DNA, 519 bp, Oryza sativa
aagacaatcagtttaatggaacacgaactgatctgccttgtcttacggagtactggatgacaatcgccttgctgtgaccatcatgtaattcatcttgccaagagatattctcgctgagatacaaccatgacgttcacctatgtatgcatctgaagatcggactgttgaccaagtgggtgtggaccacgggacatcggttattaatattccaagtcgcacttttgtttgacttggcgggaatattatcgattattaatcagaggataagattgaggaatgctatctttcctacgatgaccagagggcatgggggccaactgccatgaatagtggcaggaaactgccttggccagacgaactctgtactaaactactagaaaaacaactgctccctctttgaaactgacaacgcacaaacacccccgctcctgatgagagatgccaacatcaattacagaggttcttctcttgcttgcgtgagggatgaaaacgccaccgacgcaacgcatcatcactacc

SEQ ID NO: 102466 - DNA, 626 bp, Oryza sativa
ctgaatttggcaaatttaagaaattggttcaatttacgagcagcatcatattagaaatactgacatactcgactgcaaaactattttcaagactaaactgaattggagattgatgttcccaagtactgtgataagaattgagatagtgtgaagtgcaggaaaccaaatagcactactacggatccgggcttcagtgacgggtcatctgtgacgggccaacacaactcgtcaaagatgagtcatctctgacgggccgaaaaaatatcctcttcaatatattgctactagggaggacccatcacagatgtatcgtttactaataattagctcttcaacagaacctgttgctcatatatttgacatggttttgtacagtagataataatcaagattcagtaatgagagtatagaagataccttgctgcacaaccatattgtggtgtattataacatttaaatataatatgtgtttggtgataggagagttatttgtacccatcattcacgtggttgaatctgctcttgagttattcttttagtcctgagtttaaacatagtgacaggagtgtaaatgcagtggaggaaatcgtgtattaatgccattggctcataactatgtttaatag

SEQ ID NO: 102467 - DNA, 716 bp, Oryza sativa
actagtggatcccccgtagttttattcacaaatttcctatttttaaaaccatttttagcaaacaatgaacctctgattttttttcttcttctgaaaatagaccttctacctattagaaagctccatttctattcttaagggaatatttttctcactaggggtgtatttgtaatatatattttcacaagggttatttgtgaaaaatatcttagactagctatacatttatagtcaaattttaactaaattatttgaaagatataaatatagtagaatcatgatgtaatacattgtatgttgtaagtaattgtagtataacttatatgtaacttttaaaaatcgctaggtaacatgctatttttcataaaatgaaggtataatggtaccaaggttgtcatcattttctacctccctgcatggattttaaagcaaactgaacggctcaaaattgcattgtagttacatgcaagttacaatgtaattacattgtgattgtactatatttatttttgttaattttttagaaaaaaattgttgacaaatatataacaaaatcgtaaatttttaacacggattatttcgtccatagttccaaagataggatttttagaagaacattttttttactgattgattagaccacatattctaagctatttgttaaatttaatttttaaaatattagtttataatgttaattaaatatacaatctgtg

SEQ ID NO: 102468 - DNA, 725 bp, Oryza sativa
acgttcgttgtgaggctagaaattcccacattaatcggagaaaaagaaaagaagagtctaaatagaaatacaatcaaaaatagctgaaattcggaattaaaaatatgcaatattgaaagagaagtccatataggaacccaatacatgattaattaaaattcggaataaaaataaaataaatttcgaaattagaaaaagaaaaaaaaagaggagttcgagtaggaatacaatttaaaaataactaaaattcaaaattaaaaagaaataagagtccatataagaatccaatacaagattaattaaaattcagaatgaaaatttaaaaaaaaatcaaaattataaaaaaagaaaataatagttcaaggaggaatacaatttaaaattaacttaaattcgaaattaaatataagcagtattgaaaataagagtacatataacaacctaatagtatattaattaaaattcgaaataagaaataaaataaaatccgaaattaggcaaattaaaaagagagttaaagtaggaatacaattttcaaacaactgaaattgaaaataagaaataaaaatatcaaaagaacacaatacgaaaaaataaaataaattctgaaattagaaaaagaaaaatactaggaataccatttataaataagtaaaattggtggtaaaaaatcaagactattgaaagaaaatatcatctaaaacacatggcgagattaattaaat

SEQ ID NO: 102469 - DNA, 735 bp, Oryza sativa
ccctattctagcgacatttttttcactcaatggcacatgcacgaatctcaaagtaaaaatcatgcggtcaactaatcaactgatttttttttaaaaaaagaaaatctggtggcgacagatatgtagcaattccttttttttccgtgtgtggtggcacacacgaaagaacacaataacacaaatattatttgttgacacaagccacacactggttctagaaggttttcatttatatagagatcgataagatacatgcaaggaattacacctagccaatcactcaagttaattaccatgcaagtaaactagtcacatgcctaactaccagccatggcaagctagtcttacgccacaacgtgtatatgccatgcaaggttccacttctcaggacatttgagtttttgctacagtgtgggtagcaagcttgttgatcagcaagcctttcctatcgcccatgatgatgtgatgacaataacgttacgtatctgcctatgcgaggagccttgcttgatcttttagcttgcaactttcttttgcaaggcttgtggtgaatagcatttgttgaacatggcttttcagttttcatagccttgtagtttaggtttatcatgttctgtttgatgctgtagttgtggttttcgtatagtttctcttaattaactatgtaccgtaagatttggtatcgttttctccttaaaatgagaaaacttattctttatataaaaaattaagaaa

SEQ ID NO: 102470 - DNA, 755 bp, Oryza sativa
cctatatggtcagtcaacaaaacattggaaccttggatacaaggtgacaataacttaattagtcaaagtaaccttcctaatctgtagtgcgacaaattatgtcaatgtacgctagtactacaaattaaccaaacattaacaaccctgagtcactaagtaccggcagctactcgatcgatctatcaccaaaaacaacgccgcgacgcgcgttgctattattagccaagtgcatgtgtggatatttcgcagcagcaaacacgtacgcagtctcagtcacgcaccaacaaaacgcacgtacgctagcagctggctagcacattgttcatcgcttgttgagtagccccggctccctgttactacctccatattttaatatatgacgctattgattttttttaatgtttgatcattcgtcttattcaaaaaatttatgtaattatcatttattttaatgtgatttgattcatcatcaaatgttctttaagtatgacataaatatttttatatttacacaaaaattttgaataaaacaaaggtcaaacattgatcaaaaggtcaacggtatcatacattaaaatatggatagtacttcgtttcgtattatgaaattttttagcattatccatatttatatatatatgtctagattcattaatatcattgtctagaaaatcttctaatatgaagataggagtaatatttggttcctgttaattaatcagccgctcggagcaccaaccgatctgttttggagt

SEQ ID NO: 102471 - DNA, 1021 bp, Oryza sativa
tcccccacctccgccgccgcgagccagcatgccgtcgctgccgccgagatggttcttcgccgggaaagaaaggagcagcgcttgactccccctcttcctccgcaaccgcgagccggcgctccactaccgccgccgggaaagagaggagcacgccgacaagcagaccggagagagagaggaaggggagagttgtgcggttgataagtgggtcccacgtcgatttttacacggtgttggcattagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctct

SEQ ID NO: 102472 - DNA, 567 bp, Oryza sativa
agaagccgccgccgcaaagagccacgagaccaaggatcggcgcgcactccaattattaatagacgattgcagtgcaccgaaagaaagcgaccagatcagactccatccacccgcggaacggcgccaacgcaatggacgcactccccacgcgatcccagccctccgcccgcacgcgcgctcgtccgccacgccctccgcttccgctccactcttctcctctcccgcgcgccacgccctccctccccttccccttcctttcgcctcctcacaaaaccaacgcgccgccgtcgcccacagatattccccccgcttttttctttaacccatggcctctctcgtcgccaccacccgaaaactccagaacccgattccgtcccgtttccctttctatattacgtggagtagccgggtgggcagatcgcttctcgagcatctccgccgcgagggagcatgtgccatcctgggctgccgcctctgccgccggggtgcgaggtcaagcggcggagggcgccgccggtggcgcgagtgggttccccgccgcccgtgccgcggcgggagcagcctcat

SEQ ID NO: 102473 - DNA, 1866 bp, Oryza sativa
gctgctactaaaggacttgaaatgtatttttacagttgagctttatatttttctttaagatacagctgagtttcttttaagtccaagtgttataactaaagtaactacaaaaattattttatagttgtgcataagaaagaatgcgagatacatgctaccagtaatattcactagcggaggtgattcaattgcaaaaaatttgttggctggtaaacctactacttatggtgacatatgatggttttggtaactactcgttgtaacaactcaaccatatcaaggtattgacggttaaacctcttacaccactatagagtaatatgtggtggaacagcctgtaaagaacgaaaacttgcggtgacaggtgttctttcgctggcattaaaacattatattttagtaaaaacaaaatttaataaaaataattggataccacaaataacactactacaaatatatatagactcatgagcgacctaagatcccgcaactccggacgcctacttgcgctcaccaatgacccattcatagcactataaatcattatgttcgtgattgtttgcatatattattttgtgagctctataacaatttgtatgacaaaacttactaccaataaaacctaaccgaataattctgcatatattataggccacctaaggattagaaaagccacatggaaaaaaacaggtgagacctctatacccggttttactatcacaccataaatgttttctctatattaaagtcctgatacatataattctaatgaagtatttctactatatctatttttttcaaggaataacataacctctatactcggttttactatcacaccataaatgttttctctatattaaagtcctggtacatataattctaatgaagtatttctacgatatctattttttttcaaggaataacataagatatctcttatcatgattgatggagctccctcagggaaggaaaaaaatagtttgctattggtattggattatttttgtgggtagggccagttactctatctggtctaattctttattctttgaagtttctctattttttaagcaaagccgatgcacttctctatgacaatgagcttttgcatattttatttagctaagttttcgtggatccatgcacgagacatcacgttcagattccactctccaaaatgcaggactaaatacacactcgaactccgaaataatgtgcgatgccaatgtgttttccacgaaataaaaattaaagaaatatcctacggtacatcgtcaagaaaattagtataatatactccatctatttaaagttaatttctgttctaggttatcgtaaatcaaacaattctatttttatcatcatattttaaaaatttgtatagttaaacatcagaatgatatattatgaaaatatatctcctgatgaatctaaaaacatactccctccatttaaaatatatagcaacttttaacattcaaatatattacaaatatagcaactttcccatctatgttctcttctcaaccaatcgcattcattccctcatttaatttctccatcaactttttttctaaacaatcacaactttctctagtttaattcatatgcattcttaatattcgcatcgaatctttaaagatcttatattttgagatgtgagtagtatatattttttagaaattgatagtcacaagatataaatatttgagttatgacaaagttagaaaaacagataatttgaaacaggtattaacactagcggatgttctagattcaaatcatttttatacaattaatctcacaacgtgttctgtaatgtgttatatgtaacttactagcattaattatcacaattttagt

SEQ ID NO: 102474 - DNA, 738 bp, Oryza sativa
aaattgtaataaggtagttacatctgccatcagcccatcacccctccgccctccacgcttccgtattccgccttttcgcttcgttgttgtagctgtttttttctctctcttttttttattattactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcacattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttcaagatataataggattcgatttttttaccgcatcacgtataattcctttttctttagaaacagacaattttttcgcccttttttatcgcgtcaacggagtcggaatcgttttgattttttccctttttttggatcggacagatttttttttgcctggtttatttcgcccgatcgattttttttaccgcgtcacatataattcctt

SEQ ID NO: 102475 - DNA, 664 bp, Oryza sativa
acaaggtgattccccacgctttgctgtgggaattactaagtaatttttaatatatattttttcgttacaatcaagctaggggcaaaaagaaaacaaatgaaatatcagggcttatcagtatttatcatgaaacagacaaatgaaaccacactttaatgtgtaacatattgataagtttatgttaaatattataaaatggtagatagatttgtaaaaatattgtgaaaatgatgtgatgtgtgattattggatatgtttgcatgttgatttgtagaattaaatagattataaatgatgttgcatgttttcacgaggttgaatatataattattgctagtgggtgatgatatagcatggttgtatgttaagctttacagttagtgggttgtaactttatagaagtataaataagatgacttgtttatactccctccaaccaaaagtttatagcatatttcttgtttcaccaagaccaaataaaaaattaactcattctatatataacaaagaaaaaaaatatgcattcatgcaaccagtgttaagatgctaatttagcacttcattcaaatcttatatgcatatggagactacaaatatgcatatctcattttcttttcagaaaataaataagctttaagacttttgggtgaaaggagcaacaaaa

SEQ ID NO: 102476 - DNA, 1163 bp, Oryza sativa
atctaggagaccttacagtcaccgaataaaagaactaccctggaggtatagtgctgagtccaatcagattagtttgcaaggtaccccactaacttgtaacatcatttgttaggccatagaacaacgacggaagcaacgcagcgctcattgaatcaggcaacacaatatagaacaaaaggtatgggtgcacagttctagcatcttgatgtgaaagtacgcaagtaaattgaccaaactccaacaaaatgcaccagattctcagttggggttgtgttaaacattcaagagttgacatgaactacaaaagtatttcattaagtatggttcgtggacaactggtacactatcagaagcaagatattgtcccttattcggagatgcgttcacaaaactacttaatgaacagagcaaatccagaatgaacaatatcagaatctggaccgacttctttttcccttccatttttagcaatcaaacggaatcggaccaacttctacagctcaaagttggaagctgaacaaagggggagcagatgactaaactgcaggactgtcacttatgcatcatttaagcttcacaagtccaggactccaggtacaatctatactataagagcttccagtttccatgctctgagcagccatggcttgtttccttagtacaaaaggaggcctaagaaaagcccctaaatcaactagacattctacctaagccgttaattaaccgtgtgaaaggattcactccctatgaccctatctactgcattttaaccaaaattacctagaccatgattcagacaaatcggctatccttctgaattctgattttgagccaagaactaggaacatcttatgatatccggaagtacattcatggaagaatccccagaaaatggtagtaacttttttcctaggaaaagtcaaacctcttctaatctttttttttctgaaactgaaaacctcttcttatctgtcagatggggtagaccaatcaaccaatctggatcagatggcacacaacttcacctaaaaagcatcccttgattccataacattgaaaagcccaatcaagatttcaaggagcaataatagtacagtacagcagctcagatcggaaccatgtactcaaagatctaatttggaccacactaaatatgcaaaaac

SEQ ID NO: 102477 - DNA, 509 bp, Oryza sativa
ttttacgcatgagcaaattcatcagattgaaattattctaaattaattttagttcacttaaaattctacactactatgcctaaaagtgaattctcagatttcatgtaaaatgatgaattacgttccgactttacatgaaaaaaaatatattttggatgcatgacacattttccagatttatctgattcatctcccaaatatgcagtatttgttacatttaagcctccaagaacttagtttatgttaacaaccttaaaagaaaacatattgataaacctattatttttagggttaattgatccatgccactgcaaatatggcatattagaaaaataccgatactattcacgatatcggctatgtgccactaaaatttgggaaaattagaaccacgccactgccgtccaattatctctcaacctatgtctaagccccctgttaaatgtcacttttgccccttccccttccatctctctttttcctcaatcccggaggagagacaagatggg

SEQ ID NO: 102478 - DNA, 2633 bp, Oryza sativa
attgttggaaacgatattaataactaaaattttatgaaaatggtatcactatggttgggaactttttatatttataaatctaactaacattttagtgatgacttcaatataattcatacataaattaaaaaaaccaaattttacataaagctaaaaacaatatcttacttttctttatgaaaacaatatcggtatggtcagaaatttcctacctttttttcactagttattttttctatatcaactcctttctgttctttttcttgtcgtcatggtaactgacatgtcgccgtcgctctatatcgcgccaccgtctttctctggtgcctattccccctcgtagtccctggaggtggccgcgctgctgtttctccatgatctccctggcgttggatgtcgctaattatacggccccacattaccacatgggggtgttgtcggcatcggctacgagcaagcgataggaaagctactatacaacgctcttggagtgcgcatggagcgagcgactatttagggtatgtttggcagagctctagctccaactacatgtcttctggagctaaggcccaaccaaacagtttcaactccacctaaaaagggagctagagtgaaactgactagaatgctctcataaaataaattaagaaggtgaagctcggtttaaactgctctacaacttcacttcaaatcgagctcttgaagataaacttcgaagttgaagctctgctaaacatacccttagtcacttgtttgccttctctcttcactaatctcttttcagctcagcatgcaatccaacgtggaatgcttatcgctatagtattggagtgccattgtactttttttaaagtatctagtcatatgcagccctatgaaaagcaaaactaatacagccaatgattaataaccgtaccaactcatggtgggtactgcatctttattaaaaaaacaacctcactttgaaaccacctatactatcaccatggttgcacaattggatgacactacacaatagaatttcctggtgagtatcaggattcgccaaaccgtcttgtgagattacctttaacccacagtaaggtggttatcatgtgcagaaactgtgtggttatcgtgaaccatgctgttatcgtgaggattaccgtggtttccaaaaactgaaaaggttaccgtacgttatatcattatatcacgtggccagggaagcaaccggctggcctcttaccgctctccatctagtacttgtgatatatgcttgatactctccatacttttaaattttattttaaaaatatagactctctagtatctatactattatctcaatcaatcacaactatcttttatttaatttttccgcgttctcttcttcgtatcaaccaacttcaatacattaattgttataaatatgaataaagtgtacgtgtgtttatagggacaagtgtactaccatgtttctttaaaaaaaaatcctagggagtgagtaggattttggggtttccgtggtagctaggctgtgagtgtcatgtggtccaaactccatagtagaattgacttgagaaaaaatcggaaagcctagctacggtctttcacagagttttcctcgtccctgacgatctgatcacttcctcgtcaacaacaagtctctctgtcgtccactcgatccgatccttcctcccgtgtccctcctccactcgatctgctacctcctggacacggcgacgtacggctgatccgtcgtccggtggctggggttcctggcgggagacgccggtcgtgcagaggtcggtctcctccttcctttccatggcagcaaagccggccgacataggagagagagagaaatgagtttagaatagtattctcttagttgcaaaatatagtaaatctaggattagatgggaatacaatcatggtaccaatatatctgttcagattcgtagtattaggttgtatctctttcgattgctatatttttaaatagatgtatttttctctttttcacattataggacgttttgggattttatagattcatatatggatccatatatatgtttatagatgtgtataaattcatatgtatgctagtatatttagataaaaaacgtcttatatcgtggaacggaacgaaacggagggaattgtagataggatatattataggtataactaattaattacactgggcaaaaactgtcacaaacaaccggggtatttactattttcttgttgtacatacatgcatcgagctttaatattgtgaatcgatttgttgctgtttgcaaaaaaaaatggaattttagcacggagcatatgattattcttggtgctatggttttatagtttcataaaatcatgctgttaataaattgttatttgattgaccatatttgtgggttctaaattaattctgaaatatatgaagaattatttgatctattgtataaaaagtttgatagccattaagttaagcattttttttttgtttttgttttgacacaatagtagcaagtaaaattaataaacagtgcggttatatgaaactgtaggactataatatatccagtgttatatgccacgtgccaaaacttctggatttatgcaatttagatcataatatataccta

SEQ ID NO: 102479 - DNA, 668 bp, Oryza sativa
aatcatgtacgatgacctctacacaaaggctcttgtgctgagaacaaggataggcatgattctccgatgcacctctcacgcatgttccctccttgcttttgcactgttccttacatgtgacaaacggaggaccaccggaattgatggtgccaaccactattcgcttgttaatcgaaggctttttccttgatctttctgcagggttaatctcataatgtctccatggactggggcgtggttgaaggctcaaaatgccaaccggctggctagctggtcctggttccttttttccagtgatattgagctggccaaagaaaaggccacggtggtggaattccatcggacagtacaactttctgaactgggtttctggtggagaccagccaagatcatgcaaccagaaagtggtggctctagtgagaagattgtcgagtttagtcggtgttggaaaagaagatttgttctggctagcaagacgttggacactgagcatgtggaggccgatgaaaagacgatggagtttgtcgtaaaggggattagtagcttgagcgatgaagtctccgagcaacaacaatggcagcatcttggcccattgctgaaaaagatacggatctgttttgtcgcagatatgggatgagctattgtggtgatgcacatattcactcaag

SEQ ID NO: 102480 - DNA, 855 bp, Oryza sativa
aaagcagccatgcgtcaagcacggcgtggatgtggatcacaggatcgtgggaataattaactatttaccactcttacaaatggtcatagaggatttgtcactatacccacatatcatagatacatgaggacccatatgttatagacaacaagtggcaaatccttaattaccatatttagaagtagcaaatagttaaatggcccattctcttttttttttcatctccttcgatacatggaatgtgcttgctattgagagaatctgtttaatgagaagacgaaccacatcgccactgagccgtaccagagtatggacgctgtttgcgaggcacatccacacatcggcgctaatctccacagcgtccatcctagtttcgtgaatctaatctatgatttacaatttatttaactaaacaattattaattaccgtatataaaaaaatcaggagaatatcacagttccaaaatggagcttaaacattggcatccttaatatccatgcttccttctgaatcattctctaaattcgtaaatgccaccaaacaagatatagggcctttcggctagcactacaagatgccagcacggttcgagcctcacttctgggtctgttcggtggcactggctgcagcagctgcgcagcagcatcagctacagtggctgcagcagccagccaacagctgttgtaccctgtagggcttgtaggggagtagttttttctgtaggggctacagcagtttctacagtcgaacagctgggctgtgcagcacagcccaaacagctgtgaaaatgggctaccgaacaagccctctctcactacgagagatcagaaggagcgtgtttaacgttcaaaaac

SEQ ID NO: 102481 - DNA, 2568 bp, Oryza sativa
gttctttatgaagatatacaaggaaaccctacatgtaatgtgatttgaggctagctttctccaatgaacggttctttatgaaggtatacaaggacttaaccctatatgtaatgtgatttgattcaaattatttttgtttaatagatattcatcaacaaataggaagaacatcatacttcatgggcataccagtgattgacttactgaaatcactatcatgtcataaactcatccagatggcacacacactgaaaatgtgacccaaacttctccaagggttgaatattaccatcagcattaatattatagtgatataaattgttttccgcggtccgatttgtaccatgatgaaagacataccacacaaatttaataaatgattctaaaatacgatgatagctaacacacattagttgtgtttcaatctggccccgtcgtgctaatttttttgtcgtgtttcaatctggccctgtcgtgctaactttttttgtcgtagcttctcctcttcctcctctaataataatttactaaacttttaaaaccgtaacgtatttaacatactaggacttaattaaagtaagtagagagataaagtaagaaactaacaaagtataagtagagggatcaaagtaggacattgagacacaagttagaactcgagtatttgtagacttaactacttgaggttaaaatataatgttttcattttgttatcagcttgttatactgtatatattaatctaacattgattgtgcagtgcacaaataaaatctccctcaactgttaaatgggggctaatttatcttccttgatggttgtttagattaaattttcgatacattgatttggttatcattttatatggtggccacatagcgtttacatattattaccgtaagttaaaagatatccatgtagttattttaattaatctaaaagtagaccatccgctttcaaaagtgtttcttctcattaaaaaacttaaaaaaaacaaaagaatcaacagtgcattaatcctcttcccccttaaaaaaattattcatgcctcttaaaaactatgtcctaaaatatatctctaaaaaatataaaaacctaatacatcataaaaaatcattttagaaataaactaaatcatatttttatatctagatcccattgtaatgcatagccatttaactattaaattgtgaaccgcaacacacttgaatagtatacatagtgcactatgatcattggattcataacaattgttaatctctaatttatccataaaaaatatcattttatatcgttcaacattattaatctttatagcattctaaattatgtttagcaaaaatatgtttccagttgttaaaaaactagtcaaataccttatataaataaaatatcattaacaaagataatattgattatttattgatgtagaaacatagataatatatattacagagcgcacacacacatgagcagctgctagaaactcccccaaacagaccctttcgtatgagccctcaccggcggatcctgatccccttcatgcttccttaatggccccacctcctatacttccccctccccttctttggctcgcctccatctgcaacatcgggctcctccgcctcggtctctgcctagcggcgcagggggctcgccctcaaccagtcgctcgaccacaccgctgtggcaagcctggaagcagcagaaggaggcgggtcttcgttgataacatggtaagaagaaggtggaggtggatgtggatggaaggagtaggggggaggaagcttcacatgcaaaacctacattttttttactggcaatgggcatgttacctctacaacttttcttttattttttagagaattgctacgtaagccccatgtgtggaccaattactcacgataaaggcatgcaagcaccatataggacaaagcaccatcaaaactattgaaggaaacaaaatgaaccggttttattacttgaggaagtcacactatctataattggggatgcaaacttcggccaatagttttgggaggtaaaatatatttctttcattgatttttttcagccaattcggttaaaggcacccttattttatttattttctttttgttgtttttgcaaatctccttgtttttattttaattatggaaacatatatattacacctcaactatcttgtttatctataactagggatgaaaacggatcggatacggacggaaactagctttatcatattcgttttcatattttttttcggaatcggaatcggaatcgaaaactcggatacggaaatgaaatcgaatattatcgaatacagatacagagcgaatacgagacggaacgaatacggtagcggatatttaccggtatataaaaaacccctcaaattgagtttcttgatcaaggaagagatatcgcttattattttagttcaacatctccaacatttgtatcgtcaattttatagacggtcccacaaccctatgtgagaatcgattttcatggctattcctcttagagatccatatgcaaatatgattatcattttctattcccaa

SEQ ID NO: 102482 - DNA, 1405 bp, Oryza sativa
tcatcatcgttgccgtggcaaccatcgtcatcgtcttggcagccgtcggcggatccaccttccggccacgggtccgccgcaacgcccctccctgccgccggatccacctcctccaccgcaaccacccctctcctttgcctcctgcaggccgaatctgtcatcctccccgccgcccgcagcccaaccctccccgcaccgccgcagctccccttgccgccgccaccacccacgattgagggagagttgggaggggaagggagaggagaggtggtcggtgtatctcggaggtagggagaggtgaagagatgcggcggagaggaaatggacgacttggacgtagtctccacgtgatttatgcctcccacaatttttttatggtgatcgctcatagaccccgccagtaaaatcgatttttactagcggggtgctcataagacatttttattagcggggctaggtttttagtatctcctgtgattttacaagtgaggttttttagatccattagtaaaaataaaacccttgtatcacgaaaataaatcgttttttaagtagtgtatgtatagctagctaattaaggagtcactttcctcgcttcttgctagctggggaccggtctgccattttctctggtcagtttttagatttttatttggcatttttaggagttttgcgtgaggtagattagggtttatcgtttaatattcttatggaggtagatttgtttagaatcttttgtctctcttacctatttgtcgattgccactacatttacgaggtcctcaatgaagatccatccatgaaagtttgtttgttggttgccgatgatccaattgacagaacagggtttaaggcctagaccatcaatttgtttggtgatgctgtcttataggtttgtcaaatgatcgaatatgggggtagatacttgttcaaatactcttccattcttctttatatatatcacgtcagttagttcatatatttagggatggaggtaatatcttttacgcatacccgaagtctcggtgaattgatgcgttatgtctgaacacgtctagctactcatgacttttacttgacttttactaggatgttactagggccctatttagatcccaccccaaaattttacgccctgtcacatcgaacgtttaaacacttgtataaagtattaaatataggcttaaaaaagttgcacatattacgactaatttgcgagacgaatcttttgagcctaattgcttcataatttgacaatgtggtgctacagcaaacatttgctaatgacggattaattaggcttaataaattcatctcgtggtttactgacggattctgtaattagttttttttactagtgcccgaacaccccatacaacaccctatataatatctgatgtgacac

SEQ ID NO: 102483 - DNA, 2609 bp, Oryza sativa
gtacttacgaaaccagtcccttcaattaatatcaggatcaatgggctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagttttcgcacgaaacacaccgtttagcagtttgaaaagcgtaccacagaaattttaatcttcatccaagtcttgttggagaaaagaacgaggccaaagcctgttttctaaacattaatcatcaaaccatgtttttttttttgctaaaaccagtttcaaaaaccttgatcatcacaccgtccaacatgcttttccaagtttccagcgtctagtcaactttccgggttacacaaatcaaacaagcttttattattattttttgtcaccagtttatacagctcagtaatttacacaaatcaaacaagctttgaaaggatcaaagctcacagttaagcatttacactcgtctaatttggtccatttcttcaatccccgccattaatacctttgacttttttttaaaaaaaaatagacttcatccttgatagtactttttaataaatcactggagggatgagattcctcacaataattttccattacaaaggattgaagagaaacaggattctttgaaacaatataatttttttaaacaccaccataattgattggccgcgttataataagaagagtgcttcattttagagaaaaaacaataccaaaccttacaataaatagttgataacaggaaaactgtgctaaaaccccagacacgacctagctttcctaaccaccaagaaggactagcaccatccaattggacgactccgacttccccagaaaaatcaagggaacaagatgtcaatagcccgaccgataccaacttctaactccctggacttaggaactgctccctccatccataaatatttgacgccgttgactttcttaaacatgtttaactgttcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtggg

SEQ ID NO: 102484 - DNA, 1512 bp, Oryza sativa
tggatgaaagagttaaaagaagttagagctcttcctaactctccttcaaaatcttgagatgattgtgcattccacaagaattttaaacaaaaggttagggttcaaatctttgtttttaatagggattttattttcgattatggttaaaatacaccaaatttcctttttcttttacaaatcaaaggtggcctaagtgccgggacaattgaatttggatagtggtatatacatatactgtaaactaggaaatcataatgttttagcacttcctgaagattgatcagattttttttatggtctctgttcatctctcgaccattaattattcgttggtcgtcccaatctaaaagagacgtcaatattgaagttctcgagccccttaaaatgtccctaaacaataaatagtgtttcttataaatgtagtatattattccttggaaaatatgactaacttagttagaaatttttttaaaaggagagatatcattataaacgaggtaaattgaacgttaccaatcattagaggtataaaataagccaaaatagtttggggttgcttcgagggaataaaatgaatttttcttacaaaaacaaatcaaaacagaaatcctttagaaaacttaattatttcaggtcggcagtgacaatgcaaagcatacaacaaacagctgtctgcagcgacagtcaaaattttggcttttttagaaaaaaaaaaacgtgttcctttaattttgagtggtaagagtcatgggccctgtttggttccatgggctaaacattagcccccaccttttagccatgaattggccctcaagtatccaaacatgtgggctaatttttggttaaagtgaattagcctccctccaaacattagcccctccaaggggtgctaatggggctaattttgcatggggaccataaaaaggcagccctctctctccttctctctcctctctttttactctctctccaccttttagtcttgaattagcccatggatccaaacataccactctgggctaatgtttagcctaccaattcatgactaaacattagctctcaaaattagccatgggctaatcttccaaacaagcccatggaatagaagcttctttgccggcaaattaaatggtcgttttcgcacacgtgcaaacgatgaatcacgtatagtttataagttaattactttcttggaggtatgaattaattattgcataggatcgatggcgtggtcgttgttcatgagaactgagaaagtatgtgggagcttaagatgtgtctagcgtgttacacaggcacaaaaggtatcgtttttggcattgtaaagtaagtaagtcataatttatattatgacacctaatgtttgtaccaacatccaaaaactattgcataaggacaagggttagcctctaccaaaatttaaattttaaaagtaatatattttatggtattttcaacgtagattatttttactttggatttttaagttgctaagtactcctacctatagaa

SEQ ID NO: 102485 - DNA, 822 bp, Oryza sativa
cttctccttagttttacatcactagaagcattgttatttatttcaacttgatctgttgtagatgtgttggaggcaccgacagagccaagctcgctcggggaggaaattaatgggaagaggaaatttatctttttctcccttcatgtgccggccttttgcttttatagttaattggatccatgccaaaaatatatcaattcagaaaaatgccactactatatattcaacacatctgttacgtgccactggaaattgggaaaactagaaccgtgccactccatcatgttatccgtcaaaaaatttgttagcctcaattgcaagtgggacctagctgccagttcctctcttttctttccccttcctctctctccaccaccgtagacggtggtctcgagctaacggaggaggacaagatcgagtgctctgacgacgggggcggcatcccggcagccgcctcgggctcccgtgacagctgcttcggactccgatgacaactacgaggaggacaagatgcagtcgccgtcatcaaccccctccgcagtgggaggcctcgggacttcctctctctccaccaccgttgcagccgccgtcgttgaccacctccacggtgggaggcctcaggagccactgccgtcgacgccgtcgtcttcgaccccatctgcggcgggaggctcgggagccaccgatgtcaccgtcgtcaacctcatctacgggggagagctcaggagtagccgccgccgtcgctgtcctcgtcgtggtcatcagcgagccgcaccgcctccgcccagatcaggcgaggagggccgccggcgttgtctatgg

SEQ ID NO: 102486 - DNA, 1775 bp, Oryza sativa
tgcaaattagtctaggaatgcttatatagtggtacaaaatttaaatacaagaagcccttataattaggaacggggggagtatcacagtgtcgtttctagtagtacatcagtacattagtagtctacacgaagatgttcaagtgttaacagatacatcaatgtgatattgtttctttttgctgccctttatttcagtctttttttttccatatgttcagtttagttgttttgtaattgtagcacgtttgccgtctgctataaaaggtggatttctaatattttttttctttttattctaggtttgccaataacatttatatatcccttcctgtatttcatggtaagtgcttctcattttaaaagatcaatagaaacaataattttcttatccacgggattgcattgcaatgtagttaggagcttaggtatcatagtggctctgacagccagctaacagccctatcacttcttcccataaaaaataaaccttgtacgagatgtgaaatatcataatactacaaatttgaacataaggttatctagatttgtaatactagatttgtaatactaggatatataacatctcgtactatgtgtaatttttataggacggaggaagtgcttgtctcagtctcactgactaaagaacgtagtagagggcaaagaggacagtggcagcagcatatatgcaaagggaggctagggtggggtgatagggaggcgaagtagagtgtagaagaaaagagcccaaggagataagggagagggttctggctggtggagactagagacaaattagggtttaagggtggaaagtatgttatataaacttttggacaacaaatatgataacacttaaatggggacaaaatggaaaagattattatggatacgatttttgcttagaaccttatgtgataatattaattatggttttcaataaaaaccatctaaaaattatatttttaattatgttttttgaatagctcatgtgggaaatcccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgcatcctaaagactaacatgcaagaatgccacgtcaactcaataggtacctaaagctcaacatgcaactatagctattacatatacaattttattacatcctaaacctcaacatactaggatgctaaattatcattcctcacataatttttgtaatattaatttcaatccaaaccaaatctatccatgtcattgtcatgtggggcacggcctatacacggcgtcgccgggcgcgagatgtgcggagagctgcggagcgagccgcagcgcgtgtcgcggcgcagagcgcgatcaccatgaccgtggatggcaaggacgggctcagtggctaggatcggagtagccttgattctaggagggtttgtttccaagttgttagcgtttatttccaagttagttagccggagggctatatactcttgtaccgaaacatttgagaggaaagcatgaaagttatcgtctaatctccctcttattctgttaagccactagctgaggggtataacctcgcaggtgaggactggagcgcgactacgagttacgtagtcacggcccgccgtcgttgagcgcccaggcgcttgaca

SEQ ID NO: 102487 - DNA, 738 bp, Oryza sativa
tatattcaggcctttgccaaaagcatttttctgtgaaagctttttgtatgccatccgtgcatctctactagtttccagttcaagaaatgcaaaaccacgattacagactggattatttgaatcagacttaagtgttacagaatcaatgttctcaattccaattttctttagctgcttgatgacctgctttgaagagcaacatatgagaatataaaaatgaaattcaggctaacacccaatcaagtcaatcagaacacaaaaatgaaaatgttactcacatcttcttttttccatttcttgttgatgtttccaagaaaaattctgtcattcccaactggaactgcagctcgacagagcttcccacaaatctgtagcagagtttccataaacaaaattggagaaagaggtgtaataagtactattcattacagcaatatgtgggactagaagacctggtctatccaaaattttcacaagaaaccatttttatcacagaaaattggcactgcataataataaagcaaccaaatatatacgaaatacatgtagaagtttatggatttgtgctatgatgagtcaaccataacaaatggtaaacaggataggaattaagatcaatgtggcatatcccattaggggatgctggatcaactagtacgacctgactcaataaaatcaatcatggcatcgtagagagaagtcactggtccatttgacagtggaaaatttttaagctct

SEQ ID NO: 102488 - DNA, 1080 bp, Oryza sativa
ggtggcggggtggcggcgtggcgaggggcgggcgtgaagaggcggcgcttcttggggggcatgagcgcggacggcatttgcagcgacggcggcggggagaacggcgaggcggcggcggcggcggcggcggtggcgagatggccggggacgcaacggcgcgtcggttccatcgcgtcgcgtcgcgccgcgccgcgcgggggaggacgagtttttgtgtgctttggtggaggggtttccgaacgaggcgtcgctgtcccgtctcctggtgcgtgtttatgcgctgacacatgtccatgtgcattttctttcacttaaaaaaaatcttttttcttgttatattactctctctatccgaaatacaaagaaatgagagagaggggtgcatatcccaataccatgaatctgaaccgtactgatactcatcatgatatgttacatccctccaaaatcttttatattaagggacgaagagattatgaaccaaatgagtttcggatttgctaaaatgatgtcgccatattttatggctaattatagttgaatttctgactatctgatgttgttcggtccacctcggcatctctcggctatcataacatgactaattaaaacttaatatgattcattagttcaagcttttgatgttttaacccacaagtatctaatatagtagatattatatcaatatgtgtaatttacaatgcaaaatatagaagttgcattgcacttacattataattacattggacttacatatataattttagaacttacattatgaatacactaaaattacatatgtaatttagatacttacaatgtaaatacatattgattttttttaaaaaatatggcaccataaatatagctactcccatgagttttcttcccaaaattcaaaactatgaacacatttagtatttagagtatattttactgtgtcacctttttattatcaatgtttcgctttggatcacactttaaccattgttttcacttcaggtaatcttacctttgtttcattttggatcacctcgatactcttctaatgcatataaacgatttcgagtatgccagctt

SEQ ID NO: 102489 - DNA, 1165 bp, Oryza sativa
cctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagataacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgccgttgactttttctcatatcttttattcgtcttatttaaaaaatttaggaattataatttattttgttatgagttattttatcactcataatactttaagtgtgatttatatcttatacatttgcataaaatttttgaataagacgaatggccaaacatgtgagaaaaagttaacggcgtcatttattaaaaacggagggagtatatatttataggtaactaagggtattagcttactagattaattatagataatttgaagctaatagtagattgtattattaaacttgttcctagtccatatttgttctggagtactctattagtcctgaaaaaaacattctagaggatgaatctggataaaggtagtctaaattcatccttataaagggtcaggttggttttttttactagggagtaaagtttaatcttccactttgaccatgacagttacgcgcgggtgacggttacttttgcgagtggggcccaggtgtcatacaccgggggcagaggcagcggtggcccacgtgggccccaccggcgggcgtgcgggcagcagacgagccgtgcgggtgcactcgtgccgtctcgggagccgcgccggccgtcccatgacgatggcgtgcgtggctgcgcccccaccaactctttactc

SEQ ID NO: 102490 - DNA, 2855 bp, Oryza sativa
ttttaaaatatgtttatactggctattgtatatgctcttaggttgagaaaattttacggtggccgaagaagaggcaggcagtttgatcggcgaatccaaggtgtgtggggggtggtaaaaagttaacgcgaggaacggtgaaataaaaaccaactgtagtgctgttttgcattgcgttgcgcctcgaccatggaagacgagctagcgtgtgcatcgtgcttggtaaatttatgttagctttgaagcaacgatcacgcctttacggtttgcgaaacacacgcccggggtcctcgatctacctcacccgctcctcaaactgtttctagcaacaatcatccaaatcaactgtttcttaacaagccggagtatgtcaattcgagtgcgggcataaaaaaggggtaaattaaatagtattagaaagctggcttagaaattctgatgatgttcgtttttaatcgcatcatttaattataggtttgaaaaacatgcctgtgataatccggtggtcattaccagggttcaccgaaccgttttgggtggggttatcgccaccccacggtttggtggttattgtagtaaaccgcacgaaaactatgagggattgtagtccagtttcatttaaaatttgtgacataaatatattaattttagaagttatacaaccaatcagactaaggtatatgtatttattggaccctacgatgtagaaatggcaatattaatgaggggcgccatattcatttcttttcactactaatttatttaagaattggtagaaataaagtgtttgttagatgaagtgggtaaaatagaagcaacttttatatttgaattttgtgccaaatacaagcatttcattttgtacctatcccatcaatcatcgttcattcaatttgtttctcatattatccctaaccatacttccaacttcaaacgtctcttatttatgtttttttttccggaacacaatatggaacctaggtgttggataatgactcaaatatattattagtcctaggcactagtttaatatgtgcctatatataagggtcacccttatacatgtaatcctaaaccattatagttgattttgtcttccgtggtttttcctctttacattagaggggttttccgcgtaaaaattcgtctctttcgtatttttttcctaacactaatatttatatgtgtatacatactaccctctattagcatctccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccattttcttaatgtgcatcaggggagtaaatataaataattaaggacgagtctggtcatgactacagtgcatactctctcagtaaaaaaagaaaaaaaaagtaagtctagaactcgatgtgacacattataatagagtgaatttacgatgtgtcatatttaatagtgctagattggtttttagggacggagggagtatatattaccatgcaaaacttttgcattactaagtttcgatagctttctttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtaccaccacaagaaacattcaaatgagtaaagaaaatttatgtgttatttcattatcatttttttttaaaaaaatgcgtgagctgactcgagaaagagaattgagccaagacaacggccgagccggccagccagaacaacgcaacaaaggatctgtttatatctcatctcaaaattttacaccatatataaagtattaaatataggctaaaaaataactaattgcacagattgtgagtaatttgtgagacgaatcaatcttaaacctaattgctatatgatttaacaatatgatgctacagtaaacatttactaataacggattaattaggcttaataattcatctcgtggtttactgacggatttagtaattagtttttttaatagtgttcaaacaccctataaaatatccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttcc

SEQ ID NO: 102491 - DNA, 1012 bp, Oryza sativa
gtagaagtattcaataaggcaattcttgagcgctgcttaaagttgtataatgaaagaatggaaagagtgggtctaccagtatcagtggataaacttcagctgattcacaatttggcagaagatgaagctagaaagctctttgacaagcagcattttggtaaacatcatactacccgatccatcctcaagcttgatgaagagatgagaaagtttgcctgacaataaatattcatgcgtgtttaatgttgtcttccattttcagataataaaacgacgtcattgatgcaatttttatgttgtaatgaatatgaatatggattgaagtatatgttataaacattatatcgaactgagatgctatggtcttcagttcttcacataagaaacacttgattcttcatattctgtcataaaattctattattaattactaatagccataaatcaagtttgatagttcattgtgtagtggtagtacatcttttgtgtagcaacaagttggatttctttccatgccttttgtgcttggatgctttgttttgaacacgaacgaattttttctttcagattttatagggtatctctggtgagattcttacatttgaagcattccatttaggaataaaactcgtttgttgcttacaacctatgcaaaatggataatatatcttcaatgtgtttaactgggtattctttttaggtcttcggaaactttggttttgccaatgagtaccagtcatcgaagctgtgcaaagcaaagttttcagagtgtgaagataaaatggaacaccttcaatccttgaagcttccttcgatggcaaaatttaatgctggatttcttcgctgtaaccagagttttgaaatggagtgtgtggggcctgccaaggaaagctatgaacgtaggatgtcaaaggtccgtctcttttaacttgagacattttctatgatgggaaagaacaaatggattttgtacccacttaaaattcagatccatttagggataatgcagtaa

SEQ ID NO: 102492 - DNA, 907 bp, Oryza sativa
ctactacatatgttgtaccattagcaagttaaagaaacacgcacaccaaaaaaaaaaaactgactcggtccctatatatgggcaagtggtactcaaatgaagtagtatatcagtcccaacttctttcaggacggtaatgatagcgtttcattttactggggagctgattcttatcagtgacatgacactgttgaatctttaaagggtgtggaatctggatcgcttcctctctacattcctttaaggtacacactaccaatcgtgcaataggatctgcaagtattgttataattaggtatctgctccttattaccatgttaaacctcagtaacttgatcaggtttcttcttcacaaccacccctggagaactagcttccttagatgaggtgaaaaagccaatccagccaactggtcgtacaagtgagatccatctggtgcagcctggaaggttgatggcttgatacagaggtaaactagcattaattcttatagttaatcttttcagcagtactccgttattctgtcatctaccctatagttcaccaacacagtgttacattcatcattcctcattgatcggtcaggatcgtctcccacagatccgatgccccaggtcgctcccacctccctcacggcctcaccccatcaatcatgcgtcacaaaatgtgctctagcgagagatcattagactagaatagttcatttcggtcatggaactgtacttcaccttctatgttacagtggtactttgattatcaattccatttggtactcatgccgatccagatttggtgcttatcattttcatttggtactcatgcttcaataattcttgctttgatgaattgttgctgatccacatctttcatgattaatgtaacatagtctgtagtagcagtttaaaac

SEQ ID NO: 102493 - DNA, 2001 bp, Oryza sativa
catggggcgtcctgatgtgtaagtggctgcattgatcgttgatgcatgcatggactttgttttgtagtgttggataaatttaggggctatctatgcatttgttttcttctgcattttttttcttctttttatgtttgtgtaggcctttatggttggaactttgaaatgttgtgatttatgttgatgtgttttggagcacctttcagaattataggagcggtgactgacaggtgacgaagaaagtactttaggttcaggtggatgagatgaactgaccttaaatagatatgtagaccccagtgcattttctctcctcgtagtttcatttttctcatcgaggctatatttggaacacaggaactccatggaaattttggggggaattgcatatatcagctcatttcctataggaaaatgggatcaaaacctcacaaacacatcattctagtgggtgatccatagtaagctgaagttttatgcttctgaaaattggtagaaatgcgacatcgatgcattctcaataagaatttctcgattttattagtttccttagtatattgagtgtatgttaaaaaggagccacttttgcttgtgtgcgtggtagagtgtgtgcatatgtatttgtctttcatgcaatgaagaaatgaggggaaatggccaatattgtccttgaagttccattccaaggttagtctagtccttagcgtttttatattatccatacaagtgtttaatatttatcatatgacctaatatcgtccttaggcccacataaatgaccacttgcgcgtaccatatatcctcccatgcgaaaaatgatgatgaaatgaagtaaattggacccatcatatatagattttgtatgggagatgataatgtgatataaccgtggtgatttcgatggcgcaaagggttatattatgtgtcatgataaatttatcggttcatttggataatataaaaggctagcgactaaattaacctgagctgggacatgctattctcccaagaaaaaaaaaagagtcgatgacaatacactattttactgcagattgacaagatatcaacgttaactacaaatgcagctaagggttcctttggaacgtaggaatacaaaaacacatgaatagaaaaaaaatgtggcgaatcgaggtgacatgttaattgaatcctttggaattgtaatctatagggattgttaaaatttgctgtttgggtccataggaaaagtataggattttaggagagaggttgacataacaaagttcccgatgaggtccaaccttattttagaaatccttcaaaattccaatgaatcaagccactccatatgaattttgtaggattctcaaatacccttccaaaggagcacaaaggaaaattttccaggggtttctaatcctacaaaaatcctctatttttcctttgttccaaaggagccctaaacaaacggcatggctggtgagctgtatacactttaatcgtccatggatgtacgtacgtttcaccgtatttctacttatttttctgacaggacacatgtacgcattcagtagagttataaatatgtacttgtacaataactccatgagtgctatactagctcacgagaaagctcgaaatggttagcttgaccagctagctagcctttttgtcagttttttctagtatgtagtccctccgtcctttaaaaagaaaaacccaacttaaaacttggatgagataaaatctagcataacgaatctagacaggcttttaggttgagttttttttttggacggagtatatagctagctagctttaaattgtgccagcccatgctgctgtacatactgtttgtatattcaacactccttgtgcataaattaaaaatgcaaaaaaaaaaagcaatcttgattcctgtgagaaataaactgaaatttgtagatagaacacatgaatttcaaggatgagttctatttataaggttggggaaaaaatcatacggccttaaccctaaac

SEQ ID NO: 102494 - DNA, 764 bp, Oryza sativa
taataagctgttttggcatataatcagcttttggccgattgatggggctgtaactatgatgcattgatctaatgtatgaaacgcattatacttcacagtaagttaaacaaaccaatattgttgagtttattcatcgacattttttttaataatgtattttataaaacctagcctctacaccaatccaacatgagtgtatacagccacttgtgcatagacattactattaattagttagttcatatccagaaaccagtcaatcaagcagaagcagatcatttcagataagggcttattttaccagggcatgacgccaatgacggcaggatcacactaaaagttctgaatttcttaagacagattagcaaaccagttgtcgacaacgtctttactcagaacctgacaaggcaaaccatgtgtagagaactagagatgacacctctatcaaaccagagttaaattaattaccataaagttaaactatagttatggatgcgtcacgcatgctcaaactaaaatatcctatgtgaaattgccaaaaaaaagtatattaaattaattataaatattattgctacacgaatggatgtgataacatctctatataaataacaatcaattaattaccattatcaatggacgtacttgtgtaagacaaactccccaaatatatgatttggtgtaaattattaacaagatgagatcgtcatagaatatgccaaacttgtactacattaattaattaaactgtctacaaattaatg

SEQ ID NO: 102495 - DNA, 823 bp, Oryza sativa
ttatccttttgcaatcttgtggagtggcatattatccgttttctcaatcaaacataccaaatgcccagccccggttttaggtgggcaatccttttttttatgaattgtttttcaatttaattttaggggctttcctagttgctttagggcctgtttgagggagcttctagctactgcagcttctcaaagaatcagaagctcccccaaacaatccagcttttgatccagattctgataagttgtagttgtagaatccagaaaatgaattagaagccataagctggaaaacccaatttttctagattctaagaagctggctatcaaccagctgcttctcagaatcttaagctccgcaagcaggccctaagggttttcctagttgctttttcacggctctccttttttcagtggttgctacttagacgttttaagtttgagtaaatttattgaaaaatttagcgatatctaaaacaccaaattaattttattaaatctaatattgaatatatttagataatatgttttggaaatactattatattttatataaattttgtcaaactataaaaaaaatcaaaacggcttataaaacggagggagtaagaagataactaaagcaaatatatgaatagacctattccaaaagaaaatcaagctacaaaattcatttgttttggactgtaatctaaaactagggccaacagggctctgaccattctaaaactaaggtatggcaaatttctgccataggcactcggttttttttcttttcaacttgtatcttcactaagaaatcaacagggatatttaagattatttttgc

SEQ ID NO: 102496 - DNA, 637 bp, Oryza sativa
agcatatatgtatgacatgtgggcccggaatgtcagtaacagggaatcctgaaaaaaatgcagctatgtgataatttctaacactaatgttgcagttttctgaaaagtggcgcaaaggttgcagcaaagtaatagtttagtcaataaaagtgcagttttctgaatttactcaaaaaactaatatttatgtttttactctgtaaggaaacaagaaatgttgtatctaaataaccgatatattgatatctatccctaattaataattattaatatgtctcttgcaatcatggtgattactcaatttaataaacccacgcaacgagcatacggcatatttggaatctttcgaggacagaatacgacacttatccgataagggttttgtgaccaaagccaagacatagatctctaaattctccctcttttgcacttcatgttttttgaaaaggggaatatcattgcttactcctggccttctgtggtggagtgtgaggagaacctcctcctttcccctgtgatgtccccctatccaagaactaaaaggcaggataaagccaatggttcctttctcttgccaaagatttgtgcaaatcaaatctttctaccacctgtcctaactcctcagccttcctcaggt

SEQ ID NO: 102497 - DNA, 744 bp, Oryza sativa
cacgactctggatctaagtaagtgatatttgcataaaaatatgcacagtaagagtataaaataggaaaaccacatccatttcaaacacaaccactgaaaagcatttgagttttatagttcaggatgaaaaatgaactttaccgccaaattaatgaggtcaaaactacacataatataatctagacgggaaaggttgctgcaatagattggcatgtaagaattgtcaagttgtatgtgcactccaccaaattatctatttgttccacccaaatcacatctgcaaacaatttatttatttttggcaaaaaataaagggaccttctacatttatgtcaaaaaattttcattagcaaacaatcagaattccagccatatattatctctgtgaaattcacaagttacaaggatatttattgtaaatttcatatgcaaaatatcacaatgaaaagtttacaggtatctgctgtgctgtaataacatgacatcaagaatatatggctgaccaactattaacctcggttcactagaaaggcacctataaaacaacaatcataaaaatttaaatggaattgggcactgctatttgatccacacgaattgcttgtttatcgatccagcaaacactacaacaaaaatgcactgtagagacatctttttaatactatagaaacatttttaaaatgcctctacaatgcaatggaggcatttttcaaaataccttttggtgaattatctctagaagtg

SEQ ID NO: 102498 - DNA, 949 bp, Oryza sativa
taattaataattatcatcattttttatatatcatctcttaatttctacatatatatttgttactaaaatatgagtcctcaggtttgaacctatattatccttttctttctcatcacaaaagtaggaagttgacgatgggggacggtaacatgtggttcatttggtcgtataatatcatttccatagaaaaaaaaatactggagagttggtgatatgatggtatgagagtcaaattaagcatacacgatcactgttcctttttaaaggaatatagatatccgagaatagaaatgtatgaatgaactattataaagttaattaatagctatttaaaaaatagtttttacgaaacttgtaccgtttagaattttaacaaacataccccccatatttttcatccattcatgagattacaaccggatggaatttggttcccaacatgcaaactattactatacgtacgcggccagctccatcgcgtaggcaagcatatatggtggcaatagctatcataaaatcacaatggaaaatatttccatgttttgtgttaaagttaaaagaaattattgtaatctaaagtataacaataatgtaacattccaaatgtatcctaaaatgtactactaccaaacttttcgacatcactactacaaaatatcaaataggtgtcgccactataggcttttttccacctccgcggattgaaatcacaaaaaaaaattgacatctttaaacaattataagtgtcggttctaaataaaaaccggcacctattaggtgccggtttttataaaaaactgacacctttaatatgtcaaaaaccagcacctattctaggtgacggtgggaggcaagtggcccatgccccctcagctgcgggaggcggcatgagacggttggatgaggtagcctgcgcccctcagcggtgggaggcaggcggcccgcgccc

SEQ ID NO: 102499 - DNA, 1094 bp, Oryza sativa
cagcatctctaggttaaatgaggaaaaacaaaaaggagaaaatttaaagtaagcacgaacaactctacattatttaagcatggcatatttcatacatttttaatatagttccctagctgtttgatgaatgaatttcaattttggtcagaacacatgcatgaagtaataaagggaaaaaaattacagagacttaatatcagataagagatgatcaaattgtccatacctgacaataatggcatccaacttatcatcaataatggatgggccataaggatcctcaataggctccacttgtactaccagttctggtttaacagactgcattttatacaaaaccaatcatgagctttcaacaaacatcataattgagcatcccagaagcagcagtttcacttttggcagctcctcctaagtatgaacatgcttaattgggtatgtacttatgtgaaactgataacccttacaagtttttttttcttttttttgcggggaataacccttacaagttaagaagcatgcaattccaaaattctatatttttctaaaatgtagacgactaggaacaggtcttcagtacaaggaagttatggaacaaatttcgcagcaagttggtcctaaattgccacataactcttcaccaaaccaattcactgtataacttcttattactcacctaaagtaatgtgccacatgagagaagctaattctcatgcgcgaaatctaaggtttactgaattgtctttgtacagaataaattatacaccgcctcccaaatcaactgaaaattacacctttgatttccttcatttttggaagagaaaagattcatcttgtcacaacgtctcacaaacagcaataaaaagcagctcagtaacttaattcatgcaaactgcttccactagtcatcacccaatgttccaatccttttaggagtatttactaacagaaactatatactacataataaagtaggcaagattatcccccaccttgatgtaatcctccacagccttcatgcgcttttcgacgggctcgatcaactcagcgtactgcaggcacacacacagagggtggaaatcaagaacacaacc

SEQ ID NO: 102500 - DNA, 1167 bp, Oryza sativa
gggagcggcgacggcgagccgacggggtctctccggtgatgtgggctgaggttgccggcgattggccggcggcgcgagaggaggaagaggcgaagagcactttctacttttgacttttaccctttatttcgtttgtttatttgtttctgttttttttctcttgcgaggaaaagaggagaaaacgtacacgtggacggtccagattgactgattgacttctttagaaagagaacgtatacgcacggcttccaacttcttctgccgtggacggtccagattgactgattgactttgtttcctagaactccatccgtcccattttaaacgcaaccataaattttcgcgtccaactttgatcgtccgtcttatttgaaatttttatagtatttttattgttattatatgataaaacataaatagtacttaatatgtaacttatgttttttaatttttttaaataagacggcgattaaaattaagcacgaaaacttggacggagggagtaccacgtagtccaagaatttctttattccacatgaaatgaaattctttatctcacgcttggtgttaaattttttgaagaggaatcatatttttccatcttttttctcggtgtagctctattttttttctaattctttcagtagtaggtgataaatccttccacagcgaagcacctgtaataacttcatcaatctcaagacatattggtcaatctttaaaagtgctaatagggataggttgtaagtgtgtgcatggatagcggtggccggtgggtctgcgcgcatatggacacctatatctatattatgtttagaaaagaaaaaagaagaatctcccacctaaactccgcttgattctcatctctataaccaaacaaggggtgtgttcgctaccaggggatgggaacggtgtacagtgcacacgaaaaacggggcggtacattagcacgcgattaattaagtatttattttttttaaaaaaaatagattaatttgattttttaagcaacttttatataaaaactatttaaaaaacacaccgtttagcagtttgaaaaacgtgtgcgcggaaaacgagtgagagaggttaggaaaagtagcatccgaacacacccaaggtcatcaacttttctcttaatctcccaatcccctttcccaaacacga

SEQ ID NO: 102501 - DNA, 679 bp, Oryza sativa
gcgggcaaactggaggaggcccagaagatccagctctacaccggcgggctcctgccaccgcttagcctccaagtccagatgcagaacccccagtccgtggcgtccgccatgagtctggcacggcagttcaagctcatggccgaatacacgaccgcgccggccaaggctccgggccgcgcgtcctgggcgccccacaagcgcgtccggctctgccggcacccccgccgcaccctgacaagacaccggcggtcaccaaccagggcgagggccgccaggcgaagcgcctcaccaaggaggaacaggcggaacgccgccgccttggcctctgctacaactgcaacgagagctacacccgggggcacaaccgtgtttgccggcgcatcttccacattgccggggtggagctcgacgacgacgccgccgccgacgctcatgaggagccgaccacggaatcgccggtcttctcctgcacgcggtggccggcgtaccgcgcggcgggacgctgcagatcgcagtcaccatcggcggtgcgccactcgtcgccctcctcgacagtgggtcgacccacaacttcatctctgccagcgccgcgccacgcacgaggcttccggtggagtccagaccgcggctcacggcggtcgtcgccaacggcgagcgcgtcgcgtgtccgggcgtcatc

SEQ ID NO: 102502 - DNA, 698 bp, Oryza sativa
gtcaaacatccgatgtgacaccaaaaaattttcttttcacgaactgaacacaccctaaggccatgatatggagaggagaggtcatgtgagatagaacccctatagctttgagagctgggaagaagaggtggcatcacgtggcctgttcacacaatggatggaggcatttgtcgcgtcgatggctgctcacacagggagggaccccctaggggtgtgttcggcacctccttttcccaactcatctctctcgttttccacgcgcacgcttttcaaactactaaacggtgttttcttaaaaaaagtttctacacgaaagttgtttataaaataaattaatccatttttggaaaaaaaattagctaatacttaattaaccacgcgctaatggactgctccatttttcgcgcgtattgttcccggttggaaacctgtactaccaaacacaccctagggaggcatatgaggagtgaggatggtagcaaagcacctacgtgttagggcaagtactataatacttgatgtgttgcacctgaaaatgtcacatatatagaattgaatgatgaggtagaagaaataagtgagaaaagagaaggtgagccacccctcatgcaatacaaggggtaacctccacacaaacccaaaaaaaaagagatgaaaaaaaagatgggattggacaacactcccgcgtcattgagtgc

SEQ ID NO: 102503 - DNA, 1995 bp, Oryza sativa
ctaaccaccacctttcagttagggtttgtaaaatatattttctgtatacatggatataaatgcatatatataaacaatattggccacatgagctctatgattttagtctatgcatttagggccatatttaaatttttggaagtttttttcgggtccctagtgccagccaaccaccacttgagatcttaatcatacatagtactttctagtcttttgctaagctattctcattttgtaataatttgttgatgagctagcttttgtaccattttgataattttgataattaagccagggccatgtgtaaatggatgctgctcccaaagtatcaacaggtcaagcatttggatcttgcatggaaaggtcttggtgatttgatataatgaaaatgtatttagttttttatttgtctgattcctaagaaattgcttttgaattattattagcattgtcttgaccatatatataattaagcaaacaattttagcaacaagctaggaaagcgagatgcatatgcctgtgaaatgaattctatcacctgtctggtagctggcgtattgtgtatcgtgtgatcatgcattgcacacatacattagaaaatttaatgaatacagattaattaatttgtaatatatagctggcatgtagtacactagtaccttgcagaaacaaaaatatgtatattagtatataacatgtgtgtgcaggagatctacacgtagtacatggcgtgcaaggcttgcactacagtttttatcttaactaaaaggtataaattattggagatgcatgcatgatttaataattgattaattagtggagtagttgattggatcactctttaaaattatactgtatgtaggatgtactatacgtatattaacagttgttatgttgtactaatgtactatataatgcaccaaatttggcacctcaattctcatagcatgtgcttgtgtgaatgagttgtctctcgatctagctagctaggagtacgaaaaatactcccattaattaacatcgacaaaatactcccgttaattcaccatctacaggttatactccatccattctaaatatagggtgtagctatatttcttcaatagtaatataagatatgcatccatgcatacaattaattagtatttctcctctaaattcatttctttaaaaattctgtatgctcttgatctctaatcccagtggggacatgcattataggacatgcattatatttagagaacttttacggtacaacatactaccagtatatactggcagtatatagaagggcatgttaagaatttgatagaaaataaaataacactttagtaatttttggttcagattgaatttaattgggagtagccggtcctggatcttatcgtgcactaggggaggagcatcttgagcgccatttgatgatgaagcacgtgacgatagcacgatttgatgatagaataacgaagaaaagataaaattaccctttcaaactttatctgctatctaattaactaaaaaatccaatcaatctacactgttagatcatatatactagcagtatattgtaccgtaaaagtcctctatatttattggggtgataataattatttcttggtcttttaactctttatgttagtagtaacgtcatatattttggagtggagtgagtattaattaagtatgtatgtatgtacactagcatatattcaacaaatataatcaatcttaatgcaaatgataaactaatccgaagctgttcaagctattcttaactttgatcaaactactatatcttttacatgcatatatacatgcagacaaatatgtatatggctcaaattctactacacaacaaataattaagcataagtctatgctgactgagaacaaagaggacaagtaatcccttggctgcatgtgtggatcaagagtacacactacaacaaagtgaggtaaaaagaataaatatactgcagctttgcaagtattgaa

SEQ ID NO: 102504 - DNA, 1330 bp, Oryza sativa
aatcccttatattataggacggatggtgtagatcatatcaatgctggcggcagggcagcttcacccattcctttgggcagttccaagattgtatcacaagattaatagattaattatacagtatatacacaagtactagggaatcacatgttctcttctcactgctaaccagctagcatctgggaccattcatgcatgggatctctaagaaagacactggtgactagctagctagctcctatgaattaatgccaaattatttctaaggtgatatatagtttaattaatttagcactgaaaggttaacctgggcgacttcgatctggttaaaagaaaaggtcgataattaagcaaaactgaaagaaatgagggcaggagagagattacatagaacaaaagtacaaggaagaaagattccaagaacaatgttaagaaaggaaaaggaacaaaataaagaaggatctacctgcactcagtatgatgaggggtcattttggtttgatgccaaaattaccctaccagattgttgtcattttgaatagtagtttagttagtgtttagtttgttacccaaatataccaataagatacataagttgctaaaaaaattaacactaccaaaatttacttatgttttggtattgctaatattttagtatggtagcaacaaactaaacaagtctgatataaacatagtgctcctacatgagagtactcactccggtttcattttaattgacgttttagacaatgacatggtttacaagatatatctgtgactttgtttttctattataatatatataataaataaatacatgtttatttttattatagtgctttaaaagacaaatctatatatgttattttagttcctttaaactaaatatttttaaagttattgatagtcaaagttataaaagtttgaccttaactttgttcaaaataattaatatggaagagagagtatgcagcatcttcaattcattaacctgaggtaggtctatctagatagggagaaactgccaatgaagaagactagcaatagaagggatccgtagtatagctagctaaccctagatgcctagctagctatagctatgtctagacagcagcataggctgctgcaccacaagagtgaaaggctgtggatatgtgttgagctgttgaagatactactacatctcaaaatataagtgtttagagttttaaagaagcttaaattgatcgataatataataattatgattagttaatatgagaaaactattatgtgaacatttaacaatagatggttgtttagttgagatgacaaaagcatgcactactac

SEQ ID NO: 102505 - DNA, 1069 bp, Oryza sativa
ttggattgcattgggagcacagctagctgaaacatttgacagctagctaaaaggatcagtactcttttactgttaatttcgctagatatgcaggagtagcattaggtaggtacaacagtctagtatcacttgtctcgtcgactatctgctgccgtagcttcttccttttgtccggtcaatggtgtgcattccctgcatcgcattggtgtgcatcgcaatagtgttcattggagtatgattgcgcttcctccttccctccccaactataaatatgtttatgttgtttacttcctcaatactaaaatggagtaaggtcgagtttagttctaaactttttttaaaaattttttaacttttttatcatatcaaagcttttctacacacaaacttccaacttttccgtcacatcgttctaaatttcaaccaaaattctaagtttaacgtgaactaaacacaccctaagttcatttttcactcttctcatacatatcaatgcaaaaacaaaaaataatagaataccctaatataactattcatcactttatctactccaaatataactattcactactttatctattcccaatataattgtttcatacttttacaaactctgatacaattattacttaaaagaacttattttggaataaatagatggagctaaaaataaatttattatgggacggaggtagtaacaataaagggttaggagaaaacattttgatgctccttaataaacttaataaagaagggataagtatagtgtgagtgtgatcggggataagatgcaaaatatttacaattaagtgcaaggtgattaataagataagcattcactccatcccagaataaagctcctaggagtattttgaggtaattaaggattgtggtgaaattattctcattactagatggtggggtgatggaaattataaatattatgggtggagggcaggtttcaacggttgctgggatgatgagcgcgccaggtagcatgtgaagtaatggggtaaaaatccccatttaaaaaattcaaaattaaccaaaaaatggggtaaaatttgaa

SEQ ID NO: 102506 - DNA, 1306 bp, Oryza sativa
caccttatattatgagaaatgagagaaaagtggttgtgtcttatattttgggttggagggagtgaatttaagagcaaaataacagcacaaaacataacactacaagtatttgtggccatatgcatgtgtgtttattagtacttggcaagcaaatttttaagggctccttcgacacgcatggttatcaaatacggaaataagaaaaacatgtgattaataattaagatgtcatgccactctatccgtactaaaatgtacgtagctgtttctgttttgcattttgtagctatttcatgttaaatacaattttgagaccgagggagcataaaactatatgaatttctcaaaaagagtactactccattaatttaattggtttataactcgaacatagcgttagtgataaggttttaaacccctaaatatgtacttttgtggtaatcttattgccagccatgtagttttgcgatacttagcattaaacatgtagttttaatttattgttaaatccgtagttttataatacaccatcttaaatatataatccttccatattttaatgtatgacgccgttgactttttaatcaacgtttgaccactcgtcttattcaaaatttttatgtaaatataaaaatacttatgtcatgcttaaagaacatttgatgataaatcaagtaccattaaataaattataattaccttaattttttgaataaaacaaaaggtcaaacgtttgtcaaaaagtcaacggcgtcgtacattaaaatattaaaatatggaggtggtatatttggcaataattcattatttggactgaaatttcctgaaatctactcaaacaaaattatgacatcctacctaggcccatcccatctggcccggcccactccacctccctcacggcctcacctcgatacatgcgcgaataccaccactccccgaccttagccctagccgccgccgccgcgcgctcccctccccatcccctcgccgcgccgcgccgccggggaacccccctacgctaggccagccgtcgccgcgcgccccgcaccctttctccgccgccgggcctgccggcaccaccgccgcgaggcctcggttggtatccatctatctatactatctatatcttcttggatggcagttttttttatcgagatgtgttgctaatggtgctgcgttagcacgcccactcgcgcgcccgcaggtggtggtcgaggacgccatgcccaaggcgaaaagaaccctcatgtcttctttgacatagcgatcggcggacgcgccgctgagaggatcacatttgagg

SEQ ID NO: 102507 - DNA, 1219 bp, Oryza sativa
caacaggtcttgaagagttcaagagctgcacgtggagacaactgcaacgtgcaagcgttcttctgcgcaggatatcctgcgcgcatcagttctctgaaaagagactgcttccttatccgatccagacgagacttgcgtggcgtggaatcaaccggtttccagaacgtccaagaacaaacaggcctgcggcgaagcagtgaagcacccgttctcgctgcctttgcctccgaagaggaaccacgcaggcagcgatgaggtagcgctgcagcattgcaaggcagagctagacctgacatgcaagaatatgtactgcactgcttccctagaaaaaaaatattgttccaatcagtccatattattcctgaaaaaaattcttgctccaatgaaattctgcattggtatagtagtacgtagtactccttgtatagctagcttaattagcaccatacattcatcatggctgatcacaccatttcattgcatgtgtctgtacgtacgtgccatgccgacgcatgggccgtactccgtacctcgcacattactcgcttggacaaattcaggcggtgcggcaggtgcatcgcaagaatcgatcgatcggcacacatgccgcagcagtggtcgcgacgacggccggcgcccacacggcgtgtacatgatacaccgtatctgcgtctgcactggcgcagttcaatggatctcggcggttgccgtacgtctcatcgatcccctactccccctgtgtattgtatgatatccatctatcactaataatctcctggttctacagcgagcgtacagtgcgtacgcgtgcgtgcgtgcatgcatattgtgtatgtgtgtcaagtgcgacgtctccatccatgattaatttgagcggccggtaagcggctacaggattcttccggtctaagcgattagctagccagggacccctgcatgtatacaaatcactcgactagctcggacgtactcgatccgtccatggacgtgaaggacacggtcgaaccgacctactagtagctgctgttccagcgacgacgatcgatcgatcgatgtggggagtaccggacggcttataaatgtgctgcacgatatcgatcgatatgattaatcgtacgcggacgtctggcccctgggcaccaacgaccgatcgagctacagccaagagccagcgtacgtacgatctactatagcattaactgtttccgatctctcctga

SEQ ID NO: 102508 - DNA, 1299 bp, Oryza sativa
caactccactccagacccaactcctagagctaaatttaggagttggagctgtaccaagcaggccctcaatccatgaggagatagatatgtgcttgttatgttatagggcagttcgggctgtactggtccggcccaataggatggcgaataaaccgggcccatatacggcgcacgcatcgcggaaccgggtgctccgcaggttcgctgcctttcgtcgtcacgcacatgacgacatctgggcctcttgcttgacgtatcggaacgccaaaaatccgagaaaattttgagccaaaaaaacaacaggctgatccgctgatgaccctcactgtgaataatcccggttccaatctgggtcaggacttaggactctcaggagagcgaggaacaacacacgccacaccagcggtcgttcagtccagttatacgctcctccttttaagcttagccatcggattgttgtaacggattggattatttactccactcttcgattaatacgatttatctattatattattaatacagctcgaaaaaaagacaccacgttcaccgtggaggctagaaattcccacgttaatcgaagaaaatatgaattatttataccgttggattgtaagaggcatagatttcaatgtctgagatttaagataaacttggcatgttaattaagagatacggagtacagtacgcgtgtagaattagaatcaatctctagctaggacctttatatgcaaacggactcaaaagagttttgtccgatttcctaaaccaattaaccaaagttagagatgaattaggctataatatacatatataaataaagcagcgggcaacgaaccactgtagaaccgtaatttggatgcgtttttgttaatatgaagatagatgctaacggcgagcgatggaaatccgaagcagcgggtcaagccgtgcggctgcacagtgagccgtatttgggtgatgcacacgtcagcaaccagaaaagcatgatggcatgtgcacggatttttatttgattttgaaataacacaataaaaaatgaaagaagagttcatatagaacacaattaaagattaattgaaatccgtaataaaaaataaaatagatttagaaactagaaaaatcaaatataagagttcaagtaaaaataaattttacaaacaactgaaattaggaataaaaaataagaaatattagaagaataattcatatagacacagtatgagattaataaaaaaaatatgagattaataaggaatattaaaagaagagtgcatataagaactcaatatgagatta

SEQ ID NO: 102509 - DNA, 977 bp, Oryza sativa
aagtaaattcaaaaacaacggccggtccgcagtcgccatgtctctagtaccatggacgaactagtttattcttagagtaaattgcgccagcggtacaaaaactagtaggtgggtgcgatttaatgtaaaaaattgtaaaataagcaaactgatacataaacttaacaatcatgtgcattttgataaaaacacggttacatacctatggttcatcgtattttattggttgtatttgtaaacatgactgctagattaattgttggcaatgagtatgttttacagtgctcatcaccgaatttgtatgatcatatggatcgctcggaaattttgttagttggcatgcacttagttttgataatcattatttttctaattttaaataataggttattttagtattgtaaccaagcaaatgcaatacatctaaaaccttattcggaactcaagatgacctaagtggctgctttttctttacatagctaaaaaagtatggtgtggaagagagatattttaacaaaaaatgcaggcactaaccaagttgttacatctatataatcatttttcaaattcttgcactagatcgtacctacctaccacgcaatttactcttattattacaagcatgagctcatgagcaataaccttggctaataaattggtaacgcgatgaaaaagtcatccaagaaacagaagtcatcgaacacgatcatgatagggattagtaaggaatgtttaatttggtgcgatcgaaaacgtcttgtgtgaaaggtcctccttcaactgcagaagaggttcgcaaatgtattgctgatcgaccataaatggattaatgaaccaggaaacatgaatatctaatctactaatatgatcctttccttgagtgggcctcgaacatatgatcctttgagagttgagtgggcctcgaactgaggggctatgaaggttgtgccattcaacatcgcggcccaagtatcatt

SEQ ID NO: 102510 - DNA, 702 bp, Oryza sativa
caaacaggttatggggatccttttgaatttccttttcgattccatctgaaaattctcacaacaatcaactctatcaacacatcaactccagacctcagcagttcagcaaatgcaacagatggagtctgagaagctcagatgacacagaagcaccactactgcacactgcaacagcgaaaggagattacgccctcacgagtcacaggaccccgcgacttgtagtggtatgtcaggactatggggcatgggccattgcctgcctagctttcctccgatcccagtagtggttcacaatctgtgatctgtgcagcttcttcaactcgcaaactgtctgttcagtgatcccctgataccagatatctggcatgtagaccatatattcaacggtacgcagacagagcaccgcattgcagctgaactgctgaagatttatactcactctcaaggcacattgcattaccggtttctcccgcacattaactgatcacaccatcatcgcatcaaagatgcaaataggagtacaacacaaacagtgcttgcaactatatttgcattggttttggaagactaggatgcgttatacccggtttttggttttggaagactagcgatgcgttatacccgcttttgcggttcagtgatatgatttaaactcgacccttagacgagagacttcaagtgaactttcttccctgatatatc

SEQ ID NO: 102511 - DNA, 514 bp, Oryza sativa
agtatatcaggagagagagagaactactcgatctacctgtcttgcaaaagctggggcatatattttcagctgaaaagaatggcatctttctcttcattcacttgagccaagatcatacgtcacacattgttgttactgtccatgcattgcaggcagcagctcacttttactcctacagttccaggaacaaaattgttccccatcttttcctcctcgttaattattatttcttccatcttttcttcgtaggcctcaaacaaggaacggtcacaatctgacagtgacacgaaatccgaggcatatgtggattggcttttataactgaatcccccacgggacaagtgcccgttactgtagcgcctgcctgcctctacagtaggttgtctagagaaaaactgacacctgtttctgtgtgacatttcaaccgaagcatgcagtagactggtagcaagtgctagtggtagctggagtaatctctacgtcttgatgatgcagtatgttgtgagtagcttcg

SEQ ID NO: 102512 - DNA, 2861 bp, Oryza sativa
aaagaatcccatcacctagctatatactgatcctttttgttttctatgagtgacactagcatttgtctcttgcttttggtgatagtttgagtgtacttaatttatattagcatcataggaaaggttcgaatgctcaaggtcctctagccttaaggtaatagggtagttagtgcaggcatgcgtccgaaaagttatatataattccaaattggtaatttttttaaactgagaatgcatcattgaattgtacttctcaaagagtaattaaaaagaaagttggtcttcacaagggacaacaaagtagtagggcaaccaaacatctacatatgcactaaacctacctgattatttagccctatttgccaaaaatgattgacaaccatttcttatctctcaaaccttccgagacaaaaattaaaataaaataaagcagctgcatttcattttctaatgcaaagttcataacagtttaggcttgtttaattgaacttataaacgtcacacctatatatgtatttttggcggtgcaaatacgaccaaattaaagatgtcattgcttcaataatctcattgatatcaatattatcatccataccgtttacgttttagttgcatcagattccacttccacttggcaaaagaattctgtgacaaaaagaggaaaagcccgtgcaactgcttaattcttcagaatcaacggcggtaattaaaactaatgggcatgcaagccttggttttttctcatgtctatcagagaaaaaataaaaaacgccgggccggcaaatctatcagagaaaaattaccctgattagttgctatactatgtatgcaacgacaaacagtaaaagaactcttgtagaccattatgctgctagcattagcctttcttatcacttgcagtatcttagataattccaaattgatctgcctgaaaaccatgggcgtatttcatgctttgggtgctctttgcaggtgactagctagcatcctagctagctgctaattccatgagtagtctctctggttcaggaagataaatattcctcattttgtcatcatactgtcttttctgaaagagaaattatcattagttttgttgcaaaatactccgtccattccaaactacttgtcgtttagtttcgtccaaagtcaaacatttctacctttgatcatcaatttttaaaaatccgtatagtttaacaacatattggattatatatcatgaaagtatttctcatgatgaatctaaaaacataaattttatgatgttagactttataaatttctataaattaatagtcaaagatagaaatgtttgatttaggacacaagtaaaacgagggagtatatgacgatttctcgtgctaagaggatctgaaccgtccatcttgtcaatttgtgatgatatattctcattgtggtggtaggctggagattgcaatggagtttcctctgaagtgtttatttttctacacttgccatgatcttatagggtactcaaggaatacctttcggttttggctaaagccaggagcacactgaattcaaggattcttagtactaattaagcacttctatactaatttcttcctatccaaacaaagacatcaagacaagagttcatgaacaattggctgctttaattttgcctacattgtacatgagtgttcagtttctggttattctactagtccctttgagccctagagtctacagatatgctatgccttgatgaaaatttaaaatttaatctatctacaggtgtgatgacataaactattaggtgattctaattcttcttttgtagttgtgctcagagtatcaggctgttttctagtgttctgaagaagaattttgcagttacctgtcatattcaggcgtgccgaggcttggtacgatagtcacgcatttattccggtaaagggaaaagaacaataggacacatctgggctttgattaggatcagagaaagcggttaggaccttgcttcgctaggtacaaagcagtttaacatgttaaactaattaaaccagccagctagtcagtttgaaccaaaataaatccaaccatgcattaatttcaaattgcaaagatgcaaggacagtactgtgttttgcttgtgaattgtgatatgtgtttcctttctgcagaatttaactttgtgatgatgaacaagtacaacttactatgatatcaaaataacacttaaaaatgttttaagaggtgagctcaaatactattaagaggatcaatttattcaatgagtggatttaatctcattcatccatgccaatgcaatttatgccgcttctgcgctcaaactagcgaagaccagaggaatttttacgtgaactagagggtgaaaataggataaaataaataaataaaaccttgggttttttttaatacgacaaacgaattagacaaaacgaggataacagtttgtgtgcgtggtgaatcacagagaaggtacaaattcttccactgaataaaaaggaacagcactcggatttgtttgagtctagaaatgttaaaaggcgccttcttctgtgttcatccatccatattcccttgccatcagttcatctgcagttgtaggctcgagtttgttatgcaggctaatgcctgaattttttttacctgataatttttgccgggtcttttttacataataattacagtatcaacgttaccattgtcatcagcgttcttatcttgcatgcgctctctttctgcaatggttattcttgatattttaaaaaggaaaataaatgctaaatataatccatctcctttgtttagggttcttgctgtgcatcagattctggctttgactaacacacggaaccgttcatatttta

SEQ ID NO: 102513 - DNA, 1594 bp, Oryza sativa
tctgcaccattctagtctcacatgcatgagttttctgaaatttgaccagcatctcaaacttgtcccaccactagtactacaagtccattttttaaaacaaaaaaaattatcatgattttttttaaatttggacagcagctgagaactgtgcactaatgccgagccgaagtctagagcgtgagaaaatctattatacgccatcgagtttgcaccaatttggtatcaattgcatcgaagcacttgtttgtacactcaagcaaatggaattgaagtgcattctgcatttgttgcagctgtagtactccagacgttcagttctctgaaaatgcagtacactgttgcgtcgtgtttcttcagtgatgatctgatgagatgcacctgatgcatatgcaatctatttggggtgataggaatcgaattcagtggcttccactcgctggcaatggcatggaatcggttaaagacttagtactggctgctgctttggggcaatcagatcatggagcgaatcttatcagaaacttgggaaacgacctcttgattgaacatactgattgagatgtagaatgccatcaagaaatcaaatgtaccaagcttgcaaaacaaaaggcatatttttttcatgtaggcagtgaggggccaatgaaacacagatgttggcatttgcttggagaaatatacatgtatgcagagtggtgtcgtttctgctacagtgtatacagctcttgacaaaatatcgataggatgcttcctagggtaccaaggtagaaaggcatatctagtcgtcggatcaagggatatatgcacacggatggctcagattagtcaaacccactcaaaattatatggccttcatataatccctttatagaaattttgtttgaaactttttgtcccattttttctccaactaaccaaacctttcacgcaattattatcacgaggacattcctttcttctttgttgtccatgatttgcaaatccaaattagtagctacctcatctatcccgtcttatcaaatttgtcatgcttttaatgagtgtattttaacacctcaataagtaaataataaaatagcccccttctttttttacccttcgattatgtcgtggtgcgctttgagatatgcgcatagaccttttacatgctatatgtcgatatgtactttgttcatgaatttcaaaggtatttgggtggcaggtagtgtgtagggagatatccccttaaaacctcaaaatagtacttccccgcacttcaatttagggcttgtttgaatacaatgaatgatatatcgcaacgtcgaaaatgagataacatcatgcactaaacccgcgccgaacacggcaccaccaggctcagtgatctcctagcctttctctttgattccccattcagattccaacaacagtgaaacacattgcatccaaacgactaggagcagttagctactcgatctagcttagctggcattcaaattttactatggcaacctaacctaagcgatcaatttgataaactgatatacacatatataggatatatatatatatatatatatatatatatatatatatatatatatatatatatata

SEQ ID NO: 102514 - DNA, 514 bp, Oryza sativa
gaagaggaggcgcgtcgtctccgacatgaacatgcaagctgcagcctagccggcggccatagctcaacatagctatcagtttgcttggtatactatactacgtattttgcttgccatgttttacttagtttttgtgtgctaattagttgccatctccatatatatatggctcttcatggtgataccaatattgccaattgatatgccatatatgattaagtaggatatatattaccattagggtttgcttgagctttcaccaaaagctgttccaaagccaatgcaaacccagccactgaataacaatgtcagcatccccaatatatgcaaggtttgcagacttacccaactaattaagcacaatataaatgtatcaaatattggtagtcaaatatatatatatatggcaatgatcacaggcttaaaaacaacataagttgcattccatttatgatatgatatatacatacatcaatcaggtcattgttgacatgcatgcatgacaagtacatga

SEQ ID NO: 102515 - DNA, 1517 bp, Oryza sativa
taggggtggctcatcatctctctcctcacttctctcctccacctcataactcaatccaatggggtactcttagagcatctccagcagagaacataaacacacagctctcaaacaacttttattaggaggtaagaggaaaaatataggtccagtagaacccctactcaagcccctacaataggaaggccccccagatctcatcccacagtccttatttctaggggctccgggcacagcccccatcgacgtttcttcagcatgagaggaatttttgcttcgcgcgcgtgcatctcctcccccctcaggctgccctgatatccaaactctgatttgctcgcacatatactctgtatgtacgcattgcagatagaaaagtgcagcacatttgaacattgtttacttccaaatttatatatagttttgaacattctgcaagcgtccgtttatctgaatgcaattagaaaagaacgtggttgattttctgaacattttgtaagtaaagattttctgaatgcatgtgctctgatggaagttgtttgcattgctagctgatatactccctccgtctcaaaaaaaaaaacaaaccctgttttccgtgtccaacgtttgaccgtgcgttttatttgaaaaaattatgaaaaaaaattaaaaagacaagtcatgcataaaatattaatcatgttttatcatctaacaacaatgaaaatacgaattataaaaaatttttatataagttgccttttttttttggacggagggagtatgtgctctgctctgtactttgcttttggttggtacttggtagtaccttgtgtcaggcaggaacaaaacaaagggcattgctattgctgaacattgttcgtggaatgaattttgcatcattgggctgcatttttttcctgtggattctgatgatgataatgataatataaatatgacatctctactcagaattattgtgtttctgcattttctcaatgcttccccgtgtttgaaaatatgaatttgaatatggtatttctatgtgttaaaaatattcatgtttgtattaatgtgatactaaactaggtgtaaatataaatttgtacgttgacataaaagagaaaaataaatagggtctaagaaataagaattgttgctggagttgaaggcatttttaaagtcctaaggaaacgaagacagaccctatttagcttttaagggctttaaaatggggatgctctcggaggcatcatatgggacattagggtcccatcggtttattatccaactgccaaattatccactatcttacgaaatttcttttcaaggttacactgtttccgctcaaaattcaagtccagcctcaagagatacggaggatatcatgcttgcgccatcaaaatttctcttcctcgatctcacctcacctgtgcgtagagactagagggaggagaggagacggatggacttgcgctgcacataaccaactggttcttgcttccacgcttgctacactccccactcaccggggagtc

SEQ ID NO: 102516 - DNA, 742 bp, Oryza sativa
acatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaat

SEQ ID NO: 102517 - DNA, 1368 bp, Oryza sativa
agagggaccaaccaatcattgcttagcttgcttgtggggtgcagtgccacagagtggcatgcagtgagctctcatgacacatgagtgcatgcatgcatgcatggaggcagtgctatgctagtgtagtagtgtgtgctgctgatgctactgtggctgtctgaagaaaggaaggaaggtgatgagcttttgtttcttgctggtttttccttttgtaatcttgctcatctcttatctttttgagagggaggctgggggtgtggaggaagaaggagaggagatatctccatgtcagggtgggtactgtgtgctgtgctcttgcctctcactgtggcaaaagccaggattgcagttgctggggacaaaaggagactgtgtgactgtgcacctatgtaacttgtaacttcatgagagctagcattgctgtgctgtgatttttgcccacactagcttgttgctgtggcttgctatatggcatgcattgtgtattggtagcttggcttgacatatgcatgcaggtcacatgatatgcatatgttcatttaatttatggtttgttggtttactgataatacattgacttgcatgtctaaattaatcccaactgattgatgatggcctctgaaaattattggtgcacatttttcttgtgtggtggtgcatgtttttggtatgagtactatggatatcagtattgattatactccctccatctcagtctgatcatcatttttgaggtcttcccgaaatcattactagaaaaatcatttgttgccacgaaaaaaattgtggcatcaatactaaaattatggcaatagatacatgttgccacaattgtaaaatcgttgctagccgtggtaataaacagcgtggtaataggttattacaacgatttttattttgtggtaataaatttagatgttgccacggaatggatgtggcaaaaagtcatattgcaacacttcacatcgttgcaacaaaatttattgccaccactccatatgtggcattagttttacgtaccaaattaaaagttcaaatattaatctatcatcctatctatttatctacttattttttttgattttgtgtcttggctaggattcgaacccaagacctatccttcacgtgtgctctcctttaccaactcacctacgcatcaattctgttggaaaatgtatatcgttccatttgagcctagctaactgagatttgaatcatagatttgaatatctaaaagatttcaaataaaaaagttatcacctataaaattgtagatctcgtcgagagctataatttccatataaaatttgtctcaatctgtgtccatatgaaaaaattaagttaaattatgagacgacaatttttttg

SEQ ID NO: 102518 - DNA, 953 bp, Oryza sativa
ctaatttagatattgttgtatttataattaaaacattgatttaaagatccataaagcttatattttgagctggtataaaatataaaataaagcaagtaatagaaaatgtcaatagagactaaattaaactatttagagaaaacataataagttattaaaaaattggttctcacatttcactaaaattggaccaaccattgcatgttcctttttcgtaacaattttaaaatgcttagacattaatgtccttacatctatcctatatcatagcattatgagtttctccacatattattacacatacaaaccgcaataaggttcgcactatatagttcattgaaaagttatatttgttactattaaatttaaaattttggattcatgttaactaggtattttcttttgaaaaatataatacatatcacacaaatcacagtgaagcgaggtatatgacatgtctttattaatttatatataagtatgtaaaaacttgcatcaacttaaaccaactagaaggagaactacttgatgctacaaataaaccatatttattaacaatatagttctttagaatttgttaaaaaaaagcgagtaaagattctattaaaaagggacaaaacaccttacttctaatttacacttgatttattagacacactttccaaacaaattaaatcgaacttcattctatataataaagcgatcatagataattatttatatagatgtattaaatattatatattttaaaacctaacaaatatcttgaaaaaattatcaaagcaaaataccgatgaacagcggaggcctcacctgatgtgtcttattaaaaaatagtacttttaaacatgggaggtgtcagcctattgatattctgtttatatatattcaaacgcaatgtacaatatatgcccgcgcgaatacgcgggctaccttcctagttattctaatat

SEQ ID NO: 102519 - DNA, 1787 bp, Oryza sativa
ttgtgcaattaaaatttaaaattcatatataaatataatataatggttgcatgtgaggtttgagctgcgcactgcgattatcgcagaagttaagggagaaaggctaccgcttttccaagaaagagtgcaaagtgcaaagccatatgcaatacaaactctgcaggatataactagctagcttagatcatgagagaacacatatggatatatagctcatgaattggagaccagccggatcaaaaagagaagataaggcaaaaggaatggaagggccggccgggggccattagaaagaaagaaagaaagagagaaacaaaggttaagataggtgttggtgtagaaagtggttaattggatgggcatgcagtgattaccagcactgataattagagagagaatattagggatacagagagagacatgacggcatgagcgtcacgtgtgtgtggccgatggatgagagagagagagaggaagaagaaagggacatggagtgatgaagagagagcgttgcgttggctgggagagaagggaaagagaggcaaagggaatgatgattgcccatcgctctcctcgctgacacaactcgcagcacgcgtgccccggatcctctacgaccatccatccatacataccgccctgcgtcggcctacatctctgatctcttcctagtgtagtatcagtacttccagcgtttgtagaaccgtgtggttatcacgattatcacataaccatagcaattcttatggtaaccatacagttttcacggtaaccgtgctgcttctgcgttaacctcatccaaaacaggttaatgaacgctggtactatttactactacctgcttctgcagtagtagtatttttttttatagagacacgtatgacaaaattatatttagactaagtatgtacaggtccacatatcttgtatctttatgtgtgttttgagcagtagaagcagatcaattaatcgtacgtaagtccccgtggggagatcgaagaagaagaagcatgcacgcatgatagtacgtactagtagatgcatgcgcgtgcacattcatatacgtaccacgtacggttaattcaggcttagtcacaaagggacatccagaaatggacatgcctgtaccctatatatatatgtggatgatcaggtccgtgagagaattaatgcatgtgacggacctccgccgatcgatcactgtgcacgcgtgccgccaccattccatgcaccgtcgggcacacacatgaaatgaagtcgcgcgcgcgcgtgcgtcacgcacttatagggatcgccaaaccgcaaagacgacgatatgcagccatacgagagcaagtataatagcagactattagccagctgtaaacatattattgagataaaagatgagaggaaagagccacgggctacatatctgtagccagctgtagcgcgaactgcaaaacgcaatgtgtgtataggataggtggaccatatattaatatagtatggtaattaagcacctattgtatgaattagctacaccggtggagaaaccatctttggtcggtcgaccaaattccacaatagtcccagttttattaaaaacgatttttagtcccggttaaaaaaattttgatccaacggggactaaagatgatttttagtcccggttcatcctctgtcataagcatgtcagagggccgaggatctttaaactaccaaccgggactaaagattaccaaccaaccgggagtaaagatcatttagatctttagtcccggttggtaatatcaaccgggactaaa

SEQ ID NO: 102520 - DNA, 1410 bp, Oryza sativa
acaatagcttatatggcgtgatgcgctcgcctcacttgctacgagaatgattccatgtgaagagcttctatccttcaagctttgaactaatccctgaagagatgcaaaaacttggccacctccatgctgtgaaacacatcgtggagataatgattcaggtaatggctaacaacatatcagttataattcacataagtaaatcatcaatcacagactagtttattattgtgtctgttgttgcaagttgcgacataccttgataacgttggaaaatttggaacagaagctgatttttccaaggattaagaatcctaccccatcaaataacaatgtattctttcttaggtgcagtgactggtcaaacattgaaataccctgcattgaatgcacttgtcgaataaaatacctagaaaaatgatatgacaagaaaagaagtgagcatcaagaatgaaaagcattaacatatttcacataagcaatacaacaagattgtttgacgaattattagtttttccaaagaaatatagcacagatgttcacaaaaagtgtgttgactatgtttgacaatatagccgaacgtttggactttgatgaaagagtatcgtatggacatactgtagctgatttaaaataatagtcttggctatgcatgtgtgtataattagtctcttacaatttgcatatgcttaatcatgtcagcattataaagccctttcaaaagatgaccttttaggtagtctatctcctcaaataaaaagttagatatacttctgacggttggcacaacaattgaggacataaacaagaaaatattttcaaccttctacaatatcttagtgacaaatttataaattataatagactgaatcatgcagtttcttaataattctagaatccatagatacttcagagaatcactgatacaatggcacatcatacagaaataccataaccgacaacttttccttgattacttcataatatatatgcaacattgaactttatcaagaaagacataaatgccaattcaaattacattttcagaggataggcatcatgaaacgtgtgaatataagcatatgataatatgagtggatgctagatcaccatactttccaggtggcaacatgacaccagcttgaatagaatcaaaaagccaactgggattcaaaatccaggagttgatagcacagccatataagaacttagccgttgatacctgtcacaacaaatacttgagacgtaagtgcaaaatattgtcaaaatatgaaatggtaatttttggaatacatgagagcatattatcatttgtaaccaataaactgtaccaaacacaaagaaaaaatgaaatggattagcaaacctttttaggagaaagaacaatgggaggcttgcacctagcaagctctg

SEQ ID NO: 102521 - DNA, 939 bp, Oryza sativa
atgttatattataccaatacacaacatagtagatgaacattaacatacacaacatttttttagctgagaactaatataatgtactacagattgtgtcctaaatacacagttacataaaacatgaaagaactatcatttacgatattccctcaggattaagggaaggtcgtaatagtagtccctttgctgaataaaattactgcgttaaagtacattctactatgaatgcaatgggtagtttgctctttattattggtatctcgataatattgtttaacaaaacaaaccacccaaatgacatatgcagacagccatgtatataattggatggtatttaaaggcgtacaaccataaacccccaaaatttcaactaggaaccactcagccacatcaacttggaaggattgcagcactcaattgggcaacgatgaaccgtgtcatggtgcaagcactggtggagaaaccatctttcgtcggtcggccgatttccacaatagtcccggatgcaataaaaaccggggctaaagatgatctttagtcccggttcaaaagggtaacgggcgtatttgatctttagtcccggtttgtgttaccaaccgggactaaagatcccggttcgaatgctgtcagggcctgttaggcccccccgggatatttagtcccggttggtacaccaaccgggactaaagatcgtaacttaataccaaccgggactaaagatcccggtgatctttagccccggttggtattaccaaccgggactaaagtcccacccctatatatatgtcttcttcctgctccagctgcccgagcaagcttcaaaatttcttcaaaaaagaggggaggtcatgccaaaatttctattgaatttattttggtgattacatacaatcggaggtgcctaaaaggtttgcaacttcatcctccaatgtttttttt

SEQ ID NO: 102522 - DNA, 3317 bp, Oryza sativa
taagggtaccatatgtagatagaatatctttaaggggctcgggttaaattcctaacttgtgtatcatggaaatactggggtcctagtcggttacgattgtattttatcttttacttgcctattccgttaggaatatgggctgtatgttgtaatacagactcctctcactatataaggagaggtccggatgactcttggggcataacttttcttccagattatacaatcaataacacactcggtggatcaatctctggacaggagtagggtattacttctcattgagagggcctgaacctgtataaaattcattgtcttcatacccatctattttttcatcttgatagccaccctttttcttattgccgaaatcttgtttcgacatgcatgtttaacatccggcccgtttagtgtcaatcaactgacagggagtactgaaggaagaaaaaaaacaagatgcagcgtggtatatattgtgttcaataggcgccgtatgccttgttaattgcccagcctgagattcattgcatagaaaagaaattgagagccatatatatatgggcctgttaggccagaatctgtctattgctgtatcaatatagctccattaattcaactgacaaggactaactgaggccgcataacggttaatcttgctatattcaaaatggcattcaatctgcaacacaacgagagttctccgtttcatattataagatcaaattcttctagtgtaaccatgttaatagaaaaatatagcaacattttcaacacaaaataaatatgttgtatataaaaatattcaacaatgtatttaataaaacaaatttggtgtcatagatgttattatatttttctataaggttgatcaaacttgatgaggcttgacttttaacaaatccaaaatgacttaatatgaaacataacaatgcacgagtttctttttttgaccaagagaatacacaagagctgacaacacttaattatatatgttttcaacaaacttgttagttttatttgtgagtgtccagattttagacccagagagcttttaaagtgctaggtacctctcaaactactcagtatccacccttgatttgctaaagggcaacttagggaaagcactacaatggtaatttagcaattgtttcagccgtaacagcctctgtactcattcctggttgtttgctgctacgtctaattaatttttagccagattgatgaactggccgctggatacaagccccaattcactaattctcatttccacttgttgctcgataccatcactatatgggggaaactctaatcactatgttttcacccactatatcactgccacctacgcaggcttcatccactaaaccaaatctaattaatttcttcttgcctctaatggttgatatctaaaatttgacttttagtcattcttgtaaacccatttgtgcgaaagcaagatatactttaattttaatcatgctttatttcacagttacatatggccttagctattgatcaattatcagtttattgtcatttacacagtttgtgattaatggattactgatcaattacatagctctttcagtatgtgcaatcggccttctcttccacctctaaacgcatgtttgttccctgtaatcgataacgggaacttcataatacatccgggcctccagggccattcaccatacagaactgctccatgatcccaaacaacagatttacgaagaacaactgaacttcttataccgatctaatatgatactatagacaaaattaccgatctaacctttcaaccaatctataagctaatatctggcctactttttaagtacctttttataggtaccttgtattgtaaaccattagattaggttggatcaacggtcatcttcatttccaagcaccggagaaactctcttttttcttttttttaataaaaaagtcacttttttcttaaaaagaagtcaccagccttctctgagccttggatgataattcaagcttagagaaaaataaaacaaaatcccacatataaaaataattaaaattattattctaaaactctttataaaccacttaagattatttgaagtcaagtccaatacttcgggagttaagtaaatgcatgtgttcccataaaatatgatgatatcgcgcatcgaatcgattcagtaggtggtaatacaaataaacaatccttcacctaaaacagacagatcatatataccctccaagctgaagctgtatataactacccagtttcgctatacgtatttgtcgcgttataacaatttgcgataatcaaatgcataatacgttattgttatttcccaacacatctggctggttccctgtttttctattagccacgagctgcgccccgtccacgctttgcataactgatagtcctgtagtagcctaaaatatactctctcctatttttgtttttaatggatgatattgttgactttagaatagatatatttgattattcatctactccctccgtttcacaatgtaagactttctagcattgcgcacattcatatagatgctaatgaatctagatattattatatatatagatttattagtatatatatgaatgtgaacaatgatagagagtcttacattgtgaaacagagaaagtataaattttaaaattctactagtatataaaaatataagttatgctaaaaagtacctccaatcataaaaatcacaagaagataaatcatctatctattatattatatacttaaaagtctattaaacttcctataagcgctcctaagccgccacgtgtcctccaacaaacgctccaaagatgccaagtggcagtctaaaaatctaaccgttgattttcctttaaattgctaggtccaatattttcaaccattagattaaataaaaaataaaatcctcctctccacaccggtccccacctcctctacattcccctcctcctccagttggtacgtaaggtacgtactccctctctcccctcatctccccttccctttcctaatcttcaatctatctattattatctactaaaagtccattaaacactgctaagtcaccacgtggcgttttaaaaaattttagaatacgaaagacgctcgtactttcttgatcttatgaagaaggggcttacggtgggcccatatttataaccattagatctattataaaaaatacaattaaattatctaaaaactcgcattgtacgtgcacatataggtataaaaaaacaagtatgtccatactttgatacgtaagtacgacgctgggctcacataattcttttt

SEQ ID NO: 102523 - DNA, 1689 bp, Oryza sativa
gctcaggggcttactagctcaaatacaagtattatatcttcaatttggacttgctccggatacatgcaacatgaattcatgatcatgggtctattttatatgctcaaggactggactatttattattccccgtaagggttatcaactgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattgaatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatatgttaaaacagtgtgcgcatggcgtatgcccaatactttggaaatttctttattcacaacacacaagcttttttatagctgttttgctatgtgaattttcaataatgtagccaactttaggttacgctcatcatattttacaaagcagtcggtatatcactcggatcatgttatttggaggattcacaccgcatatgctatatattgatatcaagtcacttggttgattacgattatcaaaatcactcggttggttggattatttattccttgactatatgcttggtttgttcaattaaccacattgtcgggggctacacctattaggtgcatctagtcggtgcacctgactatatttttcagccctccacagtcttcagatttggtaaaagtactcgggagaccatggcgaagatgattggagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttgggaaaccgataccgtattggttaaggtttctatcttgtaatcctgctccccatcctatataaggtgggcaggaggccctctagggggcagatatgagacaacctgatcatcagatcaatacacacccggcggattcaaatccccaaacaggagtagggtattacctctcattgagagggcctgaacctgtctaaatcctttgtctccacatccatccacttttaggtctcgtgcgcaaaccgggggatccact

SEQ ID NO: 102524 - DNA, 838 bp, Oryza sativa
tgtgttattttacttgtagcaaatgttacaatgttgaaagcctcctcctgacttacgttgcagctcaccaaaaaaaaaaaggagagaatttatattcatccttttatcatgaagattcaaaaccaacatagatactgaaaacatataaagtaattttatattccttatggctagctctaagcttaaggttagcaataaccatattctcttgtgagctcatttcccattacacaaggttgtactataaatattagcttattcctcaaggttacctttacatgcacattggtgttgtccttatcgattggagaacttgctcatttgcgtgttgatcggtctttattctccaactttcaatatgcaatagagaagtccttttctatgacactgcagttacaacctccattcttcatatgccacagtatcgcctaatgcatatcgatcttacaatctcatctgctcgcgcccataattctatttcctaaccacacatatatggatcgctagatgcatgaaggtccagaattttaattttctccatgtccattatagttcatcaattacgaaggcacagtcattttgcacgtaataatagatgacagatgatcatttgaatttctagccattttgtatatatgaaactgaacatattataagcagcactatttaggctgagttttttccaactcatctccctcattttccatgtgtatgctttctaaacaactaaatggtgtgcttttttaaaaaaaaagttatataggaaagttgttttaaaaaaaatcatactaatccatttttttaaaaaaaatagcagataattaatcatgtgttataa

SEQ ID NO: 102525 - DNA, 887 bp, Oryza sativa
tttttgcgggggctatgaacaatgattccactctcaagcatacacccttggtaccaaaaagaggtcaacttctatgggattcgtccctacaagttgtttttttctattttttttaggacagagtagtatgtgatatgcctacgaaactttcagcagtatttgtagtataaatgagaaatgttcttaggaagacaactttcttacaaagagtacattacttttttctccctaaaacaacttttaaactacttaatgaaacttttttcattaagagcaaaaaactttgtaatagagactacaaatttctactcgaaaaaacttactctttagcaataaaagattatattaggaaactttcacataaagactgaaaagcatccaactagttagcgatatttaactttgaaatcattttagagcatactttatttatttaagtataagataggaaaaataaaacacatgtgcatggtagacaattaggaacaagtttatattacacccctaactacgaaatcagtcattttacactcatcaactagcaaaatggatcaaaataccaccctaagagcagtacaaccagatattaatagtcactttcatgattttgacatcaaaataatatataattttttttacttacatttaactcttttttacatatcacaatacctagatgccataggagtaaaataaaattttattcgggcatcaaaataatgaaaatcattattaaaccagattgtattgtccataggcggtatttttggggtgtaaaatgtctaatttcatagtaaagggctgtctttttagacagacctaattgtagagaggtgtaatatggacttgtccaattgaaaacgaggttacagataaagattaatact

SEQ ID NO: 102526 - DNA, 862 bp, Oryza sativa
gatccgcccctggtagatctgaactgatgcttgcatgtactgttcatgttttttttaatgtttttgccaaagaaactattgtaacataagccaacggtggttttcaagtgttagcaaagaatacaattttgattcttaaaaactatgacttgcaatgcctcgttggtggtctatttataactctataggattaattttcacacatgcttttacatgtttatcccttgataaggacaactacaaaggtactaaagtatttttaagacttgtttggtttttagcgggccttatcagtacttgcgctgccatatacacggtccatggtccgaaggccaattgatgggctggccaccaggtggttctcacccttcctggtgacctcttgttttcttcatgacctttgtcatcttaacgagtttcgccacccaagtgggtcttcatcacatctattaggctttgcaatgtgatcatggcttcacctctccctcaagccttcattgttaccagcctgcctccaatagaaacgctttaccaagtcggtgtcttagataccagtacgaatgttaacatgcagttgtggaacctgcctacaatacgtaattcaagtgaataatagttttgtcattgttgaattgatgtccaaataacctttaaggtctgtttcagtgtggatgttgtgatgcatccggtgcttactttttaagttgagatggaaattataacttatgatcgttgtactttgttttactgatcaaattacagtttaagtaaaacaagatccaactttaatgattccccaactttaatatatgtttgcaacatacattaaaacaatcaatttgccaccatgaaaatatgtaca

SEQ ID NO: 102527 - DNA, 4753 bp, Oryza sativa
gggggggggggggcgcttctcaaactgcgtgcacaacgtggtttctggtttctgctttgtgctgccgagatgtccgagacactcgtggtaaataggagtatatataggctgaggccctatttaaatgggactaaaacaacttttaagtccctatcatatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtacctgcatcaccacctgagttgtacactgcgtttctagttactctttcgttattcgtgttaaacacggtttctaagctgttatgtaaaaagaagaattttagttaaagtacaatttatgttaaatttgtagttcttttactagtgtaccgtggccaatccaacttcgctgggtttcttgctcagaataaagagaactgcctatcagagaaaacctgctaaagacactactaggtaaacgattttcctttgtagggacccatttaaattgcgaacggaccttacctggtcacggtggcgaaaatcattctctatttttatgtgcgataccttaagaaaaccacacgcaaaaatcaatttttataggcgagcctcttaacaggcccacacagaaaaatactcaattttcacaggcgggcctcctaatcgacccgcacagaaaaaatacccattccctcccaacgtgttaaaaaaattcaagtttcccttctctctcccccttctcttctcctctctctctcccccccccttatcttctcctcactttcctctcatcctctcaatgttctcctcacttcaattgagctaccaccgcgcggccgcatcgagctcgcgccccgcgggccaggcagccggtgctggcgccgcctccttctccttctcctccagctcaagcctctttgcctccttcggctccggcggcggcggcgggcgggagcggcgggcgaccgggagtggtgtgcgcgtgacagcgaacgaccaccccccgcccggatccggcggaggcggctgccccccgcccagatctggtggcggcgggcgggcgggctcggacggtggggaggcggcggatccgggtaccgctacggcgacgacgagggcgaccgcgaggagggcggcggcggcaactttagagttagggttttgttttattttattttattttatttttggttttttatttttgcgtgcgggcgacataaccacccacacgtgaaaatcagaattttccatgagagtgtgccacccgcacgaaaaatagtgatttttgtatacaatttttagataaagtttatcatgatcggagttaatataaaagaatttaccttttatacattttagttgtgctcatattttcaaaccatccgtaaaaattaaatattcaaacccttaaataatctcaattgtaaaaactttgaacaacggagttttagatctcgtggagagctaaataaatataaagtttatcttcattctacctcatataaaatctcttggagagctaaatctctactattataaaaattaaagatgtttttgctgataatttgataggtcatttgtgtttaagtcggtttttaagtttgttcgcttttgaaaatacagatctgtgtttgagtcggtttttaagttcgtttgcttttgaaaatacaaaaatgtcttataagaaatgttttaaaaaatttgcatgctaacttgggacgcttttgaaaatacaaaaggagtcatataaaaaagtatttaaaaaattgcatgctaacttaagataagagtcggactcctattatcactcgtgattttctaaaaaagatattcaagcgaatttccacaatgatttttaccctacctaaaccgtataacatcaataataaaactaaaataatattcacccattgcaacacacggacatttttacttatcttcgtcctacttcacataaggagtaacgattttttttttaattttagtagtgattctatttttaagggcatccacaatgtatgccataagggggtcttaagcctatagggtggtattgtacactatgggagtagtccttataggtaaccttatgatgagctaccctagacataaagaccacccgtaaggaataaaaaaatcatgtgttctctctcctactactgtatcctctctcctgccttttacttgtagccttgtaggacccaccttatttcctatgatatccatatatattgtgtgtggtttgcaataactaataccacatgctgtgggacccttctatatagaccacttcatctttatcattgctggtgcccttatagcaaggctaatgttggctataaggttttttttagcctttttttagcttacccatataatagttagctctttacaattaatacaggacccacttatctttctcatagagtttcttggttcttatgtccaaaccagctgtaagtttaaaacccgcttctcctctctctcctctcttctctccttcaccttagcatttaaccagcttatagcctagtaatacttgctgtaagggtgcaagggtgcgttttctaccgtgcgtggaactcaattttttatatgctgtcgtagcccttcgctggcaagactactccgcagcccgcagctccatacaagatgcgggactttggtcccaccgattcaagaccgaagactgatttgctgtttcttgttagaaatcgttttttttttctcgtcgtttcaatcgttttttttttctcttcccctctgcatgacttctttggagttggagtcatccccttcgttgttacaaaagtttgtatgggttgtttgattcctttatttttcgatgcaattaggtggcgagcatttccacccctaaaaatccaaaagaaatactttgagcactaaaggctaaagacataatgttgtttcctaataaggaagacatgcaataatatcgtaggtaatttagttcttagcggtgatgtcaatggtacatctcataacagagttcatttttttttcttttttttatgtggttttttggattgatatatgtgatcttgttcgaatatggagtaaggtggtgatcttgttcgaatatggagtaaggtggtatttagacattaatttagagtattaaatatagactacttacaaaactaattacataaatgaaagctaatttgcgagacaaattttttaagcctaattaatccataattagagaatatttactgtagcatcgtatacactaatcatggattaattaagctcaatatattcgtctcgcgaattagtcaaagattatggatgggttttattaatagtctacgtttaatatttataattagtatccaaacatccgatgtgatagtgacttaaaagttttagccccatcatgatctaagaccaacaatttttaagcttttgtaagaagcttcttgaaatatatatcatcaccttctggtttgttttacattaataaatagcgtcgtagcattagcacggatatattattagtgtttcgttaaatcgatgtctaacagtagcatgcaactaaacattaacttttttgcttataagtaatagaagaaaaaaacattaagctttgttatatgaaaatacactactataaaactggcttgaccgcatcatactgtaactagaagtgttatacgtacgctcttgtcgctgtcagttttaaagaggactagctttcagctccaaaagctattttggtagtggtgatggtattaagcgttagtacgggtatataaatagtgtttaacaatgttcgttaaatcgatgtctaacagtagcatgcaactaattaaacattaattttttgcttacaagtaatagaagaaaaaacattaagctttattatatgaaaatacaacactactacctccgtcccaatataagtgcagttacaggtttccgtatacaacttttgaccattcatcttatgaaaaaattaaaaaaatagtcacacataaagtaatattcatgttttatcatctaataacaataaaaatactaatcatatttctttcaaataggacggatagtcgaacgttggatacggaagcccacaactatacttatattgagaaggaggtagtacaaaactagcttcaccgcatcatattgtaactagaagtgttacgtacatgtagcctagtgattatagtgacctgagtagcaccctaaggtcctgagtttaaatctcccataggagtgaatttcaaactgagttattggagggctaagttccctatttgacaggctaattttctaatttaaaaagactacgtatatcaggttggatgtagaggccaggtaaaaaaaatacccttctcttaaaaaaaaaagaaaaacatacactcttgtcgctgtcaggtttaaggaggaccggctttcagctctcaaatctattttggtagtgatgatgatactacctcccacgtccttacaagaccccgttctataatggggcggcttatggctttataacctgtgaatggttattaaaagggggatccactaggctagaaaaaa

SEQ ID NO: 102528 - DNA, 686 bp, Oryza sativa
ctgcagcccttttaagcatcgccgtcctcctctctcgctttttccccatgtcgccgatctctcccgagctccccatcgcctccgcgccgtgcaaccacccgccgccgccgcttttgctactccggccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcaccatggccgccgccttcggccggcgctctcgccctcccacgctctttcctctctctctaatccctctcctgttgttcgttaggaggttccggagctcgtcccgccgtcgtcgtcgtcctccgtcggccgccgtcgtcgaccgttgtcggtgaggcttccccctcctctttctccttttccccgtaccgtgtaaccgcgtgcgcgccgcttagccgcgtagccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgtgccccggccgcgaggtcccgccgccgtccgatctacccttgggtagatcg

SEQ ID NO: 102529 - DNA, 2565 bp, Oryza sativa
atataatacttaatgtcataattattttaaaataatttagccaacatataataattaatgttatgataattttttaaataatttcacgtgataaaaaggatcaacttggtgtcaaatattgctcgataaatatataacactaattcatatctacatgcagggagagtgaaacaacattgtggtttttcagtttagatctgatttaattttaatatatgtgaggcttttctcatttttttataatttttcagaactatttggttggaatgtccagggaatgatcttgctataatacaatcccttaacccatcacgtgaattatggtcatatatgttttttctttgccaaatagttttggtaacaaatcaacaatcctatgcattaaactatttatcatatattttcttatagtttagaaattctaatacgtcggacataattgatgatgtatgccatatacccccactgaagtgattataaatgcactccaatgaattagttactttaaataattttggaaaaaaataaatatattcttaggagtagtaaagatgtatcatgcaattatgaacaatacatgaaaaaaacaaagtaggcgctaaactatagatctttatcaaattataaacaatgatatagtcctctgaagattgtcatggtcggatatccatttagccatttttgaatgatcaaactcgctcatttcaaaaaatagatagttgtatatataccataaaaaaataagcagtactgattaacacacaaaacttaaaaaaaactatttgttattggaaaaatactttcatcatgtacattctctctctgtttttccttgaagggcaccaagcatgctatgttgccatgagtatagcaagggtcacatatggctgagttgaggctacccgagcagagggccaccatttacaataatgcttaactttctatttactgatgcgatcatcgatatatgaaggtgtttatagtgaactagggattaacatcatactccatgttgaccttgaggggcacgactacgttgactcgagacctatgtttaaaggcagtggagaaataaagtctcggcgactatagtcggctttattacccgttaaagggggcattcatatttgattttaacagtgttatcttatcaaccattaggtacaataattatagaatatttattcatagatttagaaacaagagttgacataaacagttatgtttgtagtagatataaatgttttatgtattaataatatattgggcttattttagtggtatagatgcagatccatttattaaaaatgcatcccgttttaaggataattaaaacaagtaaggttgataatagctgagtttacatgtaacatggacaaaataaaccctacctatggactaactattattagtttctcaagacatatttatgaccattagatccatcgttttcttttaaaaaatagaacccatatcccaacctccaccacggccctgtacgtgggcgcttactcattcgtccaccccactgcccacaccctcaaacacaccgtacctctattttcctcctattctcatgctacattacttagaaatcataatttattattaaaaaatagagaacaatatcatccaaagcatatagtgaatttttgattgacttatttttgttatattatttataactaaagttaaagacacatattcacaatattcaaacttttgaaataaatatgtttgattttggtttatattcttgcacttttgcgtacattcaaacaaatataaaaaaaattatgaaaaacatttaaatgttcatcttttaaattatttatgaaatatatatctaacttataactaattgtattcctttttttaaataaaatattaatcacatataaaagttatattgtagtgctaaatacatggtgccgacatatgatacttaatgtcataattatttttaaataatttagccaacctataataattgatggcatgaaaattttttaaataatttcatgataaaaaggatcaacttggtgtcaaatatctggaacagtgaaagagcaatgatcaaagctggattcgatcaagggggagtgttatgaaacaacagggtgatctcatccatataaaaggatggatcgcaaccgaaggcaaccgcgccttccctaggcgctccttggcaacagacgcgatgattcccaaccatcgcgtctctaattgccaccccttccccatctatatattgtaccgcattgatcaataaagattccgctcattcattctctacattcttgtgtgcaattctctctctcactcaatcactctcgctcaatcaattctatacactttcaacacgttatcagcactttcgctctcgcaaaggagatcgcgaagtgaaagaaggaagaaacatcgcttttgatctaacagaaaagcgtacagaagaatcatcagaaaaggtacgatgcctacctttcattggattatggatgccgttctcggcctccctcgcaatcagcgcgctcatcgccttcaccatcttctccgtagatcaga

SEQ ID NO: 102530 - DNA, 1053 bp, Oryza sativa
atagatatcaaattaatctattttttaagtttataataattaaataaaaactgataactagatgttttgcttttttctctgaatttatagaaatttctctaatttattagagcgccatatggtatgttagaagcgtctgtaggaagttaatttaatggacttttttttatatatagagaaatttagttgacaaaaagtcattagatgtctaattatagagctcaaattgttaatttaattaaaatgaatacaatggtttaagcttatcataaattggatgttaggtttaaaaggtcatggtatataatgaccgtttattaaagcatccacctaagaccactgatgaatctcatatgcatcacggtacatgggacatgcatcagaatttattcctcaaccggttttgcctctccgtgagagaaatcaaggagttaagttgaccattagatatattaatctgcaataaatcatggattaaattttaacaaccatgaagaggggtgcgcacgccgtaagatagaaagaggatgggtgcgtacgtttctgccgatagaccgatttggataaatctaaacccttaaaataatggatccactaaatttaatgaaatcaacggtttgatttttttctttttcataaaatttttcttatttataagagtgtcacgtagcagtttagaagcgtttataggatgccacatggtagcttgagagcatttgtagaaagtttaatgaatatatatataatagaagatttgctcttgcttgcaaaaacaatacgatgcatccgtgtgggctggttggttccacacttcaataacaacaactatcactagctaattaattaattaaggaccaaatgtacggcgtagatcaagttgcggccaaggaagaactgctgcacgtttgcacttgcatcaaacccggggaagccttaatttgtactttacttaccggaaatacggtactaattaagatgctatttgatttgtcgtgttggattatacattggaggaagatacagacaacacatgccacctgccatattaatgcg

SEQ ID NO: 102531 - DNA, 814 bp, Oryza sativa
tatatattaaaataataaaactgggtacactaaaaatactttgttaattcgatagttgcattctgtgtgtaaatttgtgtgtggactagctttgagaaagtatatatgtttttcgtattggtatcgtctaagaaagaaaacgggttccaccaaaactaatgtgatgcattatattggcagaaaaaaccaacacccaaaagagaaatatatattataggaatatataaattaagttgagcagaaaaagtgggtcgtgtaacatgtaaaccatagactacatataaccttatgaaattatgatccgagaaatttcctgtgtccacatgtgcctagttggacaattgataaatgcacaaacctgtggtccccaagccacattcatatgccaagtaatggttgtgactaggttcattaaaaattttatgtaaaaaagtgcaaagtagcaagggggaaaaaggtgaaagaaacagtgaggtcagcaatagttaattagcccttactgcaagatctcaccaacaattctgcccttgaataatttagcagcaaaaagggaaaaaagaagaagatgtgtaaacaagaaaataaaataagaatgcagagaaagaaagaaaataaattgctcttgaagccacatgagattggctaactaccatccatttgttgacaagaaagaaagctcttttcacaaacaatatgataatgggtttgtgagaggggcatcaccagctttgcataaacaatgcattaagtcactgttagtggaggtaacgagttacatcagctcactagccatgtaattctggaccaaatcttt

SEQ ID NO: 102532 - DNA, 4516 bp, Oryza sativa
agtagccgaaggcgtcgacgaagaagttggagacgacggcgccgactgtagtaggggccttcatggcgcgtgagctctccgtggccaagcgacttgttctcttgagcgggagcaacaagtcgtcctctggtgactcccgctctgccgtctttgcatcctcgagctcctccgtaaacgccccaccggtgacagcgtgggtcatgccccatcctgccgaggattaccacagcgatgaggagctagaagatgattcccaagaggtgcctgggattcagaggaggacgtggctctaccgctacatatttgagatctaacaagtgacgcagccaatggagaagtagtcagggtaacaagagatctcactaggagatctatctagtcatgaccttgagcagggtgtgaatgtgtgcttttgctcacatattctatctcgctaggagatttagctagtcgtggtcttgagccagatcaacggaaataatttttctttgcaaaaatagtacttggggatattttgctttgctcgttgttaatcttgtttgctggtttaatttctgacctatcttggtaaattgtcaaattctctgcatggattgtagtgtgaaaaaggattggatggactaaatattagcttattatttaactttggtgccaatttcctagtatgctaactagccttgcctttttttttctccccaattttcttttcctcgtatgattgatcaatgagatcagtcaggcatgcatgagttttgggcagtcattgccatgctattgctagttagctaccttaatactccctccatctacttttgatagtcatatttccaaatctgaaaattttatttttgataggcatatttcaatccaacaacttatcatcttaatgactttcttggatttaatgcatgactctttattcttctacacatgattggctacatgggcattgagaaatgtaaatattaatgtatcgcttgtttacgaggaatgactagtagcatatttaaatggatgataagtagaattacttatccttggtctgtgtgccaagatgaaatataactatcaaaagtagatggagggagtatagcgcaattaactaatcggtattccaagtggtacattatataacatcatcttgttttccttatattgtttctgttatctagtaacatggaaaaaagttcaaatacatatatacatgagattaggaaagtaaagggatggctttggaaaatccgttaaggtacatagccttttttggtgctaatacttaacagtcaagcaattactatgtagtttagtttgctttgtgctatggaaacaaagctgtattccagcaggatgaagaaatggagtagctagctagctttctatgtgtttggacaggttgagacaatctaccaaacaactcagaatctgtaggctatctggctatggcaaaacatattttttgctggctagcattcggctgagcacctaagcaggttttattgcttagatgagagttttcttaatgcatttttagatcgcggtgagcttttcaaatgctgaaactatggattggtttagattggtttttttaagtaatagtaagccagagggctgctgatatttatcaataactgaaggagttaaaaaaatgaaagggcaagaagataaacaaaaagatagaggtgttgtaggactcacaactatctattaggttttcaagcaatgaacacttgcttattaaattttatactttgaccatttcttcttgcattagttgtgcgtcataaatataaccatataacttttattcacagaaatctaattaatctttcaaaggtaacttacggtcatataagatgacaataataattaacaatgttatttattcgagaatagagaatagagggagtaggaatcggatgattttactacgtttaaatgtactccctctatcccaaaataaaccaaaattgtactaggagtaccacgagattggtttattttgagacggagggagtagatggtaaagtaagagctcggctccctgtcggctcaacgtgagctgactaaaggccaggccccagttgagcattattgggccagtacaactgttgtacaaaggcatatcagatgccaatctgtcccccagggctagggtggacaggaagcttgtgactcgttagctcgctcggcttggcttggctcggctcgtttaaatttcgtaatgagccgagctggcttttaagcttgttagagataacgagctagctcgcgagccttaacgagtcaggagtcctagagactagagtgaaggcccagcccaacagacaacagcccaaggcccaagcccaactcctccggtggctgagagaaaacactaacctcaccgcatccgcatctctctctgcctcgatcccttttttgcccccacaactcagccacatcctcagtgctgtgccgctagggctgccgccagccgccactgcgagcactggtgtcaacactcctctcccctcccgttgccagcgccaatcgctctcctctcgtcatgcgttgccagcgccgacgtcacctctcgccgcccacatcgggccgtcctcatccaccggcccggcagccgccgccccgtgccacacaccatcacgtgtatgccatatggaaaccttcacctccacaacaattgttctctagcttcataagcacaaaatagtatcacatacgaaaagaaaccatctagaaattccacgaaaataacccaaaaccgactcccttccgcagattgtcggtctgatcgtcagctacccggtcagaccgccccaacaccaccggtctgaccaagcagcacccgcccggtcgaatcggctacccagtgccaacatgcactatgcaacgaatgaaaacactacttacctttgaaaaatattgttcatacacatagattaaatcaacattttgattttaacgcacatactagtggtgtgtacatatgtgtatttcacgtaattctaaaatcatagtgtagttttgtgatacatttgttacatgtgatttactcggacatatgccaccacttatcaataatgtacatggtatccaagttgttacatcaaatatgatagttaaacacatggacatcgtgtccttgaagggatgaaggtattgaatttcttcatagttctcatgaaaaaaaattaggtcttgcgatggcagtaacacgattgccaatgactatataacaaaaaagtagatttttagttatcttcataaactagttgggcatacgatggcttggtatataccaagagcacactagttggtatatatgcattttgtgtgtgtgtgtgtgtttgtttgtttgtttgtttgtgtgtgtgtattgtgtaggtacttctttatcgacacacctatagttgacgtaacgtattagcgttgaaaactagtaaacatctatgattatgatgactggaccacaacaaccattctatgtcgtctaatttgttttagaaacatttcaaagctttcggttacaatatctctagccattactagcaaactttcacaaacatttttcttcactaggatatccctaagcaaagcaagtacgagcatatatagtggccggtgtaaaagaatgccattgcagttgcacatagaaaaatacaaactattgggaagtggatttgaagtttatatgggaaaattaatggttaaattagcatgaaaatttgttatttagtcccggttccttggttcggtagaagtggtgtgaattcatagaaagttaagatagagattagatttggatggttgatatttgtttacgcgcagggggagggagtgggtggggttggggtttgtgttgggggggtggaagcggaggagggcagccaatagcctcatcctttcgatctctaaatcgcccttgaaggctcagaccaaccaaacacacccaaaagaaatagagaagaggggaaaactaaatcacccatcgtcacatcgacatcaacctagggaaaccctacggcgcatgggttgtggacgatggcaaagaggaagatgaaggcaatgggaaagaagaagccaaaggtgccaatgaagaagaagacaaaggcgcaaatgaagaagcagctgaaggcgtcgacgaagaagttggagacgccggcgtcggctgtggtaggagccttcacggcgcgtgagctctgcgcggccaagcaactgttctcttgagcgggagcaacaagtcgtcctctggtggctcccattctgccgtctttgcatcctcgggctccttcgtaaacgccccaccggtgacagtgcagatcctgccccatcctgccgaggattacctcagcgatgaggagctagaagatgattcccaagaggtgcctgggattcagaggaggacacggctctaccgctacatatttgagatctaacaagtgacgcagccaatggagaagtagccagggtaacaagagatctcactaggagatctatctagtcatgatcttgagcaggg

SEQ ID NO: 102533 - DNA, 1912 bp, Oryza sativa
  unsure (1)..(1912): unsure at all n locations
cacgcatacgcatatgtatgtatatagagttatgaatattttttaatgtgtaaaaatatatacacatatacaaagtttatataggacatatatgaactttgtatatgatgtatatgaactttgtatacaacatacatacgtatttaaaaaataaaaaaaaattgcatcacatatataaagtttgcatacgcgtatacaaactttgcatatgtacgaatacaaactttgtattcatatatctaaaaaaacgaaaaaaaacagaagagaaaccgaaaaaaaaggaaaaccaatcttaacataaacaaaaaaaaaggaaaaaaacagccaaccgaacagaaacagaaaacacggaaaagcaaaaaaaaaaaagaagggaaaagtcggtctcccgcgcgacgcgtccgccgccccctctccgcgccatagtataaaaactcggaccggagcttgacccggcggacctttcggttcaccggtccgccggtctgaccaatgaaccggcggttcaaccgcgattttttacatataggtatagtgcatgtttgctagtagtcacaagtgatatacaacctcaacccacagacctgaggtcgattcccaagtatgcacccatttttgccaaaaaattcgaggtaccaatatgatgtggaccatactgggcctctcattggcccattacaaaccttcactggtccaaccgtaggcggtttaatctccggttcaacacaaaaccgcccggttcagccggttcacagcggttcgaatgcatgtcggttccggttttttccggttcaaccgccggggccgggccagtttttttcccngatgggcnggcgcatgnncgggtgtccggtgggggggggagggncnnnggggnngggggggggggggaggggctgggctgatacgcgatcagccgcacgcggtcagtcgcccccctctagtctcttccctgtatctactatacttatgtatagactacatatacacacgcatatacatatgtatgtatatatagttatgaatattttttaatgtgtaaaaatatatacacatatacaaagtttatatacgatgtatacaaagtttatataggacatatatgaactttgtatatgatgtatatgaactttgtatacgatgtatacaaagttcatatacatgcatatttaaaaaataagaaaaaagaaattgcatcacagatacaaagtttgcatacgcgtatacaaactttgcatatgtacgaatacaaactttgtattcatatatctaaaaaaacgaaaaaaaacagaagagaaacccaaaaaaaatggaaaaccaatcttaacagaaacaaaaaaaaaaaggaaaaaacagcaaccgaacagaaacagaaaacatggaaaagcaaaaaaaaataaaagaagggaaaagtcggtctcccgcgcggcgcgtccgccgccccctctccgcgccatagaataaaaactcggaccggagcttgacccggcagacctttcggttcaccggtctgaccgatgaaccggcggttcaaccgtgattttttacgtataggtatagtgcatgtttgctagtagtcacaagtgatatacaacctcaacccacagacctgaggtcgattcccaagtatgcacctattttttgccaaaaaattcgaggcaccaatatgatatggaccatactcggcctctcattggcccattacaaaccttcactggtccaaccgtaggcggtttaatctacggttcaacacaaaaccgcccagttcagccggttcacagcggttcgaatgcatgtcggttctggttttttccggttcaaccgccggaccggtccggttttttccactatgctccacgcgcgacatgtgtccagtcgcgcggggagggacgtgcgcggtgggggggggggc

SEQ ID NO: 102534 - DNA, 3214 bp, Oryza sativa
cagtggagtacagtaaatttcttcctccctcgcccgcccacactattcggtcaatcgctcgactcgattgccgatttccatccattgcatgcattggccgcgcgcgtatcgtcttatccactcgatcgtcgcgcgcggcgcgggagacccggcattttgcaggccggccggcagttcatttacaactatggaagcttttatttgtggccatcgttctgtcggttcatttacaactcacttcttctccacctccaaacgagaacaactcgttagcagcagatcaacacaagtgcatacaactgctgctgcactgtacgcaccacagttgtagaaaagaaagaatgaccttgcctgggagaaaacggacgagacacttgacaatatgtactcctatgtgccagtagttggctgctacctccgtttcatattaagtttatttttatcacctcccatttagcttaaataagttcttttaagtaatcattgcgtcagattttataaaaatagagaataattatattgggagtagataaagtgagtagtaattgcattagagcaagtttaacattatagcccactatcagctccaaatcatttatagccaatgtaatagctaatttatacaatagttgtttactatattattaatatatggtcccacatgtcatacacacattacgtcttggagttcgtgctgcagctggctacagatctatagcccgctgctcttctccctcttcctttatctctttaaaatatgtttatagctggcttatagcctgctattgtacctactcttaggattggataaagtagagatattctagtcttttagtgtttgtattggtatgtgtaggagtattttggaatggaggtagtagctaattgttgaggttttattacatctgcagtggtgaatgcagcgcagtagtagacgagctctactcctatctaaaaaaaattgattgtatagccaactttttttataatgtcgaagataccattatagaacatacaagattgataaagtatatccagttaagatccaaaagattatgaaaaaatgtgtttaggtcttctttatttagacttataagccgaaaagtttaagcttaaacaaacaagcggttttttgtttggcttttttaagccataaaccactcttacactattaagctattaagccaaaagctaggttagagaaactattttggcttatttaagatagatatatgactttacctttaaatttagggctttaaatccactagcttataaatcatataagtcaaaaatctgacttaaaaggcaaagcctaatcaaagaggcccttagcctcctaactttgcgtgccagttttaagatttgttttttatgcttttagggtgtatttgagagggaaggttggaacttctctcacgcgcacgcaaaataggtgactcgttagtgcatgctataaaaaaatttaaaaatagattgatatgctttttaaaatcaacttttttatagattttttttttcaaaaaacacattgtttaacagttcagaagaagctcgcacgcacgaaaaatgagggagtggaagtatttcctgaggtatttttgtgtagttcatgagagaggaatcacttaaaaaagataaaggggaaatattcaatgaaaacccatgaaaatcatacctaaaagttctctaaattcatgaaaagttactggatagaagtataggcatgaaatacatttataccaaatctcaaatccaaactcaactttatctgagagaaacaaaaaggacaaatttgaggtaatagtatcatgttactattcacatgaagctttcattttttacttcaaaataaagttgagtttgaacttgaatatattttaagtccacatctatctctggtaatttgttttcataaatttaaaaactttttggcccgattttcacgagttttcactgaatatctccctaaagataatagcacaaaaatatttggtgtatcatatgaaagattacttacataaataaaaacaataacacaatttatgtaccatataatatgtaagttttattttcaaaagttagttaataatgcagaaatatagaaacttacacaatctactatgatgtgctaggaggatagacaaaatttttcataattctcttaatcttctgacaagataaatcaattgtcagccttatatttccttaggcattttgggaattctttacaaagtatatggcccaatggcatattgtatagacaattgataaaaatagtggtatatttgttaacaacgaaaatttgcatcagattcggagaaggaagaaaatcgaagcggatttggtgttgaatcgagttggattcagaatcagactacggatcggctggataccgcatcggctggaaacagaggttgaagactgaacaagttgagaagattgatggccgatacagctgatatggcatgacttaggctcagcatgggcttagattgggataaccgtcattgccaattagagatggagctcaattaaggcaattatatctattaattaggatattgagtcggtttttattagatttggtaagagaccgccgtatatggtcttatttttatcttaactttagaaaggtttgagtcgtgtccacaacggactaatatgtacttggggtataaatatgaaccccatagcattgtaatacgggagccaatccaatacaacttcggtgcatcgccacccttttacttttctcgtttccggcgagttcttcacaagaggtaacccgtctcaatggccagcgctatcggggctaacatgtcgctttagacatgttaggctcgatattgcgagtcattgctatcatatgtctttgctaatctattcttagcttttcaatttagttttatcggttgctgctcgctttagggtttatgctggtttcggttaaattgtcttgctagattagattagctaaggcatctatcatcttgaagtgtctaattgcttgattgtctagattgcatgtttcttttcatactttgagatgcatcatccctagtcgtgcttagaaccatgcaaactagcttgcaatcgaacataataaggataatatcagggtttcaaccgatcttacctaatatgcatgtttcaatacatgtttcatgtatattcgacacttatatagatagatcgttttatgtaagcatat

SEQ ID NO: 102535 - DNA, 531 bp, Oryza sativa
taacaatgtttgttgaatatatacagaaaataagttcacaacctaaggtacgggccggcgagtcgccctcaagttggggcgaaaaaggcgcatgggccctaatgctagcaaagaatggagaagagaccgggcccacattgttagactaggagagtggcgtcaaccctggccactaggggaaggttttggtcagggctaacactgggggctactgtcggcgatatgggcccagggatatcacgtctagagggaggaggctgcccccaaactcacgtggctccccccgagtggggttgagcccggggtggcgcggcagctaccccctcccagctagaggttggaggccgcctcaaacccacgtggctctcctcgaggggggtcgagcccagggtgttgcggcggctgccccctcccagcttggggtcgggccgcccccaaacccacgtggctccccccgagaggggactagcccggggtgttgcggcggctgccccctccctgcttggggtcgagccgcccccaaacccacgt

SEQ ID NO: 102536 - DNA, 782 bp, Oryza sativa
caaagaggctctatttttatgtcatcattttatcaacttatgcttcttttttaatttttcatgagcatgtttctcaagctgttaaatgttgtgtttcatgcaaatattttcaactatgttagcaaaatgttaacatttataaatgaatctggacaaccatttatctagattcatacaagagtacctatccatattcatgtactacctctatatgaaaatataacaacttttatatatgaatctagacgggcagatgttcagattcatagctataaatgcttatattttggaacgggaaaaatataaaaatgatttttattgaagaaggtagtagacagaagtttatttgtttaaaaaaaacaaataaatatattcttcatacttataacactatctctgtctaaaatattttatttttcctatctcacgcatattaatataaagtcaaaaggctaaaatgttcttcactttttcaaactccgatgtatttaactcctactttattaaacctcaacacatttgaccccttcttttaagaaaactccattgcatccgttctcaaatttctcaaactcaaatacattgattggctcaaattatcggataaatgaagaaggcaaaaaatgaaggctttgtgtgatggagggactggttaattttaattatcacgtgctaatggtccattacgttttccgtgccacaactcaacccaacctcacattcaaacggtgccttaaagcaagttttatatagaattccatccgtcccaaaaggggtgcagg

SEQ ID NO: 102537 - DNA, 2508 bp, Oryza sativa
attcctgcagcccaatttggctcggagaaaatgtaatagtagtatgagatgttatttctatatgaaaaataagactatccatcatttattcttgaagtgtcattatgcaaaaatttttttgaagagcaatacatatttctctggtttgtattcttcacatagtatatctcatatattagaaattgacttgtgggtattgataaaaaaaaccagcaaacttattctcgtaggagcatccgttgggctttatgattgagcagaaattatatagtttttgacaaatcatcatttatatcttatatgcatgttcttctcagggcaatgtactgactccggttctggtctcaattataaaagtgtgacgatgataccaggcaaacaaaaattgcatgtcacgaacttgagtaaaaggtaatgcagtttttcgccaacttcaaatgaagattcatatacaggattcaacaattaagaggtttatttaggtgttggcgatcattaatttgtgtttgcttcagtttatctaggtgtgttttataagacttgttgatgtgccattattattgagtgaatttgtgtaatatttagatataactcgttgagcaaaataccagaattttatttcattatcttaaaaaaacagtcaaagttggtataacttgttcaacgctgtcagttttaaaaacggggataaggtatctcagatcttgtgctctactgctctctcattggagcaaagaggttaaagaaaagcttcgagatcccccaaaaaggatcatgctcatgtcctcgtataactttataatgacatcgtgacagaaaccaaatgctactactacccaaaaaaaaaaaaaagagcatagaggtggggctcaacatgcttcatgcgagtttatggtgtttgtgcagtggtgtacagctacctgggcacctagcaaagggcagaaatccgttgacggccacaagttttgcgatggcaaagctcattggttgaaggtgcactaatgcacaaaatccaggattcgtagctaaaagacagcgattgaccagcagcgagtccactgccagggggatactatacgaagttgtttgggacatgattgtcttaattgggcggtgctttgtttaagttaatctatcttttgtcgcttcacgtagtatttttaatgcaataaaaggctcccttcacatttcgtctttgatctttaatcatcatcgatgacccaagatcacacctaatggaggcggtggatgctctttggttggaatctgatggagagttggagagtggagacgaccctgttcaatttaatatctccaatgtttgcacatatcatgtacggaatgcataccctaccaaatgctgctatttacacaaaaccccggatactatgatttatgtttaatttgtaaaaacccacatgaactttaacatgtactcccttcttctcaaattaattatcatataagattatgcaccaaaaataaggacaatttaagtcacattaatcaagacaccatgcacattcttccgcaatgcatgcatcaattaaaaccccataccaattacaccctagcatgtgcatattctcccatactgcattaattgtattccgatggaatccgtatccatatagttatatggtgatcaatttgagaaattttgaattatattacatgatgatcaatttgggaaggaggtagtatcacataaccacgagtatttaggtgttaagctcttattaaaccgtaatgttaatcaatccatcttattactgtagcaaaataaaaattaatccacgtagaatactacaacatttatacgacaaacttaaaaaaaagctatatatttcagatataattttggaacttataagtattatatatttaaaaaataatagtggtagtgtggttttataaaattaaaaagtcatagtacccatgggtatgtataacacatcgctatgattgtctttattatagagcatatatattatattatctgaggttttctgaaatttattttttaaaaagaattttctgaaatgtactcccgtgggaaacgaaaattgcggatgaaattcttgtcaccatcggattaaatccgctatccttacccaacaaaaatgacctctcaggtcagacaaatcggtttttctgcgccgatatccgcattgacgtgataccagtttactaccgtgatcctaacccgtcctgcgctgcgcggcgcggctcgctgttgcgtacgttgcgacttgcgagtcaaatacgttgctcctccctccgcaccgggcggggggtccccgcggcataagtaaaaaagcgaccggcacggtgggttcccgggctgacggcgcgccatcggcaagggccaaaggaggggctccacgccgcgctgccgcgctgtgcctgctgctgcttgtgcgcagcgcgcgtcgggggcggcggccgcgcgacgcggtggtgcagctgcctgtcgctcgcggcctcggcggcgtcccaccacgcccg

SEQ ID NO: 102538 - DNA, 1585 bp, Oryza sativa
agtgctattcattattttgcttgctcatgatttttcattgaagtatgcatctgtttttcattactatcataaggtcattatcattacagctgttatattacatgccgactgtaccatgtaatgaatagtgctcccgtagaccctctgtcctgtaagatgtacactcccctgaatttgttagctgtagcatgtgacaatccaattattgtggactgtgtaaagaagaagcattacaagtttttactaaataattactttaggaaaaaaagagcaactttttctgtgttgtttcagtgtactattgtgaactgtggtttctaggagctaactgggaggcttctgatttttaattgtttaggtttggatatcatgaaaggtcccatattggagatcacttgtatatagcatacagtaaacttccaaatgaactgaggtatttaagctgctcctttgcagtttatttttatacgggtgtgcaatctgtgactttaaccaccaggcaatgcttgctcatagcaaagaagttaaaatttactaaataaggctacaaatctgatcaggactatcagaatgttgagttaattcattcttagtactttcaattaaccatgtattatttatcaatatttaaagatcgtataaaacttctcctgttcttgccatttttcagtatctttatcaatattgtgtttttctatgcgtgatataaaatttgaagtatcctgtacatttatcccctcaccagtgctaggaaattttgggttctacattctttagtttcatactaaactatatatgcatatcagctatcactctttgtttcttatgtcttggacaataaataagctcagggccttatcatttgtatggcaatttttttgtggtatggcaggttgatatgagaagctcataagaaaggcacaagctttgtcctcattaaggtgcgtttatatgataaatattgttcccgttgctggatcactaaatttcaacaaaccatgtttattttggtcatagattcagaaaagaaaatgagtttgaatgaatattgtgtacttaaattgctcctaagttggttcaaccttctcaaaaaagatgtgaggcaatgactccagttttttagttctgtatacagtatgtatttgtcaccctaggaattatttgaggggcaatatttttatgaatcttaaagattgaatttcaatccatctgccctggcttgaaggtaaacatgattttattttaagattgcattttagtttacactagatgtacactgtactactgtagctaggtctgttgttttcatttgtgaaactcaattggtgtaactgctgtaatttaactgcagatctcaaaaccatgtataccacaattggtgctattaagtacttctgcatcaatattgattattgtttgttttttatacaatacaactctgttaattagtgtggaatcacttcacccatatccttttgggatttattgggatcaattgtttccagagtgtgcaagggctatgtatggtgcttcagggtgctggtatattgcacaccccatgataatttgcctatacttccatgaa

SEQ ID NO: 102539 - DNA, 890 bp, Oryza sativa
gtgtaggagataataaaaacaccttgacttggtaactagccgcgtaacatcagtgttctagtatcattcgtttacatgtacatgtatttattgtgtgatagagggggttgacttcgtcttgttaagcatacatgtcgatactcgattgttctcctgaaatttgggagggacaagataaagattgcaacagcatcaatgcttgaagctcgaaccacgcaggtcccttttgaggtaggtgatgacagagctcccttcatctctcgatggcgagcaatgagttaaaagaagcatatatgtacaaacgcattttaaaatattcaaaaagggatgacctcaaagagcgggggtatttaactttttgctacttttaagacattaacgaaaaaaagcggatgatcgcacaccgtcccccgcgtggcgcgtcacgtagcgcgcggagagagagagggggggacctccctgtggcgacgcgtgaccggttttttagtttgtatttttctatcggtttttttgtttttcagtttttttctggattttttatttttaatatatacatatacaaactttgtatacatatgtatgcaaagttttgaatatattatacaaattttacatacatatgtatacaaaatttgtatacgttattcttttgtatttttttaatatgtacatatataaagttgtatatgtatgtatacaaagtttatatatttaaactttttatacataaaaaaatgtatacatacttaaaaaaatatacatacatacatacacacacgtatgtatactttatatacatacatacaaactctacaaactctgtatatatgtatagaaaattatacgtatatacataaagtatatactacctccgttttttaaaagatgac

SEQ ID NO: 102540 - DNA, 735 bp, Oryza sativa
aaaaaagcaactcagtgaagcgtgtatagccgcaaattaaaaatctccaatccgaattgaagttgtactgtgacgggaaaactgttgcacatcaaggaaaaggttaaattactattttcacaagaagtgagctgattcgtgttaaatattttttttgaggtgaaaagtaggaattttgccgttttataggtagaaggggaaaataagtttaatagttttacataactgttacatgtagtgccctccgggttggttgtgttcttgtcatgtttcgcttccttgtttttccttgtgtattttctcttatcttccagggctcctgtgtttgcatagctaaaagctttgccatatgtaagaccgtttgacgtaatatattcaagtgagcaattctccccctggtgtcccgtaaaaagaagccataaacaaaagttgtgctagaattagttgtttctatgtgcttgactgtgagcgtttaattcatgcatgattgtaaaagcaatctgctcttcactttggctagtgtcctcgaaagttattatgttcctctctagctagatgaaccaccaagttgtaatttggacccccaaccactcctttctcatgttctatggcttgagtttggttagagcaaaccattgctcattgaggcttatgtgttgtgtcaaaccattgctcattggcatttccccccatacatttaccatgaattcacattctttgagcaagtgatccgtc

SEQ ID NO: 102541 - DNA, 1243 bp, Oryza sativa
aatcacttcatttaatttgttggttaaaataaatttgtattttctctgtttgcaccgctatactaatttctctcttttttaaatttgccgcgattattaattttcattctctcctctgccatggatgtactgaaccggacggatagatttgattggctacgagggacaattggcaacattaaataaggaaaaaaattgctgagatgcaacttgacattaattgaattatgcactatcgactaaagaaaagtcttacctaataaaacagccaatgcccgattgcagaataattgagtgagcaagtatctacttgtatgtgggaatctaattttacttctgtcatatgtgcagacaaactatgatgccctattgccctcttgcttcaaactaaacttagtatgaaaaagaaaaatccctacagttagatcctactcatgccaataaagcatgaagtgacattgtaaatttgcatggttgatttgaatagatcttgcaatgatttgaatataatccagttgcatacctgtaacccttttgttcctcattggcaatgtgcctatggctcttatcccaatttttgctacctttgggcctcataccagggagaaaatggatagtgatatgcactccatttctaatagagattttcttttgggtgtcaagtggcatggtggtacttatttatctcacgtctactaataattggtcagaccaattaaactgtcagttaattaagtacttcgtccatttcaaaaatattctggtgatccaacacatgaggatgggataaacattctgaagacgagtgcaaatagtcaaaaacacagcccgagttgagcaaccaacaagagtccacacctgaatggacctgcccatcatcataacacagccacgaggcctgtgctgattggccggatcttttctttttcatttctgaaaaactagaatggttgaaactaaaagaaaaggcaaaggaacaaacgctacgggctaaggaaggaagcatctggtaaggtataagagagcactcggtagcaggctgccattttcgtatcgtcccctcctctgatacggactccgttttctgaatagtcggcgctacttgtctacatccacctgctctcatcaggaataaaaggggctttgcccacaacttatcctcaggatctaatactgcgccaccatacgtggagtttacagataattcagccttgatgcaaagtactatccaacagagttgtca

SEQ ID NO: 102542 - DNA, 1601 bp, Oryza sativa
gcaatagtggcggtttcctgcggacaaagggggagagatggtagcaacaacggttggcagcacacgcttgagtcgcctgccagttgttgtaagtaactgatttaccagcgcttcgaaattttttcaggtcttcacatcccttgccagctcctgcgcggttgctcccaccgtcggctaaaaaaaatgagttcaatgctcttgctttgcttggtaggcacgatttgctgctccgctgcagcaccaaaaaccactaatgcgttcctcctcttccttgttctctttgtatccttgttgttgttgttgctgctgctattatgttactgcctccgcattgctctttttgatttgttgttgatttgcttctgctctgtgctgacctcatgatgtatgtgatgccgtgtactgctgccatggctagagaatagaaggatacaaagagaacaaggaagaggaggaacgcattagaggtttttggtgctcaagaactgctcgatgaaatgtttcttgaggtactactaaagtttgaatacatattgaattatctttttagtacttttacatgcggaaaccttcttccttgtttttgttattatattttaatggaaagtaatttatatttaacaaatatttcaatggctcatccatgtcaatcaactaaatcaataagaacatgcttagtttattcccattagggggttgtataaaaaatacaaaacaaaatagatgtttggtgattgtatttacttgatctggcttttggtgtgctcctaagcaagtctgtcaactttttttgcctgtggacatattgtaggggctcatccaagtatttgtctcttctatcgattggcatgtagtgatttagtgccttcctctggattgtgcacacaagaactgttggccaggttagtcaaggttgtttagtgttgttaagattatcatgaatgcatactcatccttattataaacacccctctccccattatctctctctccgcatgagggatgagctgctatatagttacaattgctttttatcacaatctcacatgtttgtttatggttttttttattacaccatgtttcatttattagcttgatcactatttctccttcttatatactttagttcagtgaaagtattttcagggaatacggcaaagaattatgcatcattgtattaagagaaattaagttcaagaaagaaaataaaaggtgttggcctaattctcgttggttcaggtgtgaccaaatcgactaccaaaaaaactacaaataagctagggcagaaaacctgcatccatcggcatcaggccaaaaagaggagcacacaaaaacttcagtccctccactccaaacttctcttggctcatctctatccgaatcttgatatgaatacttcatttgccacctttttttccatttgtattcaccatctcagttcatgttctatccttttagcctttttcctatcatttgcattctccaacgcatttgtcaatactagaacccttttcattataagaattccaaatttattcaactacatgttgtaaatcctctcaagaactagttgatttcaaagttaaacgggctgcaggaat

SEQ ID NO: 102543 - DNA, 655 bp, Oryza sativa
ccatgccctgcgccatagtaccaataaggtatggcgcatggccttgcaggcgaagaggttacgtccacccacgcccttcgacatagtgccaataaggcacggcgtcaagggctgcggacgaacaggtttcgccaacccacgcccttcgccatagtgccaatatggcacggcgtcaggggcagcgggcgaagaggtttcgccacatgccatacccttcgccatagtgccaatatggcacggcgtcaagggctgcgagcgaagaggtttcgccacacgccatacccttcgccatagtaccaatgaggtacggcatcaagggttgcgggcgaacaggtttcacccacccacgcccttcgccatcgaaccaatgaggtacggcgtcaagggttgcgggcgaagaggtttcgtccacccacgcccttcgccatagcgccaataaggcacggcgtcaagggctgcgggcgaacaagtttcaccaacccacgccctgcgccatagtaccaataaggtacggcgtcatgggcttgcgagcgaagaggtttcgtccacccacgcccttcgccatagtgccaataaggcacggcgtcaagggctgcgggcgaataggtttcgctaacccacgcccttcgccatagtgccgatgtggcacggcgtc

SEQ ID NO: 102544 - DNA, 824 bp, Oryza sativa
cccgtgaggtcaaattataccgaccgcatgggataataggttatcccagacggctagcatgtgctagcgcgacggcacgaattatcccgtgcggtcggtataatttgaccgcacgggataatagagtcagccttattgcaccacacgggataatagattatcccatgcggtccgtataacccgaccgcacgtattccgtgcggtcgggccgcccgcaggcgaaaataaagattttcccagatgaggagctgcaggcgggccgggcgaccgcacgggataatctatccaaccgcccgaaaaaataggtattgtagtagtgcgtgtaaataggaagtggagcctgggttgtggagatcatgcctacgcagttagagtaaaggctaataatacaactagcagttagagtaaaggctaataatacaattagctgcttactgtatatagtggttacagtttacctctcagacaacttatatagtggttagctcttaactgtaaatatatggtcggcatgtctctctcacatattttattgatttttgtgcctaagctggttgtaagcttaccacccgcttcccctctctctcctcacctctcctctcctctctcatctacctcacaatttagtctcttacagccttctattatactttgctcttcggcggccagtgtgtcagctgggcttcaaaacagtataccactcatttaattgtgggtgtgtgtcataatataaaaagccagacgtgcgtcgtcggtgacgttcgtcgccaaaatgtcgtgtgcgtgtgactccaaattttgctattgtgtgttgtgttcatacc

SEQ ID NO: 102545 - DNA, 1877 bp, Oryza sativa
actttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtcacatgtggacaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttaggatgacggtgaatccgaaagcgggcagccgcagagataggaaaatcagcggggcaagggcaccataccgccgcctgcttaaggaggagatgcgggaaagggtggaggtcggctaggagtagagatggcaatagagacccataacccgagacccgacaggtttttactctattagaagctaattgttctaactcttatacacatgggtctactaacgggcgaaaactcttatctattgggtacatggctatgggtccgttctttacccacccgtacccaccaacctgtgggtgaaaaaaaaccgttgattgagtcaaactatgagcaatataagtatcgatgactactaaatcatagcataaaactcatttcacatcttaagtattgttctagtctagttatatgaaattgttatttgatttcttgattatgtaatgtggttgtataattttttttcctcacctttgaacgctaatgttaattaatagtattgttgctaaagaaaatattgatggtttacaactctaatatggctaattatagtacaaaattataaatgctgcaagtcaattatatgggtatgggtatctatacccgttacccacacgggtgtgggtatagggacgattttgtatccacgatggatatggatatttaagtgagaatatttaaacatcacgggtgtgagtatggggcaagctaagagaacccgatggtatgcacccattgccatctctagttaggaggcctcgttgacatcattcgcgccttccggctagctggcggggccagattgacggtattggtggggcagattatggctagacgaggggagttagggtgtgtttagttgggaaaagaaaatttttgggtgtcacatcgaacgtttgaccggatgtcgaaaggggttttcggacacgaatgaaaaaactaatttcagaacttgcctggaaaccgcgagacgaatcttttaagactaattaaaccgtcattagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgaggagccgcaccgagacggggaagctggcctgaggaggagggcgggggttggggggggagggggggcgggagga

SEQ ID NO: 102546 - DNA, 7255 bp, Oryza sativa
gttttctcactgactagcggaccgatgcaaatctatgttgaatttttaggtcaatgttttcgttttcggaggatcgatgttgggtgaattataagattttttataaagaattatgtcggtaaagctgttgatgcatgcttggagtagaacttgttaatcagctgtctgattgtaatttgcattcctcagctccttttcttagttttgtcttctcaacactcaattcaccatctagaacaatcatgcgcacgcatggttgcggtacattaatataagttgaaaattaatactagttcaattttgttcagaaaaaaaggatagaagaaatgttgcttcaattactatgacgatatcaatctgccacagaagacagaatctacacgtcgttttcagatatggttaaactattccacagcacaaaactttgaaatattcagatacaagtacaattaaaacaactgaatatatatatatcttgagtgtctcattttcaatgaacaaatcgtcagatattcattattagatacagatacaggtcttcagaagatatcaaaagcgaaatattatattatggtcgatcgaccagtctggggtattgtttaatttactttcgttagtgtgcatgcattaacataatttgtgctcaatttaattagcttgccatcacgatatatatatggactcgatcgatcgagctgtgacgtggcattcagtttgtgtgtgaatataattaattgtttctcctatccgtcatgatagatatactcctaatcaataggtacttgatgaagtatataccatgattaatcaattttgacttcgtgtgtgaatacaattatttccagacgtttgccgtgatggttctgtgttagtagtaccttgtgatggtaaggtgcaattaaacgtaaggctgattatgtcaaaactgggggtggctattgcctaatgcatgataaaaatatggtgctttgttactggaccaaaccaaaactagagcagagccaaattaaagttggaccagctgttttgatcaccttgatttcaccataaaattggcttaaatattggcataccatgtctcatattttcagtttggtatgaccaagtattttgctgaattctgaacgactatgtggaatggctatttccttgtttcatgtgagcacgttcccgaattgctaactaatgtattttatgtaaaaaaattttataggtaagtttcttaaaaatatcaaataaatatatattactcaattaattatgcactaataacttgttttgttttacgtactataaaaatcacagatgaacctctgttttgaactcagccttaagctaaaaccaaaatgaagaacacatttaatatatagacataacctagttagttagttttggttctgaccacatgagagcatcaagcaaatcaacctaaaaaatgttcatgttgttttcctcatccaaataccacaggctgcccaatgcttgggctttttctcaacaccaaatggacaaaagaggcttcccaaaactcctattagccattcatcagtttcaaaaaagtctccacagtagcaaagagctaatataaaaacacaaataagtcacgatatcttgtagtaaaattattattttttaccaggctagcgttcattttggcatgaacaaaattttaacttcaaacattgatcatgtgcacatttcctataaacatgacctagctagttaatttgaatttggctcaacacatggcccacatgagagcatcaagcaaagcaaaccccaaatgttcgtgttgtttacctcatccaaatttccacatgttgcctctatgcttggatctcttaacaccaaatggacaaaagggattccccaaattaagtttctagtagccaattgatgattaatcatcggtttcgaaagagcgcccatggtagccacaatcctcgtatgattgtaacaattaataccacgacaatttcatcacctcggtctcattttcttcaaccacatgaatatatacattccgtagttatattacgtgtaataacaaatatcttctagcgtataagaagccgattcgcacttgtcaaactttattttaaacggaaagtctaaatttcaggtgactgaaataaagtctctttcttaaggctgagttcaggctgagttcgggatgcaaggttcccaaccttacctcttaaaaaataaatcaatataattttttaaagtgatttttctatagaaaacttttgcaaaagacacacagtttaacaatttgaaaagtaagcacgcgaaaaacgagagaggtgagttgagaaagaagggacaatgatcctcgatactcatttctctttctaatagaaaaggtttaaaaatgtagtaatacaatatataccaacaaatttacaatctaaaattgcacattatataccactgtaaatttattttagaaacatagtgcaaatgcaaacgaacagaacgcgcgcacactcatccgtatggacacacatgtacacactaccccatataagcacctccgagacagaagattggaccaacatatattaaaatttattaaatcaccacatataccttagaaatatactccctctatttcgaaatgtttgacaccgttgactttttgccacatgtttgaccgttcgtcttattcaaaaatttttgtaaaatatgtaaaattatatgcctacataaaaatatatttaataatgaatcaaatgataggaaaagaattaataattacttaaattttttgaataagacgaacggtcaaatatgtgctaaaaagtcaacggcgtcaaacattttgaaacggagggagtactattttaggtgactgaaaattttatgtgcctgaaatctagccattcccttctttgtggcaaaaccatatatatgtgttgcaacggcggtgggtgtcagatccatcggaatagtcaaattaacatgtcacaatattcatacgtgtgatactacgcacgaaagtttgaaacagacgagcactcgatcgatcgatcgatgaaatcctgaccgttgatgcttgatcgtgtggatgtacgcccgatcagcctacgtacgtgtgatcggcggtgtgcaaattagtcctcggaatggctcgcgcattcacaaccagcactgggatgcacgcacgtactgcgttacacgtctgcattcagttgtggaatctttcatctaggaccttacttttgagatatattacattcagattcagttctttctctcctcctttctcaatttcttctccatggttttttgcgcgcgcattttttaaattgcgaatcaatgtaattttttataaattatagaaaatttgttttaaaaatcatattaatccacttttaaaattttttaaattaatacttaattaattatgtgttaatttatgcttcgtttacatgcttgaaggattatttcccaaactggtaattcttacttaccttagtagttaaatacatgactttattcgtatttaaatatattactttattcggttgagtttgactactatgtttttattagaaataacgtcattgtataaaaaatatagtattgtaaatgtacatataaagaaaaacttatgcccaaatatttttttataatttcaaataaatattttaagaattattggtggtcgaaattttaaaagtttcaccatcaattaatcatacactttaagtaggagggagtaatattttttcattgcttagttttctttgccgagttggctgaaaataatcgactagtttttgctatatataaaggagaggagagcaacttgcgagccttttttttctcttctgaatagcagaatgattttacaatcactattcaacgtacgtacgttatagacaaacaaattaactgttataaagttaaaggaaatatgttttaaatacattcatatataatttaatttaaaaaaaaactagataaaggccggtgcgttgcaaagaatattaaaagagataaaataaaaaataattagaagtttttagcatagttagttcattaagcatatcatatgatgccatatccaaagaaaaacatttacgtgtaaggaccatatgatttcgcatgttattttgtggcgttagagacggcatcatttaaaatttaaagtagtatagaaaatcgccccatgaatttatggagtatatataggagcttgaaagtgtgtcggaagtcggatctatcaattcttccttccaaattagaacagacccgtacgtataaaacaacattgttgttagttggcaccccccgttagaacacaaaacaccaaataagttcgttcgtcaatttacatgcctgaatttcagaggttgttgacacgagcgaacgtaagtaacacgcacaaaagactttaattagcgcatgacttcgaacacgcacgtgcggtctcgatcacaactcgcacggccccacgtgcatgcacacatatagggtgtatttagttggggaaaaagaaatttttgggtgtcacatcgaacgttaatttcagaactaattttagaatgaaaaaactaatttcagaactcgcttggaaaccgcgagacgaatcttttgagactaattaagccgtcattagcacatgtgggttactgtagcacttatggctaatcatggactaattaggcttgaaagattcatcttgcgatttcctccataactatgcaattagtttttctttttatctatatttaatgctttatacatgtgtccaaatattcaatgtgatgtttttggaaaaaaaatttggaactaaacgggcccatagtctcgcgcgcgcgcacacacgaacacacttagtacacgaagtagtagcttgtatgcttacgccgactaagctgctgatgtcataattaggtttgcaaatggcaatgacgtcaggatgacatgtcacatgtcgcttgtgggcatatgcatgcgagtgtgggcggaatataatgcttgtccaactagagcccttccagaaggctacaatttcaggactaattctataaaaaatgatgaaagaaattactaatatatttagggtttgtttagattgatgccattttaaactataccattttaatagagttgttaaatatatgcatccatttagtttcttgccaaactttggtaaatacataagaaatcttatcaaacttttgacaatgccaaaatttgataaggttattttggctacaatctgaacagcctcttggtgtgaaatttatgtgaaatttcggtgtgctgttaagggtgtagtagtggttgttaagttagtagaggagctttctacctggataagtactgctccctccgtttcgaaatgtttgacgccgttgactttttagcacatgtttgaccattcgtcttattaaaaaaatttaagttattattaattcttttcctatcattttattcagtgttaaatatatttttatgtaggcatataattttacatgtttcacgaaagtttttgaataagacgaacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttgcacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgagaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttg

SEQ ID NO: 102547 - DNA, 640 bp, Oryza sativa
agtgcaacccacaatattgattactaatgtgatgctaaaaacaaaaaattacaaacaacaagttgaacatatatactccttaaacaagcgcaaccattgacaaacaacggccatatatagaattttctgaaactgagaaaccaaacattgtctgaaactcatcacaaattcagaagccaaactaggagtgaacaaaagactatgtcaagtcatgccccatttgccaagaagactttataggtagaatagattgactgctaattaagttagattgtgatgaaacaagatggacttgaagctatgactctcactagccgtgttgaccaatctgcctccaaacttgatggcttcacactaacttactcaacggggcagtgtaaattgttgggttgtttttagcagcctaagctgaacaattttttcacacttgacgtatttgctgacagagctatactttgatccagtctattaccatctccagactttgaattttgtatgtggttatgtgtgagctcttgacctcagatttttggaatttttcaaaaagttatcttctagaactacttatttgtctcattcatctgttggaaaaatgggttcttgggatggaactgctagctggcaggaaaacgtttaatgg

SEQ ID NO: 102548 - DNA, 548 bp, Oryza sativa
aagtagctagctgatgaaaatctagaaaataagttttctaattttttgtttctagtttattttctcctttagatagtgaaaattatttacatttcggcctccacttttagacacacaaccaaatttaattcattttctaaattcaataactacagttctcaaaatttaaatgaaaatctgaattgtttaagtaagctagagattcttgaagctgcaactatcggcatctcccatataatgttagtacttgatacattgcccgcatttgcatgtgatttttggtaaatgtggtacgagaggtgcccactaccttttttgcctagccaactgctgcaacagaattaagtggatctgaatcattagcaggaacacacaggagagctgtgtgcatagtgaaatgaatttggtctactgtaacgacttggtgattctgtaccgaagtcgtacatacaacacgtgcaagagtacgaactcattttataattgatttcgtgcaccatgcttttgtgtgcgcgtgtgtgcgtgtgggggggggggggggccttgat

SEQ ID NO: 102549 - DNA, 535 bp, Oryza sativa
tcgtgctcatccctcttttaaattcaccatgaaaatttggaagtttgtggcaacagatagtcatactggcttatgagttgtgacgcaaaataataatttagagtttatattgatgcatgtctatgccatatttggttggccctgaaatttactgacgaaactcatcatctgtgtaccgcaggatgatcatgtaactcctaaccacaagctcgccagaagggcatcagtgagcagaagccatgggaaatgctgatttgaggcccttccacgcatgctagcctttactaatcacccaagtttgcagcaatactataccagtaatttcacagcttatccgaatcaaaaagaaaaaaaaataaagacacagcttctcaatcataagtaacattcgccagagatccaatttggcacatcgaggagcgtatttacatgtaattctttctgaattatgttgggttggacatcatccccagtatgttgcgctgcccatgatcagacaggataaaccggctaattaataatccatgttagttac

SEQ ID NO: 102550 - DNA, 593 bp, Oryza sativa
caggcgtgacgagaaaccaacaatgatttatgaatttctttgctgaacagcaaaacggaaaaactaatcaactaccaaataggagaatcttcaagaagctatatgccataaagcactgaattggtaagattccactccatagatagaaacagtccccaatacacttgcacacaaaagcacaatcacacatttaactcttgtatcagaccattcagggtgtgtaaccacaggatgccaaacagtacatttaggagtactatgaaagcatcaaaataaggaaagttacgcctaaattcataaacgaaaaatgagttgtgagttactgttttcattgtctcgtctagggtggagcagattgcaaatttcattcaccgctcctatgcccaagcaaatcttcgtactcataggctgcatggattcaattcagcaaagtgtacctacagtcctagacaaggataagtttgtcggggtctgactcagatttgggtgttcacacttgtgaggtacttactagtcagaatcagacaggtgttgccatgtcggaatccgactcagacacgatgtccgatttggcaaaatagttttgggcctgg

SEQ ID NO: 102551 - DNA, 520 bp, Oryza sativa
gccaaattgttttacttgcagctttctacaaagggtaactagcagatgttatgcgaccaggaaggacaggtcacatttggcatcttgcgagggatagttttgtgggtctgctttggggacccatctaggtatcccctgttaatgaccagcttagagaatcccttttggtgctgaattagttagctacttgttgtagatgctcctgttggaatatgtgtccagatctttatatgatgcatactccacgactagactaaagataaccagtaaaggcttttgtttggattgatgcccaaaagaaccttttataacaaaattaagaatactacaagcgttcaagtaaacccaatcatgcaaaatacgctagctatcctgctagtgttggtaatgattgtagaatttatccttagctaccagaaacttggtatggaaacaactttaatgtaaaaaaaaaaaatcagccctagcaactttcaaaattctgactttaatttgtcagcaaaattgttcaactttatta

SEQ ID NO: 102552 - DNA, 694 bp, Oryza sativa
gactagtatgacatatttgtagggtcttgaatagatttggccacagttggatgccacatggactccaatcattcatacatccaatttatgatcagacaaattatttgaggatctttcttcatgttggctactttccttttatttctttttttcttctcccaagtggttttgtttccttttccaaaagcttaattaaggccggcttcttgtcacctgaatcctaatcattgcacaaatgctttatgtccttttgatgacctattgtgctattaattcagcaatagcaattctaatcatcatcttcccactagggactactagaacatatctaattcagaaaatgatctaacaaacccattcttttgttttgtgcagaaagagaattgggtgctatggtttcttcaagaaaaacaaaagcaaaaatggaggtgctgaagattagaacatgatgcaaatgaagaagtgggctacatccaggaagaggatataaagcttctgtagtgatctgcttatacaacaagcatcagcatgcaaaaggagctcatgcaatgatgcaaaaacaccaactttgcatacataaaatcagtgcaagatgcatgaaacgatatgacaccagtgaaaagtgcaatgtgcaccactatgactggctcacacacacagagattatttagagagggaaaggaatgcataaaaa

SEQ ID NO: 102553 - DNA, 2927 bp, Oryza sativa
cccagtgacattctaaagtaatgcataagttgaaataaaacaatagctttaaatggggtcaacatgctcaagggattgtttgggatctgtgtgacttgccttgcaaacaagcgtcttcaattcgtcttcaggaatttctccaacgaacgaacgatcctccgaaacaacggaaaactaaacctagaacgcaaaacaaggaaagaaactaataaaaaccaaataaacagtacaattaaagttcataaataggtagagcttgaatttagatgaattatgagacttgaacgacctcattccgagttcgtatgaattagatatgaattttacaagatttaattccaattaaacctattaaagaaaagactattccaaattgattaaacaatttacaaatgacttatagctgagacaaaagattaaaacatcctccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacggcagcggcacaacagcggttgcggtggcacacatacagcagcagcgcgacggcgacgtacagcggctaaacagcgacacggcggaacaaggcagctagcgcagcggcgacgctagggcagcagctagtgacacagcaacggctacgctagggttagagcaacagcggcggtgacacgaccgagggattgaaacctaacccgaggggacacggatagaagtctcaccgaaccaaagcgaccggagagggagggtcgacgatgacgatccggcgacacacacggaaacgatgacgacgctagggccaaacaacagattagattagattagattagattaaatccctagggataaactacaccggtaaatgacatgggagagaggagagctcaccggagaagacgacggcgacgaccaagacgacgacggcgacgaccaagatgacgacggcgacgggtgacggctagcggcagcggcgagctagggcagcggcggctagggtattggagaaggcggctaaacaggaggaggaggaggctaggggcggctgaaaaaaacaggaaaaagatggggaggggttggtttaaataggggaagattgaataggattaggtggggccaaaggaggcacggcagagggggagagggagggactcggaggggagagggcaggggaggcgtgcgcggctgggagagaggagaggcgcacggctgggaggaggccgagagggggaggggaaaaagatacgggaggaggggttgcctagaaaggaaaggagggggaaacagatgcggtgccgttttgggaaaagaagaggaaacggaaccagaaagagaataggactcggctcgtcatacaaaatgaaaccgcggtggcaaaagaggtcggtggatacaacgaaccgcagacagggagagtgaaccgggaatgattcacaaccaaaggaggaaaaagaaagaattattaattacttttctaattaaattaatcactgaatgatctttcatttattaaaaatacttcctatcctgaaataattctgggaaaaatccagaaaatacttggacattaaaaatatttaatacaattttatctatatcaacttaatgttcaaaattttcatagattttattcacacacttactttaattattaagtaatttctaaaaattcctttttcacaacgatttataatttagcgattttcagggtgtgacatgtgatatctcgcagcacctatcataaacagttgagcaaatcggtcgatctgcattatcctttagtttgtgccacagccaacagggaaagcggtggtaaaccatttgcatgacaagtggaactgtggaccagtctatttttttcttacccaaaatttttacttcaaaaataaaaagtttgacccaagcccgtacacttgtgaaaaatggacatgtgaagtgacagatcgcttcgcttatcctaacactactggagaaaccctcaaaccgggagagaatccgagactaaatatgtgtgtgtatgtatgtacgtacatacgtacgtacgtatgcatgcatgtatgtgtgtgtttaaatacatattatatggatgtatctacacagctagtggtagctggtttgtctaaaacagctaccactctatctataatagggaccatccacctatacttcaaatacaattttctcttaaactactcatccgattttcgatccgattacaccgttgtgttcacaacaattaaatctttacaacaagatctcacatgattatattttgatgaaaaatcacaaattacttttatgatatgtctaaattacttttagatttcactaagttacttcttaaatataaaaaagtaatttacatatattatagaagtaacttagaacaaaacgaaggtaactttagcatgtcatttgaagtaaatccgttttagagataaaaacatgactctatctagaaattaaattaatcagcacaaattatggaattaactaaaaaaataataaaagtaatcacctcagagcattatgaatgtataggaagtattttaataaaatctgaaagtaaattatatatatatatatatatatatatatatatattgaatctattctacaccctctcccatgggtcaaacccaccaccccaccctcccttgggcccaaaacccctctcccacctcggtcaaagcgtcctcccgccggtcaaacccgctcaccactccttcccccacccaccactttgctgctctcgtcttgcaggaattgtgcaataacagaacggtcatcgtgcagtaacaagacaatattatcgcagtaacaacgtcaaaaagtagtcatgatgg

SEQ ID NO: 102554 - DNA, 993 bp, Oryza sativa
acaaatacatttatatgtatacgtatacatttatacatgtatatatatatatacgtatatatgtatatatatatatatatatatatatatatatatatatatgagttggataatatgaaccaaggttcatatgcacctcaatccccggagtgacacgtgtacacaaccccccatgcatccgcagtccccatgcttgctgatcagcatggaagttgtacctgccttgtttgagctgctatataggccatgcattcagctgttggctaggtacatgttactatgttaggttgtccgttttacccctctcatgtacgtgtgattcagtaagaaaaaaatgaatgcacatactagtagcaatctttgtccgcgcatggtggccaactagccatagctcagttggttcaacaggccttcataccaaaaatatattcctaatctccactttgcaagtgtactttctcattattcaatctcgtttttatttaccaataatccccaataagattggactttgggtgcagctagcagattgaatttagaacataaaattattgttattttacaaaataaaattattatttttatcccaaaatataagagattttacctatatagttacatatgaaaaaaaatataaaacatatttccgtgtagtaatatggatcaaatccttatatttggatatggaggtagctcatatagttacatgagtaaaattctttacattttggtggtatgtacttttaatttataatttactctcgccattctaaaacataagacacaataactgcttaaagagaaaaataaaattattatcacattctagtttagatcatcgtaataaatacaatgtatatacccaataagattatggattttgagagtggaggatttaagaaaacaaattttaaaaaaaaatgtacgaaaagccaaattgtggtccttattgtttgactaggcatgacactaaaaatattatttccaaaatat

SEQ ID NO: 102555 - DNA, 1214 bp, Oryza sativa
ggcaagttcttagtttcaagttgagatgcattggtttcaatctccaacaaggaagtaagttctatcaacttcacttgtatcggcatgactagaacattctcgattaagtcatattttttttttgggttgacgcaagcattacctatctaatacattgattttatctttaactgcatagctatttatagttgaatcgacttagttaggactttctcggttaggtccgatattctgattaagttgatatttctctaatcataccgttgttttagataaatttgttatatccatcatgtttgtgcatatttatcggctaaatagtttttttgattattttcttcaatcttatactgtctcggttaggtttaatctaatagatggctgctaataagtaattctactaagccaataggttttatgctgtgtttttatcagagttctagccgatgtgttatcttgttactaattctcagtgttgtattgtcttatactcaaacttgtataatcaatagttaaatttctctttatcatcttcgatcttatattgtctcgattaggtctaatctatcaagattgttttaataaggagtggtttattgatgattatgcatatgtttagttctagccgatgatagcatatatctcattgtttatccgattatctgaatctacatcgagcatatagccgattgatcaaaaccctattgacatcggcaagcctcgctacatcacattggcctattggttagatgtatcttgttagttgtaggatcaaatgaactaaaatgccctttgatcttgttagttgtaggatcacattggccctatgatcttatacaatccatttatctattttgttggttgtaggatcaaactaactaaaacgccacgtacacgaatgataggacgagctatgcagatctctcatgacttcatgtacgacgaattccatgtcaacatgttgtcatgtggttccatctaaaccctggattgaatcggtctgggccgtcggattttggtcaactcttggttatgatttaatctaggttttccatctcagtgaacccgtggactacctctgtggacctagtctacggtggactgattgccgatgacatcataatttatctttgtcttctttaaagtagttataatttatgtaataaatctatttaatccttttaaataggctttaattggattaaatcttgtaa

SEQ ID NO: 102556 - DNA, 674 bp, Oryza sativa
tttgaaacaatgacgtagctcgggtcatcatcaacgggggtgttctggcagtagatggtgatggaggaccgctagacgaaatgcacctcctccttgcatactcggcagaggtgacaacgggcaaaggcgacaaatagagcagcgacgtgccccgactggaaggtagcggcggtgttgatttgcacaggcgagggtggcggtggaaagaagatagggggtggatcctatttgtagccacgagagaccatatccttgcccaagacggctatggcagtgctgggaaaaaactagagttctaccggatagagagagtccgagttcgagcccgattccacacaatttacttaggtatttttggggatttcttggggaaagggtagaggaggagataaggaacaaacgccctcaactaattttggaaaagatcaatagaggcggttggatttcaaggcgacatagactctggccagatgtaggggacaacactaacatgtgggatctcgtcccacatgttggtaggagggagatgagggaggtgggtcgggctagtgccttgagctagctaagccgagcggggagagagagggagatgggctcgatttgacccaaaagtttagaggcggtttttaatttattttatatttatataaccattgaattgatgtttgtattat

SEQ ID NO: 102557 - DNA, 698 bp, Oryza sativa
actgcacgataatcgtaattttactacgtcagttttacgagatgaagatcgaataggtgggctataggtaaagtttgtaggtggctttgagtgaggtctgattgatgtacaagtgttttgaacaattttatacatttggtaaaaccatgttactgcatgtatatacccatgttactgcaaattacatattctattactgcatatggagtgttaaagttcaaaataccaatatttaaaaagcaatatctcacaagatatgtattatttttaaaaccgttttcacagggatgctatagtgttactgcatgtgaaggatatatgggttaatgtctcacatgctaaatatatttgttactacacaaaagtggaatgttactacaaaggcaggtacacgttaccatatgtttatgcagtaacactatcgaaaaaatgtagtaaaacacagttactgcaaaaacttataatttttactgcactcttaaagtaacgatgcgatgggattgtagtaacgtgcaactgacaatagtaacaagtaatgttatagcattactacttgtggagagtcaaattctagaaaagccaacatttgaagaacattatctctcacatgatgtactattttttaaaatcgtttgcaccatgatgctagaaaaaaacgcttatcaaaactagatccatcatgactatatttaacaata

SEQ ID NO: 102558 - DNA, 1052 bp, Oryza sativa
tgagccgagatgcctatgatattgtttttaagattttttgtgttgttttctattgatttatcctcgatgtgttcttgccatcaaattttcttaaacatcaacttgcttatgtgtgaatttttttcttactgcagtcattccccaaatcagtatgcaagtgtgtattcaagtttgtgaaatgcaaatcatctatattttttattctatgtaaatttcacagaacaatagatattttcaccaaactaatacaaaactacagatttaagatggtgtatcacaaagctacagatttagcattaaatttatcatggaactactgtttatgttaatcacaaacctacaacgtttatgactctgacataatagtagcactagagatttaaactccaagacctatagttttgttatatataactctattattacatatatagttttggcgcacccacttctagttgcatagtaaatttggcgttaaatatgtaattttagtaaacatcactttaaatctatatttttaaaatattttgatcaattaaagtagctggaatgattttgaaatttactctttaagcaaccagcacagttgtaattatctcaatcggttgttgaacgtgccctagttttaaaagcaacaaccggtttgtggacaggtcgtatttgtattaaggaaccgacaatggtacttatcacaatcggtcgttaaacgtgccctagttttaaaagcaacagcgggtttgtgaacaggtggtatttgtatggtgattaatttactacttgtgtaaaactttcggacagtcacctagctatggcccagtactactagaagccagtacaaaacgtttaatattcagcacatgggtagctaataaggctttgcatcattgcatgaaatggccgggagttacaattaatagtgaagataagatggtacactcgggccagaactactagcagcttattaagtaccacgcaattaatccatatggacgaatcatgtgtccttgtcccagtaaacaaacaatacacacataagagggctgcaggaatta

SEQ ID NO: 102559 - DNA, 1880 bp, Oryza sativa
gtttcataagctcaatcaaccttgtgtgcaagagattagaaattatttttactgaaatatatatgaaaatgcatgattttgcagaggaatcggatgtacttgacttctgtatgctaggatgtacttcgtccatgtgcagcaacatgaacacttgtaagctagaatcgaaaacatgaaaccaaattaccatttttcaacatatagaaaagaatcttcggtttgctgtagctaatgtatataatcagtttttcccttgaagttgctgacaacgaagaagggaacgttgttgtggaacgttgcaacgaagcatgctaccacttctgcaacaagaaagctgatattgtcactgtcgtttcctaaacaactgcatcatgcaagcataagggactccgcactttgaatccccatgcaaggctagctatatatgctgccctggagtagtcataaataagttggatatcatgatatccaaactagtgtgccgtcgatctctcatgtgtgtttacgacactttgtatttctaataagccatgacatataatcgcattctaccatcttctattaaggatgcatgcatgtgaggatatgttgagtgatgatatcttggctaaaaaataaatataatcgagtttctagtttcatcacatatcatttctaacatttggtcatcaagaaaccagaaatataagtatatttatgcgcctttcatcctatgccctcatgcaacaactaatgtgttaaatattttcttccaaacgggaggcattttaacatgaacaaaaagaacttcagtattggagtcatgattttagatttgggtggtcctacttagatattttttaaatgatgtaaatataacaaggtaatagaattacatgttgatcaaagatataccataatatattaataagagacacagggagaattcccccctccccgggcaagcaaccgactgcggagttaaaacgtaaatcgcgacacacagggattgttttccactctgagtgccaactatccattgaagagttgaattttaactcatgacacacaggtagagttcccacgtactcccggtgaatatataccgatttaggagttaaaacttaacttgcatgcagttggtgcgtgggttacgaggccttatagattgagttaacattgatgatatgttgtcgctggttcctatgcagttggtgcgtgggttacgaggccttactgattgagttaacacattttttttgcgtgggattcgtttgaagatgtacttcagttaaaatttatcgatataaaaaattaacgaaaatcaactgtgtgagagttaaaacttatctggaagaaattgtggcgcaaacgaaccccgcagacatcatgtctactcgagaccgtatagtgaaagttaaagtttaactaatgtaaacaatggtgatgcgttttgatgtctcagtgctatgggtagcttaaaattggggtggtggatggttgtgaagctgatgtcatatagttaaaaaataactttgattaaccgttcggtgatgtaaactgtccgtatgtgaaagttaaagtttaactgatggaaagaatggtgatgcgtttcggtgtctcagtgctatgggtagcttaaaattcggggaggtggatgattgtgaagttgatgtcatatagttaaataataactttgataaaccgatcagtggtgaacactctcggtatgtaaaagctaaagtttaactgatgaaaagaatggtgatgcatttcgatgtcgcagataacgagtaaatattcgttctttgttccggtcatacgtcatagctatgattatcttaaaatccgggggtggtgggcggatgtgaagttgatgtcttttagttaagacataaaat

SEQ ID NO: 102560 - DNA, 2424 bp, Oryza sativa
aatcaaaactcttgcatattaagtcggctgatgacaaacttcacctaaaaattatggcacttgacgagatctacaactttgtaattaaaagtttgttcatttgagattgtttaggagttcaaatattcatgtatttgatcatatatctatgttttaatttatttttcttatatttccaaacgacctcgaatggtgacatgttctatacgaaaatttgagccatctacgagatctactactttttttatttaaagttgatattttgagaaagtttaggggtccaaatattgattttctttctgggatctatttttgaatttggtttttagttttgcaaacaaccttggatggaggcaagttctatattaatattctagagcacaatgagaatacaactttgttgatgaaagtagttctatataagattatttagatacttaaatattcgttataagttctggcctataattttacaaggtgttatttacaaagtaccatcttgatttttttagaaaaatcatattaaatctgattgagctaaaccaaagtcctatgagattgttatagtaattcctgtaatatgtcaatttttatactttcacagaattcctatgagattcttttttcccggtggtcatttaataatatcaagttacataacatgccaactcgtatagagaataaataacataagtgaacaatcatattgaaataagtgttctaagtaaatatgaaccaaatcatattacagagaatattgtaaggataatggaggagttcggtccatctcaatcagaaattttgttattttcaaaaagtaagggaaaaatgtttttgcatgtggatttctcgaagaaaaccggccttacaaatttttccctgacggatttctttagcaaacaacccgcataaatatacaacccataaaaactgatttgtgtgggcggctttgtataagaaaaaactctgttaaaatgggagcgccacaaaaatatgaaaaaaaagtatagttatttcaaactaacttaggtcatgataaactttatatgaaaattatagctctcgacgaggtctataactttgttgttggcatcgtctagggggctaaatattcattacaaactcttagatatatttttgataaaactgatttttaaaactttcaactgagctccggtagagatatgctatataacaaagttgcagagctcaacactatctacaagtttgttgtttatgacttctccatttgatatcatttagagtgtaaaatattacaattcttataataggtgaagccaaaagaatagcatccaatttacaacaaaaacttcaaaataggtgagatagtaagaagattacagactgaatgaatcagagtacctaggttctaatcctataaattgcacgcacacataaaattgcatgacttgtgaccctggacgcccaactgtgtatagatgcataccgaaatacaaaacattttttcgagtttttttgcacctacaagaataaaaattagaaaattaattttcactagcgtgtccttaagggtgccacccatggaaaccctcaatttcttccggcacggagttgcatgcgagtcagaaaacacccatgtaaactggttattggccatccgcacaaacattttctttagtagtgcaacgaatacacaaatacttcaaggataatagtcatgtcataaatatcattaggcgacgccacagcaaagcatcggggtctactaaccccgacgatttttaacaagcatgttataccccctctattttaccgtcgctgaccctggtcaaaaaaaatattagaccccagtagaattaattagttgaagccacttgtggttagcagtaatgacacaacaaacaaattaatatctaagctaggtcagcccagcccacgtaatgagaaaacgcttgaatttgagcccacaaggctggcagcccactactccactagtctccacaaaatccctgttttgataacgtattctagtattcctccatggtaattatggagtctcgacttctcgtcttcaggtcttcttgagtcacatctaggcaagggcgggcgagacgccgggatggctagacgggcggcgaacgggcgaatcagcaaagaccgaagacatcaagaactaggattaggtgatcacgcgacggcaagcgtgagcagccgagctgccgtttgattaggtaagtaggtaaccctatcccaattttttttcttccggggactatcacaaattcttgttttctcatctctgaaacctaatcttaggaatttagggttctgaaatatgcacttttcaatttattcagacttctgttacatggccttatgcctgatggtcgtgaacgaggaggaggattgaattatatattcataattattttttcctcccag

SEQ ID NO: 102561 - DNA, 1905 bp, Oryza sativa
ccacgcgatgtaaggagaattagttacccattatatcgttatacatacatcagcaaagtgatatccttgtagtacatttcattacttcgcagcctcgcaatttctttccgtcacgccgtcaccgtcatttgttctaccgccggacacggacatgatcgacacacaagtgaacgagaaaatcaaggagatttgcaggctcgagggggctcctacattctccgtggttgtattctcaaacatcccattcgtcgagttcacttgtgcttcattgcatcaaatcatattctcgtagtttgggtttcctctggacacatttttttttgtcatcaacttgagcatgagcacttagggattgtctgcttggtcaaacagtacgcaccaaaagtttaattctgaggcaatatgtgaggtgttttctccagttgcaaactgcagtaagatagtcatttattaacttcactgatcaaggaaccactaagctagtggttcaaataaacaacctcactggaaatggatgagaaatcaagaaaatatcattatgagtaaaatttgaactaaactctttagttcattatttttgttaggatcatcacaaacttttatctgctatagcacaatctaccaaaaattaaaggaaaaaattaactaataccaggaaaactctgtactatacttatcacaatgacacagctggtagttatcttttaactgcaaaccttttcttacccaagtttacaactatctgtccttttgctacatatcaaaggagcagtcaactcttatattgtgctgtgctttgatggttcatacagcgatacacaggtagatggcagttaaaattatactttgtccgatcgtcctctactttcggttaacattttttccccttacacaattattgtgtttttttggcagcttttgcccgagaccatgcctgacaccaacgacgtaaattcaacgccatggtctctgccaaagcggttcatacaagagccggcaatatttgtttcgccggtggttgttggccccggtatgccgtcatcggacgtgtcgcttagcatccagctcaggcacttcttactgaccaatggtggtcgtatggacaggttggtgttcatcatcaccttgatgatgtgcatatggtgcatcatattttttcgcggaccaccttttttttccttgcttagattacgggtttacatgttaatatttctggtatgcttgcagcgtgaaactgctagagatcgacagctctgttgcgtatggaaacaatgtgctggaatcgttctccgacgggagcctgacagaggagcttttcatagacgtgttcagctcgattctattcaaggatgacatgaagtacaggctagataattatggaaaaaggattttcattccgacttccatatcagtaacgtgaataacgccaatttctactgtattcctttttttcgtacggtgcagcaacatgattgtttttctgttcttttttttcgcgagatgtgactcttttggttcacaccaacacatggccacacttttttttttttgcagtttctcctgaacattgattttatcaaacaaaatggaaagatacaaattttccactgatgctttggccggaaacttgcgcgactacatccagcattggttagttattaatttttgcataaagactaatgccatgtctacttttttcccctgcatcgagcatcttttaaacccagcaatgctattgtaagtttcgtttctttacttccaaacactgaatggacagataatggttcctgtgctccaccactatcactggtctctagatgcaatcaacattgcacacaggctggttgacataatggatacaaacaactacactttgctcggaacactggtaagcgaccaccatgg

SEQ ID NO: 102562 - DNA, 801 bp, Oryza sativa
agttactttttaactgaacatgtataccccagtatgtatgaggaaaaagaatccgtgtttccactgtgagtaaagttaaaaaaataactcctttttcatcccgcctaatgttttcaaacacttcaaaggttattacgtgaagagtcaagcaattgcccaacaaacggacgtagcttgcttcactggaagaacagaatattagttaaaaaaattactctcaaaagcacaaatcaatcttgcaggcacgaacccgatgatgagtaaaaaaaaactagtttcgcgtatagggggcaacctgtacataatccatccaagtttacgaagcattaagttaaagaattactcgccattcccatcctgaccatcgatctgctgagattaaataaaaggattcaagaaaatctatgtatacttactcgtacgtgtgcccgtaataatagttaaaaataactattagtagcaaacacactaaaattctccgtggtgtatccaaaagctttaactatcggctagaagtaaaactttaactattattgccacaggtaatatcagttaaaatttaactggcattcaaatctacaccacgactgtaacatacccaagcctataaacctgagaactaaatttaatttaaatgcatcatgtggttgtggagtgattttaattgtttttggatcttaatagtaatatgtccgtactaacgttacggtgtcataacattttttcttaataagttattaaaattcgactgcaatgaaaataattttcctagaatctgtccatttaagctttcagtccaag

SEQ ID NO: 102563 - DNA, 3150 bp, Oryza sativa
agccaaaagttctatcaaggccatctgaagtataaatagccagctacatcctttgattatagttgagtcatcatgtgtacagaaaaaaagaaatgcagtattacctcatattatctttctactgctacaactttattaattttaatatgtttgcttcgtcgtagcatccgccactttggcacaaccttcatttaacattgtcaagttgtcaacctacatgctacagcacagcctcaaccctgcttccatgcatagacaagctctcttccaatgccatttttggcctcaaccatgcttccatgcttagataagctctcttctaagaaatatgtccttttaatataaagacctaatgagtttcagtgttattacatatctcttctatataggaaatatgttgttaatcaaaacaatgcaaccctgatcggcaagaggcaaagataaatataccatccagtatctcttctgtacaggaaatatgttaactaaaataatgcaaccctaatcagcaagagacaaagataaacatgctatcactgaatgtgagatacatatttatccagaacaagtgatgtcaagaaacatagctttagaaaattatctgtataatatttgtatgtttatcttccctaacattaattttctaatcgttggattcagaccatgtcccaatccactttacttcccacacattccaggccctaatcttatatatacatctcattacactatgtattgattgtatcagtacattctatgtcattgcaaaggcaagtttctctacagactaataaaatatgtgctatttgtttcttctgtagaatgatttggtctgacagaatgagaagtaaacaaaaatctgaaaagcaacatatactataaggaactgaacttcattcaactaccactacagagtgagactgattttacttggcactattatggagtaccaatcaagtggaagccgcagccttcctgaccttaccttaatatatgtggtatttgatttaacaaattaatccaccgaaaaaagtcaccgctataaagtttcagtgtctgtgatcaagacgatcagatcaatacacggtggctgccaagagtaccttcgaggggcgcaacaacccacaccgaatcagctacaagggttttttatagtatagatagaagcaacttccatccatccaatacttaacttattttatccaagtttgcatggcctagtgaagttataagtttggaatggagtatacatgtgttcctacttgccctgctgccgcacctccatggcaaacaacaaacagtactatctgatgctgtctacaaaaatcttagaaattaaatgggctgcatataactcttcttcccctgcaagaagcatttgagtgaagccattaaggaatataacaaaaaaaaattctgagaaccattgtacaaaagctcaatgaaatgaaattaaggagtacctgccggtgtactggatgtgaagaacagatatatatatcatgcaatggcatgcttaaataagtgtcctgacaatggcatctcgtatcatgccatattgaaactaattttaagcaaagccattatgccattcacttccacttcaagtacatgtatcgcagattatacactaatatcttatgagtcccacttccacttctggtttgcataaatgaacccatattcacaaactacccaaaagtaaagttggaataccttcgcctgaataccaatgtttctacttttcagcaatttggctactgaaacagaaacaaattatcaacaattccttctcagatatagttgtaaagatatttatgcatcatggttcaattgcaccttatgagtattgacatgaaaatggataagaaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaaccagttgtcctggtaaaaagcaaaattaagacgccacaacatctagtcatatgtagataaatatatcattttagccaactaaaggtttggataaaatatcaagcttagcctacttaatcatggaagaagatttcagattcaggaaacagtgtttcttttacagtgagcaattgtgaatttagagagaacatgtaagcagagtctacttgccaagagcacctatcttatcataacagaagcgattatttcagaacatacaaccgtttacacgctagaacacctatcttatcatagtagaaatgttttgtgggcaaacagttctgttcttcagaataatgggatattgtgttgaatttcccttgaaacagttttgatgtgtgaaacagcagtacgctggaacactgagagcctaatgcggtactacttgcattcagacaagcagccctgcaacaagaatcttgtgtagcatgtagtaagaaagcacccttaaaccaatgcagcttgcagcgttaacctaataaagttgtgcaaatgaatgtcaaactaaaagattacaaagatagagaagcccttatataggcacaccgcacacatctacacttgaaatatattctgtaattaaatctaaattgatacgaaagacagagttgctcttgctaaaagattacatttcattaaccttaatgtcttgtttaaatctggtgatgcagatttatagtgttcacatgaactgtacaataaagcttataaactcaattagatgaatatcaaaaggaaacaaattatatgtacaaggaaatgtggataaagagattaggtaacctgccgcatcagctatccctggacatgacgcccatcgagcaggggaaactggcttgcacatcccagacatggccgagcgccgtgagcccgtgacagcgtcgtcgtcaacatccaagcgtcacagatctagaaaacagtgaagtcgttggggaaagaggcagcggtggggaaaggggggcgtgctacgcagctccgcataggttgtcccggtggtcatcagcagaggggtgcatcagtgcatcacgtacttcgcgg

SEQ ID NO: 102564 - DNA, 1533 bp, Oryza sativa
  unsure (1)..(1533): unsure at all n locations
actcgggacggacgggacggcgggattcccgncgccggcggcgctagggcacgggcgagccggcgggagtggcggaaggtaggggatgacgggtgggccccacccgtcagcgagggtggcgggcgggcccgcccgtcagcggcgcgcgcgcggggagaggccggatgggccgcggggaagaggagagagagggaaagggatgggccgagccggcccaagagggagagggggagggaaagggaactttttagggtttttctttttataaaatcattttaactttgtttatttcttaataattattatttgtgctctgaaaattccactaaaatttgagggctcctttttgaccaaggagaatttaacaaaaattctccgggccatatttgaatttttcttgtacgtattttaatgtttgccaatttcttttcgaattttaattaattctattatttcttttagaaaatgatttttatttcgggatgaatttatcaggacgtgacaaatccaccccccttacaagaatctcgtccccgagattcgaggaggctagcaagaagataggttgggcggtcttcttttatgatctgacttcttccgttgcatcttcttgaacgtacttgcccagcaaaacttccccactctgaactgcttggcttgatctcctgttgcagatggaatcttcttttcacctgacttgaaccagggtgcaccttttagctgacgcagactaggttgtggtagtttaatgatgcttccgttccagaacttctcacgattcatatcttcggcgtcaacctcacacaagttatcaacttcatgtcatgtgtcgtaacctgcttgtcattactaggataccatgcttgtcatcatgagaataccatgcttggcgtttccttccagcttaccaccatatgctttagactatgatatcccgcttactaaggataccatgattgacaacttgccattaactgtctcatattagctttcctggtctccggtgctaggtacttctgctattcgatgcaagggtcaaccactctaactataagttatgcttcccaagagaaccaatttatcccacttgacatgctttgacgtcttcccgaatgactttgctgctggacttgttattgtctgatcgtgatcctgccagatctgaagcttcgttgttagatgtgattttgatctgacctctatagattatcttcaaacatatcacttgttccataactgggaatggctctcacgaacaagcagctcggattcactttctttacatttagtttacttcccactattctctttatgttgttatcatttagccttcaaagtattcctttacacattcaaccctgatgtgttcttttcagatttctcttatcaatcacctttcgacctacttctttgcccggtaataaacacctttgctggtatcttctatcaatcaccttttgaactttgtcaaccaagtactcttcactccgagagttgtggatgcttctggtgacaatgtggtacttgagcctg

SEQ ID NO: 102565 - DNA, 766 bp, Oryza sativa
atatatgtaagtgcaagagatgagctaaagcaagcaggcagattggcggtggtattacagtagcaaacatatatttactctggtgaaatgagaagtttggggtactggtgtgttctacacccatccccattccataggatcttctgtggctgcatacatgtatatgtatatgttcctgtcgtatgtaatattctccttttttttcaaaagaaaaatggcattcttcgaacatgtgcagatgtgggtcaattgatttcatgaggtcatgtaaactacttttggatcacatagtttatttatttaccatcctttgcaatatttgggcactacactagtacccttaaaataatacttcaatttttactctttcgaagcaaactagcaaggaaaaagggcaattacagtttacttgattgaatcagttcaactgggttttctggaaaagaatggctaaggtaagcttgagataggcacagaaaaatctttgtatagatataaatctgatggaatatggtgtagccttgtggtattaatcatcctgatttttagtaaacactaggtgactaaaaatgcacataccctttcaagcttacctctaagttccgaacaacaggtatgagtggaaagtggaatatcaaaggcacggctaagtgttattcataaggcgaaaacatcattgcaatgactatcaagcttaagttgaatcacaggtgatgttgccagtcctatagttgcatcaagcacccatacatatgtgaaacagcga

SEQ ID NO: 102566 - DNA, 3044 bp, Oryza sativa
attccataaccctggactaattcgcgagacaaatttattgagcctaattaatcaatgattagcctatgtgatgctacaataaatatgtgctaattatggattaattaggtttaaaaaatttgtcttgcggattagctcttatttatgcaattagttttattattagtatacgtttaatacttctaattagtgtcaaacatccaatgtgacagtgactaaaatttagtctctgaatccaaacaccaccttagtgctgaagcacccaatatcaacaacagtgacatgacaccacggtgcctaacctgatcgcgccagtgacgggcgctaaggttggagacttagctacgcgccaatggctcgtgaaacacaactcctatgttgggtggcaccgaggtgcccaacctcaacaccattatgcttgcgcctaggttgtcaacctcaacgccaaccatttttacattgaggttctagatctagcttggttccagaaagctctccacttaagtatccgagcacataccgtaaacaacaaataccctctccacatctcacaagtcacaaacatcaacaaatgctaaaatataagccatctcatcataaacgtatcaaacacaatctcaagtcaaatgcgatgaaccttataccaactcaatccctatgaaatcagggttttagaaggagtttgcgttgtaaatcgatcttcaactcaatcctcgcgaaggtgtatggcgctgaggtcctatcacgacggcgagtcgggtgtcacatgggctaggggtcacgactaaccttttttgtgctgatccatacgaccttggtaccgaggtggttgatgtaaggaaaattttttaagtggtctaattttgaaacaagttttttaaaaggaccagtttatcaaaatttcggtggtttgtcctggagcgctcacacgcagagggggaggatgagagatgcgtgtgtccggtgggcgcggccgatgcgggcgtgtcaggtcaggtgggcccgatgggaagcgacacgctcgaagcggtgtttcttccgttggtgtgcaagcgcgtctcatcagacacgcacgcagagcgcgcgtgggttgggggaccggggttaccggtgtggtaaccttaccaaccacgctgccaccgtacgtacggactactacgcaggcaatgcatgcaaggtgtacttgatcaccaatcagaaattcgatcagatattcccaggttaaccccacacctacccacctacccacctacccctaccacacatcagtgatcagtcaagaaaaaacactccagtacagtgcatggttaaccatttaacccaacccgggtttggtttggccacacagccgcgcgcgaaagagctagagatacgattagaaaagaaaaaagaagtagtagtagaagaagaaaaacaaaaaggaaaaaagcgatgtatgcagcgttgtttaggttgctctaccttttgctttttacttttgggggcgctgatcgcgatggagatgcagtgcatgcatgaccggccgcttggacgcatttgcatgtatgcaacgcagtatcgtacgtctcgatcgctagagctaaagctgcctttaattaatttcgccggaattaatggcagctgcaacggccggtctgtcatatgcgatctgtgcagagagaccaagagctagcgatccaaacttcgaacgcatgcaacgtctagttagcacgcccatacatgcatgagttcgctatggtttctcaattttagttagtaactaattactcccagtaatctctactagatggctagcgagaaagatgtaataacgtgtgcatgcatgcggtgcatgtgtggagggttaattaattaattggccggtgccggtgatgaactgatgatgagaccgatattctttaattagtttgataagtacacatgaacataatgtgtgtgtgtgtatccatgcatgcatgcatggccgatcgcttttatgttactacaatattgtacacttgtacaaggcatatattaaggcgcgtgtcaaagaaattttcatcgttcccctcccctagtagtagtagtagaagaagaataagatattttcatcgtatgtgacacgtacggtacgtgcagctgtgcatatgctgccatgcatacatgggttcatgtagaagagactacacctagcaattaatcgtgccagaccgtatctttattctttccgattcatcttggaatggagtgccttcgtcgtttcagccagtttaaatttttgcccacactgctccacacactttgtcctgcccctgcctaaaggatgcattggcatatatcagtatatatatcacacaaaagaaaatgccaattatcaaacatatattgcgagatctattagataatatccgtggatagataattagcagcagctagctagccagctttgtggttagtacacatataatttgtttgacagaacaaaactaagtaattaattttgataaattaaatatggtaaccactgtacgtcttctgtattttattagtcaattatatgaatttacactgtgatattttatttttacagtgacaaattgtatatggggtgctgtttttataacagatggggcccatgacatgagaaagatgctagtacgttttttatgctttaggtaacatgctttaaataacagctagtgtttgattcaggggttgaaaaaacaattaatcgaaaaccactcgattaatcggccagattaactacccctattaaacttaattaatcgcatgatccatttcaaaacctggtaacaagttttgaacaccttaatcatcattcataatcatcactcttccctacataaaaagaatacagtcaccgcgagtggtaagattacctcggtccccatctgcccctctcgatcacctgtctagggtttctagaatctagttaacctcaagaaaagcaagcactacgactcccccttcctttcttccagcctcgcctcgcgctcacctcatcacctctgggttttttcttccttggcctgggctgcaggaat

SEQ ID NO: 102567 - DNA, 1083 bp, Oryza sativa
ttgcatcgcttgttcctacttcttcgtgtgtgtgtttttttgttcatctttttttgactcgttcattgtttctggagattaccgctttgggtaaactgaagccttaaatgggagtgagcatctttagtagtacagtatactagtattgctgtttgttcgagcttttattttcctggttgacttgtttattgactactagtattggatagctagctatcctttttctgcaggcaacttttagattgattcttgcttgtttatagaagtggggcagcgggtagcccacctctgttttttttttgtttgtgtgtgaggctagattgccgtcttttattagaggcctaatggcccgaatcgatgtgttctaatgttttggcaaaatttacgaatttttttcgtttctcgggagaagtcgtactcacagcaacaaatttgttgcaaaatattactggtatagtcgataagacttgtgactatatggcttgatcaaggtattttggtccgttacgtacgtcgtttagtttcttcgggatgtttcttttttttttaaagaaaaaaaccttccatcgtgtttcgtttgctgtgcttcttttaagcttgttttatctgcatttagcctggccaactcgatctccatggtgtctgttaatttagacgaattggataaactgcttgcttgccgtacaatcttgatttggagatcttcctggccaacataattgactttgtttttaaataatggtggttttaaatttgtttaaagtttgatcttcaaccagaaaataacggtttaaataaatttatttttgtacttgtttaatacgggctctctgtttctgggctttaaagatgatgggtactgatttctgagctgtataggtagcctagcggccttttaatcttcattttttttttcctatttgaccgcagttcttatcggctttgacgggccttccatcatcgtctgctctcctcaatcctcccccactccttgggtaaatcgttagcctagccgccacccgtactgagcgctccgccatggcgctcgtctgaacttcccctttagcgcccgccatggcctgc

SEQ ID NO: 102568 - DNA, 1333 bp, Oryza sativa
aggaggaggagggggagtaaagtaatggtgcggaggagaggagtggagaggaggtggcgcgccatttccggaggcgagaccgcgagaggggaggggaggggagggggaaggagatgacgaacgaagatcacgagggaaggagggagggaggagtggcaccacgcacgtctgaagcctccaaacataaccgttgcttttttttgtttttagcatttgctattagatccttaaaaatatataaagtttttttagcatttgcttttagacccttgaaaaaatactccctccgtttcacaatgtaagtcattctagtatttctcacattcatattgatgacttttcccatattcatattgatgtcatcaatataaatgtgaaaaatgttaaaatgacttacattgttaaacagaggcagtatataaaagttttatttacaaattatttttcgtttgcaaatatacctaataaaccaaacgatggcccagtgagttaaaaccggtaaagaaatttccgtcgtccgtacagagaaaagaaaaatacgcgcgaataaaaaagtgcgtgcaaaaatagtttctgtccgattccaaaataaaaaaaaattccgagcgaaaaaagagtttccatcttcctacaaaaggaaaaaatagtgcgaaaaaaaagtttctatccgaaacacgcgcgaataaatacctaactaaaaaataaatatctatctctaaaaaaccttctgtcgtaaaaaaagaaaaaaaaaaccgactcccgtagagaaaaaaaagtccgactcctgaaaaagaggatttctcgtccgtaataaaaaaaaggaaaaaaaacgttcgactcaaaatatgtaaaaagaaaaggaggaaaaaacgtcccaaccaaacttaaagtcgccccttgttgtccgtatatatctctttaactctaatctaatctatcaatctaatctaactttttaaaaagagaagtttccatcatcagttaaaaaggaaaaaatacgcaagaaaaaaatagtttccaaaaaaatgcgcgggaaaaatacggtttccttcgtctgaaaagaacaaaaaaatgctattaaaaactatcagaaagaaatacaccatttctaaaaagaaggtttcaaaaaaccacacaagaaaaaaaacgtttataaaaaaaagccgctctgaaaaaactaatagatgaaacactgtttataaaaaaaacagataaaaaaacaaacggactcaacgcgcgaaaaaaaaccgttgtttcaaaataaggttcgagaaaaccgtctggcttaacgtgagaaaaaaaccatcatttccaaaaaaaaaaaaagttagag

SEQ ID NO: 102569 - DNA, 2011 bp, Oryza sativa
gggctccctacagtcctacaccatcctccctctacgccacgtgatcccctgcctgtcagggcgtgggcccaacggcatcttagttactttactcaatttttgataaaaaggagaaaatggtagtactggatatttgcctattcaatttttgttcttcgtactttcatatctcaagattatcgtcttgtgataataatgtttagttgaaaaactttttccaaaaaacatcacatcgaatctttggatacatacatagaatattaaatataaataaatttagaaaatagttacacagttaggggagaaatcgcgagacaaatcttttgagtctaattaatccatgattagctataagtgctacaataacccacatgtgctaataatggataattaggctcaaaagattcgtctcgcggtttccatgcgagttacttcctccgtttcacaatataagtcattctagcatttcccacattcatatggatgttaatgaatctagataaatatatatgtctagattcattaacatcaacatgaatgtgggaaatattcattaacatccatatgaatgtgggaaatgctagaatgacttacatcgtgaaacggagagagtgtgaaattagtttttttattcgtgtccgaaaaccccttccaacatccggtcaaacgtccgatgtgatatacaaaacttttcttttcatgaactaaacaggcccaatatttcacacaaacattgtaaaattttttgcacgaagaaacttaagtagttttatagaatttaaattttcgaagggcataacattggtattgagtaactctcgacaagacttaatagtctttttttaaaaaaaaaaatcatgcaactatattacccggctttgaaacaaagcctagacaacatacaacatacagagttcacagtgtcttaacaaaaagaaagcagaaaacagagcaaataagagagccgctgggaacaaccagccatccatgacagagctcagaacagcacaaaagaactaaatacccctttttttctactaaaccccactattttgagaattaaaagcaagacgagaactactcatctaaaccacaaactatcctaaggcagcgttcgtttggaggacattgagggagaaagcacctcgttttccgcacgcacgcttcccaaactactaaacgctgtattttttgtaaaaattttatataggaaagttgctttaaaaaatcatattaatccatttttaaaatttaaaataattaatactcaattaatcctgagctaatggctcacctcgttttgcgtatcttctcaatctcctcaatctccttcttctcaaacacaccctaagtcaacaggcagattaattactagtcattattatcaccttgattactactttggacttcaactcatggatatacttcatgtaataagacatatataaccttgctagtattcaaaatgcacaacaattttatgatacactatataagagtttttctttcaattagtactgttcacaacagcaccagacaaaacttctctctgaattgctccaaacttctcgatgaaaaggaattactcgaaacttctatcagaattactactatcagtgtgcatctagctacaactgtctatctagtaaacactaatatggtgaaacaaagaagaagagggagatagggattgcgatttgtgagaggaagatgaagataagaagcaaaatagaaaggtgcaaagttaaaagatgctcaagtattgaggtgttcacggtaacagactctagcattgagagggcataggcgaggggcgcgaggagcgacacgcggagggcaggaacgccgagagcgaggtgagcgacgccaagatagagggccactggcagcggagggtcaagggaggcaggatgttgccgcggcgggcagtagcacaggcggaggcactccactaccataccatgacgcgcctagttcttctctcggacgacgcattcgtcaaacaactgca

SEQ ID NO: 102570 - DNA, 2725 bp, Oryza sativa
  unsure (1)..(2725): unsure at all n locations
attcctgcagccctaccgttacttgatagaatatctgctaagtaatagtaattgctccatcaacttagacttatttagtaaaaataatacaaccgtcacatttgttacgcctttatgtggaacacacaaggtgcaacttattcatcacgatcaattattcaccacatttatgactagagatagataacatcatcgttgaaaagattaattcgaccagatatgtaaaaatcgaagctgatcaatgcaatagtggtgatctcatcgtaatcaccaactccgtatgttgttcctcatcatcatggaggcctcttcctcctcttggcgcctcggctgctactttgacaaccactgctgacgcttgacatgacgaggcgtttttgtcgccctaggcgccttgcttgtgcgtttgttatacgcctcggtgtgtggcaagaaaaacccggtgccaccggcatcgcgctgctttgtgggaggaggtggcaaggctggggcactggtggctaccagcagcagtggcgtcctcatctccggagcaagccttggcggtgcaataggcacccgatctagcatcatgccaccgttgctcatgaacggcctcacccccattgatggtggggcatggtagcattggtatttgttgtccaccatagctggtagaggaccaacagtagcatggtgttgtgtcgtcgttctttgcacagcgctgccaaagaggacatcggcaagacaagcggcgaggtcctcgacaatggcgcggcgaccctcacaagggtcgatgacggctccaatgtccctgaggatctccgatggcaaccactggtggacgtcgtcatcctcctcactcgcgccgtagaagctatcagccatttctggtatataggttgagcacttgagcatgagcaagaagagagatttgaggtgtggagatggagaggtaagggtatgtttatatagataggtgaggaacaataactatagagggcaggatattagtaggcatgtttctttcctcaatcttataaaatgaacatgtttttcaattactgattttttcccttcttaattgtgggtgtttcttctcttcatttactttatgccttctatgtatttttggcgatgataatgtgcttcatatgtttcattcaaaagtatacatggattatctagagagtagtgaaaggcgctaatgcgctatacttagatattgatgcatgtaatataannccactttattaaattttcaattatttgcagtacgataaagagaaacatgtgggcagtgtgctctctgcctctgttgtgtcaaaatgaattctcctaactatatattgaattcccttcgaaagagaattaagcaatggataacgacatatcacatgcaaattgttgtacttgctggtgaaataatgcatcagcacataaagacaactgcacattttcgttcacaagaaaataatctatacatttccattagtaaatacaattgcacaaaaaaaacatatgtgcacatttcattcacataaaaatgttctgcacattttccattcacacaaatctatacaaaaactgaaatacatatttacacatttcggcacatttcactgaatcatttttacattgctcatatgtgcacaagctttgcatgtaacacatttctagacaaaaaaatgtaacacattttctgatatgggcggtcaaagcaactgctactttggatttctagatcaagctagcactttgatggctggcttttcataggaaagagggaggaggggatgcgggcggaggcgggtagggttttgggctagtgggtgccattttgtgaaaaaacccctcagcttccatattttagagtccaggcctacttcgcggttttcctcccctttgcatggaatatccggatttccgaagggcctaaacgtaaaaagccagctcaaagggacggttggtgagggacgccggacgaattacgaacaaaacggagggtcttttcacaaaatttccaccctgtgggtactgcagcgatggtagcaaaatctgacgtggcacaccccatcgcgtgcccaggctgcgaccctttattttctccgatatgctactcatgtgactcataggttcaattctaattcatgtttacacatcttcactaaacatatagctctaatattgtgtgacaggctggcagcaaacatggtttgaacagaaaatgtttttgaatggagataaattcagcgaaatgcaactttataagagatcaagaggctggtaggcaatatgttcccaagggtacaagttcaaatcctcttatgagttatgacttatgaggggctggtgggcacctagatgatggtagcagaatcatgtgacccaaatgtccaaagtgcctcgagggtggaactagcagagttccactaagtaaaaccgacatacttgttatgaaacctattttattctggacgaatcaagatatgagtggaaagcttattacagaagaaagcttataccagaagatatcttatcacggaaggaagcttgcggcgtaaacaagcttgtaggagaagcaagcttgccgcaaaagccagcttgtgggagaagcaagcttacggtgtaagccaactcacagtggaagccggaagccagcttgtgggatacgcaagcttacagtgtaagccaacttacaacttacagtggaagccatcaacctcctctgcctataaataggatc

SEQ ID NO: 102571 - DNA, 558 bp, Oryza sativa
aaatgaatggaaattccaagccttaattaatgaatagtattgaagacgtgtatgcatgtactcctctgtcccataaaaaaactaatcctaccatggtccaggttcatagccaggattggcttttttttaaaggacagattagtacaaaatattcatggtcaatagaatttatactgcagtgtatggagtcatacaaccacaactaacgacttcatcacagcactttccaactttcaaaaattacagagcaggaattttacatgaataaatttgattattatgaaattctgggaagaaatcctccgtttgaaaggaaatattcatatcttttccaattcacgtagggatgaaacgatatctatactattttaaatattagcagtggtgccaccaccatctcatatcactgacgtttgttcctcccaacttctgagaaattttgtgccccctaattcaaatgcttcatattctcagagtatagccaactactaactccaaatcatctatagtcaatttaataaccaattcatacgatagttacatataaatatatactac

SEQ ID NO: 102572 - DNA, 604 bp, Oryza sativa
tacattagtacatgtaaatgttcagctgtcagaagttagagatgtacggggctaggaaggagtagttgttttgataatcacattttggattcatttcaacaagacaagcatgcatgggtcccttaatatttgccggtccttattatcattgacctaccaactatgcatgcatggaccaaagagtgtcatcttgtagctagcagtcgttcgtgacgtttagtcagcaacctaatgaattggaacaaagacgtttcggcgtgcatttttggtgatttcttaactagttaaatgatggaggatacatcaatatatatatatatatatatatgcaatatttcaaggttaaggatttgataagtactgttatattggggtaatggcatgtatatgtagggggcatgtagtaaccaccctaacgtacacgtactctagttgtattacaggtttgcatcttttgcaatttttcttgccaaaccaccttaaccacctgcaaactgacacaatttatgtaaaaacctatccagatactgcatatatagagccaagtcatgcatgcatgacagtcatatactgctatatttgagattgctgtacgaatgcagca

SEQ ID NO: 102573 - DNA, 1684 bp, Oryza sativa
gcacctcagaccagtccagacctgatctactagccaacaagctagctatcgcaatgatagctaatggcacaccagcacatttcttcaaaatcttgtcacatgcctcagttgatgaactgtcaagagatttgccttcactaccagttcttgtatacaataattctttagagttatcatgagaaagtggtttcatattgtacacatcgctgataattgttgcacctcagatttacgagtagttacaagtattttacttccgtaatcattatcttgtaaaccactttcgagtatttgccatgatggcttatcccatatgtcatctataacgataaaaaacctagaatagtagaagaactgtataagcaccccaatcactgaaaattacgagtcatcaataagatgtggttttctttttatatgtgaaggagcaataatttttagtgccgaagaaaatctagataagagagataaacatgcattaaaagtgagatattgcaattaattattcattagcctatgcattggcatgtgcttttggataatgtgtgggcacgacggtcttgtagctaggaaccagtggtgcactagaatagtgacagggataacgctgacaagtgggtagtgtgctcctccgtcatgagttcaaatgtgacatgctcatgtgacggcggtggccaacacatcttttggcgttttctggaattttccgaaaatggtttttggaatttccaaaatgataaattttgtgaaaaagctctctggtgatttcaaattttttcgaaatattttcagaatttccgaaatgttatttttccttttttttttgctaagtttgtgctgtaatttatactttttggaatttccgaaagtattgtagcaacttccgaaaataattccgaaatttttttggaaattcggaaaatggttgctcaaatgaaagtattgtatcaacttccgaaaataattccgaaatttttttggaaattcggaaaatggttgctcaaatgaaattgctttcttgtgtttttcagacttgtccgaaaatggttttcaaaatttttcaaaaaattgaatcttgatttgcctccaacgatcagatttgaggttgtggttataaataaccccctccaccccaagtcaagattgctcgctccattgctttcttgtgccccttgcttgtgttgatttgagattcactttgagccttgccctctcacttcttactttccactagggatggcagtcgggcacgacgggcacgggtagtgactacccatcccgtgtccgcgaggtaattcatgtccgcgggcatgcccgttactacatgatgggcaaggagcacttccaatgcccgtcccccgtaggcgccatgtgcccgcaggcatgcccgtttacccgtcacatctgggaaccagaggtgggaggcgcgtctggaggaagcggcggcgaccggaggtgggaggcgcgactggaggaaggtgtggcgggctggcggccgatggctggaggacatcgacgactggttggagaggagctcggcgcagacggggtagaaggcgacggcggtcgcagcttccttggttgccccccctcccccgtggccgctatgaaagtcgtcggctggagggtggggccgccagcgactagcggaggtgggaggtggtggcgaattgcgcgcccctct

SEQ ID NO: 102574 - DNA, 594 bp, Oryza sativa
agaggagggagtggaggggagttgggctggggagagagaaggaaggaggcccaaaatgaacagtgaactttcacctttttccagagatttgtagagttgaattttgaagatatttttggagggatttgaatttgaattttgacctagggtttcatggaatttgaaatgaattctaggagaggatttgagatctctattggcacaaaaacaaataagaaccaaattaactccaatttttaaatgacaaacttttaaataaatccaaacaaaattaagtgtgctacaaactccgttaccaaatatcgtgtctcggtgtcgacatcatgtttggatctcctatggcgtttcttccccgtttacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggattggtactcccggtttggaaaccgggactaaaggggggttacgaaccgggactacaaagggtttctccaccagtgtaaacggggaag

SEQ ID NO: 102575 - DNA, 707 bp, Oryza sativa
cgaccacgccaccttccgggatgctagctcggaggatgacgctaccatcgtgcacctggcgcgcatggtggaggcgtacgacgcggctcgtatcgacttccatcagatggtgcgccgcgggatggtcgagaacaacttgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggagtggacttgcttcgtcgagacccctcgtaccgagcccgcgcccgtggttcctcaggagggggaagcctccggcgttggtagcacggaggatgcgctgttgctcaccttccgtcctggcccgtcgcagcggtagacgaccagttagtaggcttgcacgtgtgttctttctcgtttgtcttcttgttggagtcgtgtggggcatggttatgccggtgtgtggtataactgtgtcagagcctgtctttattttatttgcttaagcaacttgaacttgaactttaatgaacccatttaatagcagtaataaattcaagaattatagtagtcgtgggtggttagttttaattgtcagcttctctcttgatgaactgctgtac

SEQ ID NO: 102576 - DNA, 662 bp, Oryza sativa
gcttgttgagtatgtcatatgctcattcttgccataatccatccacctcagttgaagataaaggatcgccgaaggagaagacctttggcttataccccagttgagctcgcctgtgggagtggagcccggagcttcctagattttatttttccgctgagtttccttcttggtgaggactaagtgccctcttaagtaagtatttatccgtttagttattatgatggatttgtatattaaattgtcagtttgtgtacctcggctgattccctggacgaggattttatgcccaaatcagttcggaaattattagtgaatttccgggcgtgacaagttggtatcagagccctctcactgtaggataagcccaatggtccaaccttaaggactaattttccgaaaacataatttgtgaaagtttctcttttcttccttatctacaattcttcgcacatcgttttgtccttctctcctcttttccctctttcacactgagtagttgttaaacttgatggagaaactccaaggcgtccatgttgtccacttctgccagtaaagtggatccaggaagaacccaagtgcccacatatcacgatagagtgaacttggatcctactttacaacctatgcccgccaagtgtctttgaagaatacttagtacgata

SEQ ID NO: 102577 - DNA, 541 bp, Oryza sativa
caaaatttattcacacatggttaggcttgggggaaattatgaggggatctctcagtactctgtatgcttcacaaattttgaaagtctagaaaatctcatatgacatcagtataatcaaatttgacccaagcagcacgatactcccttggcctcccaatataatagattaaaacataaaaaaattgtcctaaaatataagggtatcgtaagtacaatttgtcacatcaatcacctcccattcaaattacttcccatcctaccaccaacgaccctcccactccctacatacccttatttaataagggggcatatagccttttaccttcatccttaatttcttcaaaacaaccaaggatatcttatatttgcggacggagggagtattatataaaaattaaccaaatatgtgctaaactattattccctgttttgattctataggcaggcacatactttaagatttaaactttgtgatttttgaccaagaactagtccaatgatttatagtgatataaaattgatattgttggattcctatttt

SEQ ID NO: 102578 - DNA, 814 bp, Oryza sativa
tattgtttctatcaaatattgcatttattttcgaatgtcattgggtggatttaacctattgtttgttatagcccttttgttcttgattactttattccttgataccttgggttattataacttgactagttgagctttatttattggttcaactagatattagatataattgcttagccctgcttagaaacattagctcactattgggataacttatgattcactattatttcatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagctagcatgggcaacggctttatcttttgtatagcatggttcattgcggggcactagactgagaagtggcggagataagcccacgggggtcgctggggagtccatgccttgtttataagggggtgattatgatccaggaaggtgcgctgcagtggattgtgttgtatgaggtgtattgtcataactcctttccgaggtaccgtggtggtattgaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtataactcctttgtactcccttgcatttattctacacttgtgggtgtgtct

SEQ ID NO: 102579 - DNA, 2948 bp, Oryza sativa
tgtttcactcacaccatataagcatagtggcacgtggattgattttaccgccttggttttgtttttttttccatttgatctcatcatgaatcttggtcaatggttgcggcatggttgtttcttgattcttaaacctctcttgtttcactcacaccatataagcatagtggcacgtggattgattttaccgccttggttttgtttttttttttccattttgagatgttctcttgacccaccagtctagcaatgactcattttcatcgtgtgataggtttatttcgttgcagtttagcctactcaaaactctcacccagatttggcgcaccaaggtgcaatttgtgaacagatgttgcgcgcgttgacaaaaatagttatttgactcatttctcttttctttaacccaattggtctttaggtctactccctcctttccattttaagtgcagccatgatttttcgtacacaactttaactgtacgttttatttttttaaaaaaaatgaaaaaattaaaaacatatgtcacttataaagtactattcatgttttatcatctcataataataaaaatactagttataaaaaaattcaattaagatggacttgggtgcagaaacttatgcttgcacttaaaaataggacagagggagtacttgttaaaaatatcaactagtttcagaatttcagtagttactggaaaaaaaatttagtagcatatttctaaatctacaaaatttacttttgatagacatatttcattccaaccacctatcctcttaggctgtgttcggaactctttgttcccaactgccccttttcgttttccgcgcgcacgcttttcaaactgctaaatggtacgtttttttaaaaaagtttcaatacgaaagttacttaaaaaatcatattgatccacttttttttaaaaaagcaaaaacctaattaatcataagctaatggatcactctgtttttcatgcacacaacttgggttgggaacacaggattccaaacgcagtcttaatgactttctcggatttaatacgtgactcttcattcttccacataagattagctatatgggcatcgagaaatgtaaatattaataaatcgcttgtttacgaggaatagctctttaagtagcatgtttaaatagatgataggtaaaattatttatccttggtcattgtgggaagatgaaatatgaatatcaaaactagatggagggagtagtattaaattgcaatacaaatttgtagaaattgagtggcaatatttatagggcctgtttagttccaaaaacatcacatcgaatctttggatacatatatggagcattttttttgcagggatacatatatggagcattaaatatagataaaaaaaactaatttgcacagtttgtatgtaaatcgtgagacataatgacgaattaattaagctcaaacgattcgtctcgcggtttctaggcgagttatgaaattaggtaatgatggattaattaggtgaaagttccagacaagttatgaaattagttaacgatagattaattaggctcaaactttcgcttcgcggtttataggcgagttatggaattaggtaatgatggaattaggtgaaagttctatgcgagttatgaaattaggtaatgacagattaattaggctcaaactttcgctttgcggtttataggcgagttatgaaattaggtaatgacggattaattaggtgaaagtgttcgatgatattttgtacaccttttttttattttataagaattggggtgcgttaaaatattaattccgggaaatacagtacaatagtaaaattagtgattaattatcactaatgatataatctggcgtacattctcatgagaatgttatatgacatgtgcagtgctgcccaattaatatacgggcgcgtatatactcatgtgtgtgtatatatatatataatgatgtattttagccaggatagaatatataaatatatgcatggaatagatggttgaataaatggcagcacagctataaacgatatcactgacgaaaagaagaaacgacggtggattgattttggaaatatgccactgtagcattgtcattagaggatgttgatcatgatgatttgccggcagttgattgcatggaaaccaaatacatgtttgcatggaaacgtaggaaattaaaaagcaagatagctatctggatgaattttccttgccataagcatcacgtacgcgtatacgaatacaaagaaacaatcgatccatatcacaccggattggaaaggagtcgccgtcgcagtatactcagaaggaaaatatattgagcaggatggctactaatcggtaatcacagcatatggaaagagataaaatcatacagaatcaatcaattggctggccatatcgatcgacccatgcacgtactggctgggaccgccttccttcactataaaaggccatgccattttacacaacgaacacacacagaaacggaggaacacacagacagaacacacacacgaaagttacagagagagagagagacacgcaccattttggccggagaatctcggcgtccggcgggaacacgtgcgctcggcggccggtgacgttggccgcagtgcctcggcgtccggcgaggaggcgcgcggaggaggagacgatcgccggagcatgtactcagccattgccatgggtatagcttattagctttcttttgtctttttcctgctttttctgttcagatcgtcatgcatgcacaacacggcgacgaggcgagtttctggtgctgcccggcatgctggagatagcgtcctctccgcctgtcggaggcactgccggccggagatcgcgtcgctccctctcatcacacacgtcggtcgccggtgacacatctacctgttgccgcgacgtccttgcctcgccggccacaacctctatc

SEQ ID NO: 102580 - DNA, 1235 bp, Oryza sativa
taaacggcagggcgggcagagtcgacatcaagacaacatcaccaacaccggcgtgcggaccgatgaggccgtgaatcgctgccggcgcccacttacacacatctacaccaccatcaccatcatgcatgggagaacgtgaagcgaagacagacgacgacgaccagcatagcttaatcggaggtatctcacgggtttaacccgcgagagtaattaaccgggtgtcttccgagaccctggaaaccaggagatcacaattgccaagtcagatccaccttgcttatggaccgtggagcgtttttgaccaaggattttgtataataaaatacatttttccttcgtccactttatttttttgtgtatttagtacactggcacgcccgcatatttttatttttacttccctgggtggaggaaaattttttttctctccaaacagaaagtttcaggcgagttatgaaattaggtaatgacggattaattagtctcaaactttcgcttcgcggtttataggtgagttatgatattagttttttcattcatgtacattgttggagaaacatgcgttgctgagaatcgaacccctttacctcacaatatttagcacctagagttctccaccaagctatcttgtctttgtgtgcaatggtagcttgtagattatgaatatttatacattgaacagagatcagcgccaaatgctttggcgctgacctcggatgacgtgtaaaatccgtggcacctcggatggtatctcattgccaatgatagtggcaccgagatgttatatctcagcgccaatctctatggcgctgagaaaacggcctatttggagattggcactgagaaaacggtctattttttaaatagttttggtacagttcaatctcaaaataagttttttaaaagagtcaaattgtcaaaattacggcaaaaactccttccggtatccggtcaaacgtccgatacgacaccaaaaatttttacttgaccaactaaacaggcccatactagaagacatatttggttgctttggccttgtttagtttataccaaacttctcccaaactcccaactttctatcacatcacatctaaactttcctactcacataaactcctaacttttctttcaaactaccaacttttcttaaactttttcccaatttcagaaactaaaacacaatctttgactggttgatatactacgcgtgggtgcgcgcatcatgaactactgta

SEQ ID NO: 102581 - DNA, 1674 bp, Oryza sativa
atagaaccataaccctctttatcaaccgcttcaatacccaatttctagcatattcacatcccacctggacttcatcatatgttcaaggtctttgttagtttccatcttccatccaccaccagtgcattatccaagccccacactgcaatttgttggctcacccccaaattatcttgcttgccatatcatcacgcaaattggcaagagaatagcccttgcatctatcaacccacaaatcaaacctttgttctgccatttctagcatctcatactctaggtctgctacgtacttagcgcccttaacaacaattctaaacgcattgccaggatcaatcctgacataaccaaaacttacaacaattttggagtcaggacagatctaattccaataacaaacacaagtaacaaataaaagttcatcaagcgaaaagacaactcatcagagggggcaaacaatcggcttcatcaccgccacagccaccaccaagtgatggctggccggcgctagggtttcccgccagttgcagccattgggggcgacgggcgtgagtaggctagatcagaggaacaatcgggcgggaggggtggcggaggcggcacgagcaagcgggaggggcggcgatgctagcaggcaggagtggcagcgacacgtttttggcttcgaacaacaagaaggaatactctctctgtccctgaattttgcaacctacgaccgatgtatcccagttcagattcgtagtattaggatacatcccatctaattctaggttactatattttgaatggagggaatactacattgatccaggaacaaaaatatcatttcaaatccttcctgttgacatggctttctaatcagagataaactctgatgttttgggtaaaaaaaaggggaagagtggtatctagatagtgccaatccgtaagagtggcaaatagttaaaaaccccgatccaaatggatcaagatcctctgacttcagtgaacatgtgatacattgttgggactttagcatgtcaatcaactttatactgagatgagccagtcaaaccatacaaaggtggcgatcaaatgtattacacatttaggataagtactagtccaaatgtggtgaccagatgtgtttccaacttatactcatataagactttccaggataagtatagtcccaaactttcatcttaagtaatgatacatagaagaaaaaacaacttaatccattctcacagtttaagttagtttcatttaatcgctacatacgctacaacactgtagcgttcttgtctgccgttcgcttgcaaggtcagaggagccgatcctattcatttattttcagaatttgccatccaatacgcactgccttcacgatatgccatctaattcgcactactttcagaatatgccactggatgcgaattttctgcgccacttcgtccgacgtcagttctcgtcgtcgtccctctgtctgccgccgcccgcatccccttccatctgcccgtgctggtgccggtgccgctgcgttcccattcgtccaccgtcactgctgcgaccccgtccgtccaccggcaccccctccccttcccccgggtccgtttgctggtgttgtccccgtcccgccgtccatcctctggcattgcccgtgaccccgttgtcacgcccggaatttctaaccaa

SEQ ID NO: 102582 - DNA, 516 bp, Oryza sativa
tcagattttgacaaatgagtctattgtctgaaacaacctaaactcagattctcccttctgtttttcctttttgaaatcactctgtatttcattttcttggtatatgcttagaatcaaggtaagaatcctcaaatcgcaaaactatacccttttcctgaagattaacaaacaagcactcatgaagcaggactcaccaagctgaaaaaagtctgataattttattgaataaatagggccttgaattgctttgtacaaattgaataggatttacataagaattgctttatacaaattgaataagattacataaatatgcatactatgaataaatcggaataaaaagattacactgattgcaatgccgatttgctaatgcaatcatcagtcctaaacaagactaccaatcatcagttctaatttaaagacaagactgcagactaacagttctagtaagttacatgcagactgacaatctgaaaccaacactctacactgacagactaaccgaagagaggc

SEQ ID NO: 102583 - DNA, 673 bp, Oryza sativa
tacagtagttcatcactaattcaggactgggtaaattatgccatcctagttagcaaaatacccaagtgttacagcgagaccagaaattttggcctgtcatatcggatatatggacacacatttgaagtattaaacgtaattaataacaaaataaattaccgattccgttgaaattggcaaaacaaattaaaagcctcccatttccgttcgtaagcctcccaacttctttctttttggggggggggctccccggcttctttgcccaagggatgctgcccccgtttttttccttttttacgtgtgctcctcggggggtgcccctctaaccttgttttcaagcccaggaacacaagcgtcgttgtggaaaaaatagagaaaaaggcccttggaactgggtgatatggcaatggtacagggttttgggggctgttacatccaatcgaggctatacatatctgccaacttattacattcccgaggaccttagctaactcaaaaagaaataaaagccgaggttataatcttcttcgcttctaggacaagacaccccatcgctgcatattgtagattccctttcttcagggcttgaaccaccatcagtaaatcacacctagatggatattgccatacccccgagagatatcgcttatactgccttcaccgcggccaaaac

SEQ ID NO: 102584 - DNA, 1005 bp, Oryza sativa
taccctaggaaaacttctatgcagtgggaaattatatttttagtttatcagtcgttaggtggacagtggttaatgttctacgtgagcaactcttttactatgtgggatctatactattatccttagttcattttgtattctcaccgataaaatatgagtattcagttattcactgaaattctggaaatacctttaaaggtttcctcctgtgtttggaaaagaaagcagcagacgttcatgtcatcagtgttgaaaaaaatataaattatttaaaaatgattacattgcttgaagaagattaagggtaaggcctgttgtgtactgaaattacagacttaaagagtgaaatgcggctctgctgactgtatttgtttaatttacatggctgcagaatgtgctgtgagcactccaactgagctgtgaccatgtatctgaggcagctgtgattcaactttgctatattaatatgtatatagttatatagttttgtgtttggccaatgtgtcctatttcacttctggactggatgcgttctgcatcacccatgtatatatagtattgtttaggcccatattatctgtcagtgacacaaccaagaagtacgtatagaaactgactagtcaattgtccatgtcctgattttcagtcttagtttctacatacccaatgcaacacagaattagatgaactgtttgtactatgctactatagtactatgccatgcctattaaacaacgataatgtgattactgaaaaacgaatagtctatctaggatatgttactgcactatttattcgctccacatttatttcatgatttttacactagattcattttttttaacttagagagctttctttaagtgcatgacaaagcttgctttcagggtcctgtttctggttttcggggtatattgagaacattcatttcagcatttgtggcttcatatgagatctcttatcaggtaaattgtggttcttcatagtgtgcatttaaattgaatt

SEQ ID NO: 102585 - DNA, 528 bp, Oryza sativa
catatggtagaaaaggagtatcctttccagatatcagaattgattcgcttcttatcagccgtttgccatgggagttggcctgctcaatgtgtgtatgtattaattcattctgctcctctttcaccgtaatacatcgacctgtaatttcctagctctggtgttccattgctgatatggctttggctactctgccaggcttaaaagctctaatattttttgtgcccttttctttttcttctttttttgggagccctactgatgttcatgtttatagttaatctcaatagtgctaattggagtttgtttgtttttcttcttttgtcaatgtcacactctgatcgctgacaaacaagaaaagtagaaaactggatttctctagtggatttgcttttttgagaaaaaaaataccatcgtattatctcaaatttagtattatagtaaatgatcacctttcaatttcaatatattgttattttccaattccagtgttctgaattgtggatagtgctcctgttgcatgtatgcttt

SEQ ID NO: 102586 - DNA, 876 bp, Oryza sativa
acaaatgaaaatagttaaaaatgaacctattacaagacggagggagtaaatgtgtggtatagttgatttaatttcagctgcaatattgggtcaacaagtactcactaatgagtaacccgtgtccattccttatactcattggatcgtatagcatgcatatcgaccagcatgtaaataaagaacggataattggtgcactacagcatttgccaacggacaagccgcctaataagcaaaggctgcaagcgccctatcgatggtgcacatacacgtacgagcaaatgcacgccacgcacagcttaactttcctccttttcttttgcaccataggcgcctcctgcctctatctctaaaccagactgacatgactagctagcaagcacgcacgcacgccatatgatagagggtaatactaatcctttgcacgtttgtgtgcatgaggtactagtactgtaagaaaagaatgcgttacccaacccaccactgcaccagtattaaagtctactgagaggcagctgctagtttctgatgggagcgacactatactacacgtagagacaaggtgaataaaggatgatgcataatgacgaggatcaaaggcattcaaagattagattccttgtgattgtgcggacgatggttagggctcaaaaatggcccacaaaagagagcacctagcaaatgagcagatgagatagagggagggaatgaagcgaggagtactgaaacttcaatagttgagcacgtactcgagtggtatgaaagctcagcaccgcgtccactcctttaactgcaatactgtgtatacttctactttacttgctgcattatacggccgggtggtaataagagcacggccagaaaatctacacaact

SEQ ID NO: 102587 - DNA, 709 bp, Oryza sativa
catatatgatattatataagagaaaatataatgatgctagctgtgcaatctgcgcgggccaccatgctagttttacttgtttccgttaacatgttttcaaactactaaacgatatatttcgtatgaaacttatgtgtaaggtaactttcaaacatcagataaatctttcttaaaaatttaaaataattaaaactcaattaatcatgtgctaataacactctcgttttatatgtcgtgcttaatcttatctttagcggatgcaggctaacgggaccatatatagagacaccgacgtgcaatcccaaggcgcaacgggcacagattgtgactggatggatgacaattaagcgcaggaactgcctacaggaaccgtgcgcaaacatttggccatgagtaattttacggtttactattttttctgttataaatttaatagtaactcttagtatctacatactgtaatggtacctttaaaaaaccgtagaattgctctttggccattgcgcagccgtaaattcatttcatcagcgcggacttcaagaaataggccgtgtaccggccagactaattaatgctcagcgtgctgtggtgcagaggtccagagtttggtcttcggtgtgtgataaccgtcatgtaggcctcattttgatgggcctcaatttccaacccatctacgtgttcagactacagaggtagcaagcagcatacg

SEQ ID NO: 102588 - DNA, 706 bp, Oryza sativa
tcaaaagtgccacgactgatggctcccgtcacctcccataattttacagttcaattttccaagcataatgccgcattgagaattcaaatgctgaattgagacaacatccaagacactgtgagtcaaggataattcaaacatcaaacagatgacatattcggccaaactatggttcagtcaccactggagtgtccttgactcctgaacctcgtaactactaaggttcagctttgcacacatcacattgacatttcacaacagtataaaaagaaaaatacatcgaaacaacatagcaacaattgagtacttgtaaattgcatctcatttatcattattatcacaggaaagacacccagaattgtaactaagaaatacagctcgggcttttgcattatgtccttgattgtttttaacaaatgatatcaaggggcattatctcaaaaactttgaaaggtccaacagaaccacagttctaggaggggtaaaatcaggcaacacagaaaccaatttagttcactctacaaaatcaattgtctgatagcacgacatgagcaggtcttccagcatttatcaccttgggacagactgacccatctctatataaacacaaataaagcatacatcagaactttgaatatctcaattgcttcattataactttataagtgtggaagcatacagcattgatgtttatccctgacactac

SEQ ID NO: 102589 - DNA, 701 bp, Oryza sativa
ttcctcgcgcgctccgcgactaacgtttgcttcctctctagaaatcaaggggagggcaccgccaccggaagagggcaagaagaacggcgagaagatggcggccgccgccgcgatcccgatcccgatcccctgcgtcgcggagcccaccgcggcgtcccgcgtctcgccgggctcgtcccccgcccgctccgacgcctccgagggcgccgcgttctacgccgccgacaccgaggccgagccggaggcgtccgtcgggaggagcacgcagatgctgctcgcgatggccgccatgggcggccgcggggggccctacggccgccgcccggcgtcttcctacggcagctgcgccgcgtggagcgccgggtcgctcaccgaccaccgccccgcctcgccgtccccaatctgcagccccgtgagcagcaatggaggggagggctgccgcgacggtgatgacgcctcctcgttcgtcacgccacggctggttagtttccgtgttctttttccagggggaggcgcagtcctgaaggttcttgatttttttgctgcctttggtcttaatttcccattcttgcgtagcttgtaactattgaattgtggaaaacttcgccgacttcttgcgttagttctttggaggaaggtggtttcttggatgaggttgttcagtttcttgcatggtttacaggaacaaacgcctccagttt

SEQ ID NO: 102590 - DNA, 1092 bp, Oryza sativa
agggtgacaaataagtaagaggtagcgataggtgtgattttcaaaaatataaaactagaaacatggagataataaggttaggttgatcaaattcctaagataataatatagctatttaacttttttttaaaaaaataattttgtatggaagctagccgcgcaattgcgcggtcacccagctagttatattattaaaagaatagaaaaaggagctcccacgttcgctctcatggcctaaaaattctcacattaatcagagaaaaaaaaagcagagtcaatatagaaatacaatttagaagtaactgaaattcgaaattaaaaattaaagaatattgaaagaagagtttagagtccatatagaaatacaattagaaataataaaaattcagaaataaaaataaataatattggaagaagagcctagagtctatatagaaatcctagagtctatatagaaatacaatttacagaaaattcggaattaaaaaaagaaaatattgaaagacaagtctagtccatataggaatatatataatttacaaataactaaaatttgatattaaaaataattaataactaacacgtatataaaatacaatatgaatattatacatttttattttcgtaaagttattgcaaaatttaaaattatgatgtcattttaatatatttgaataatataatgagaaaacatatatgctattatatgagagaaaatataatgatgctagccgcgcaatctgcgtgggctaccatgctaattatttttttaaaaaaatacaaataggtcgtcaatgctgacccccttcacatggtgtcggtattagtgagattggtgcggagacattaaacgtcagcaccgataaccttggcaccaagaaaaagagtaaatttccaaaaaaaaaaagttttttaaggtttatttgcaaaataaattttaaagaaggatcacaatgtaaaaatctagctgcgctgcacatgtgcaccttcagatacggcccggttgcggtccggtgtggtactggtacggtccaccgagccgtccgcttgcggtgcggtgaatacagataaaactccgtactgaacccgaag

SEQ ID NO: 102591 - DNA, 738 bp, Oryza sativa
gggaaattaagcaacgaatctagaccatcccttgtatgctggatggttagatgatggatactgctaaagttacatgatccgaatccatctacccctggcttctcatttcacacggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacaggcggccgaatgtcgggggtgattcgtcccctaacctgccactgacaaacaacatggcagtagaatcgcagcaggtacactggtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagtttaaaaatcgtgcacgcggaaaacgagaatcaatctcccctatctcccgagacgaacagagccttaatttac

SEQ ID NO: 102592 - DNA, 1042 bp, Oryza sativa
cacattaattagagaaaaaaagaaatatctacaccgttagatcgtagtgggtccagattataatggtgcagattgatcaatgaatatatggaaagaatcatacagcaaattgatttttcgtatccgtgttgttgtactaattcgtatccgattaaccatcgaagaaaaaaaaaggacatgcactgccatatatatatatgcatgcctaaatagctagcctagcactcctggagaaaatatggatggcgtcccggagagaaagcacaccaaatgtcatgcatttttttcaatagattgatgactagcacggcaaattggaagggagtacctgtcgtcatatttttcatcaaataatagtaagcatgtatttacgttataagtccctaaaattatatatgtaattttaacgtatttagactataagtctcaaaattattacatatgtaaatcccaaacttatatatgcaagtgatgtaagtctcaaaattataaattattggcgactaagatatagggttttcgaagattaattggtaatcctaattagcaaataacgtaaaaagtatagaagaaattagaaaaaaaaaagagcggagtgatagacacgtcatgatgaatcccaaaatttgatctcaatacgaattcgtagaattcgacaaagttcaggtaggaatacaatttagaaattactgaaatttagaattaaaaataaagaatattagaagcagtgtccatctagaacacaacaaaatattttttaaaaattaaaatttaaaataaaatacaactccaaattggtttttaatatgaattcgaaagagttcaagtagtatctatttatcatattattgaattttaatattactaaaaaatatttgttagatgatatcatgttaaaattatagtggttaaatttaacacaaaaatcaaatagaatcccagtaatgattaagagaaggaatgatgggcaagctgttaagcagcacaatcacagtggttggcaagagttttagaaagtaaaaggtaaaccaaaatcataatc

SEQ ID NO: 102593 - DNA, 712 bp, Oryza sativa
atttcgatagatctttcatatttcttagttgtaggaatagagttgttattacttctcttgttgtatatataggccccgttcgtttcctctgaaaagaatggataaagttttggattttcgtggcacgtttttcaaactgctaaacggtgcgtttcgtgcgaaaattttctatatgaaagttgttctaaaatatcatattaatttattttcaagtttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggcttggggtcgcctcaactactaagaaatcgaaaggtgtggatgattagagctctctccattattacaggattagctatttcatccactaattaattgctcttatt

SEQ ID NO: 102594 - DNA, 590 bp, Oryza sativa
attaaatcttcaaaacaagaccatagatggatatattccgacgaaaaaaaattaacttattattgattttttttaaatgttgctcgatgtttcaccaagtatatcggaattgtctcactaagtagatcgaaaatatttcactcgtttaaatcgggtgttgtttcaccttatataaaaacaatgttttagcaaataacgactatacatagtaaaacattatgactacactaggtgaaacatttttcggtggaacaaaaaataaaccaaattcccttaatagggggtttctaaaatatgtgggtttttttgttgtaatggaatatttcgctcactgcaacattagatctatacatagtgaaacattgtgagtacactaggtgaaacatttttgatggaacaaaaaataaaccaaatttccttaatagagagtttccaaaatatgtggttttttgttgcaaaaaagtattttaatttattgcaacattagatctataaatagtgaaacattgtaaatacactaggtgaaacatctttttatggaaaaagggggaagaagtaggtggacccacgtgggggaggggcgcgtgcgg

SEQ ID NO: 102595 - DNA, 1369 bp, Oryza sativa
aattaacgccgtctgggcggatccgtccaaaaccaggctgttgcctttgcctgaactaattggcggatcccattgtgaacctccatcaaaaacagtaatgtaggatgaaattagatcacgttaatactataaatagataaaggtatattcatatttgtagtattacgatggatttctattgcatcttgtagttttcgctgtttcataacattttttttaagagcaatgctacacgtactaaatttttcttactaaatttttactaacaatcatctcaaccatttgatttaagtagatggaagttacaaaaaatctagatgcactcatagcatgacacatcagtgttagtaagaatttagtaagaaaaagttagtatgtatagccttttcctttttttaattatttgtacatcattgtaggataaagtttggtactactgtttgcaatatcgatggtcatttgtatatattttttgtgcgtctagaatgttacaaggtctactgctgtttatacatattaccattgccttgtaaccgataaagatctcatagcatttctaaaagtctcctcaaatcttgctcttcaaatatctatatatcaagatagccaaaacgatagatttctaaatttcatacgtactcaacagtttttccatattctactctccaaaattcataggtttcatatgttagtgtctcttgtcccctccttcactctcttttgttaggcatttgtaggcattctcatcctttggtaggtgtggagcccaccaagagccaaccactatgatttaccaagttcggccaacaagagaagacatttggcattttgacaagttaaatggtttatcaagcaatatgttttttttatttgctacaaatttagcaaagagagctaaatggtaaagctcttggagatgatcctagacatctatggtatgtgaaacatacacgaatgtaccatagctaaaattaatgctcaaggagacgggaaataatctctaaaaatgagaataaagtgataaacctaaatgaggttgaacgagtgggccggttaaaaattattccgttagataagccctttatctatccgcgcatactacttgggaataagtccacttactggctagcctcgagctcccgccgccatcgtcaaagctccacctcaaagctctaggaagtcctcccctccgcgtggtgacccatttgcttccccgttggtctcccctctttgcctcctggcgctccaccagcccttgtcgacgtatgacaccctacgaccctcatcgatgccatcggcccctctcaacgtcgtcacggcattggcatgccggctgccctcaccaagctccgactccaactccgttgtg

SEQ ID NO: 102596 - DNA, 738 bp, Oryza sativa
atgtatatcagggcacaagtggtttgtgtgcgccattgttgcgcgtggagtgatggagctctctgtcagctcgatcgactgtggtagaagaataaacagatccttcagctaagctatttgccacagttgggcacttgggcgttggctccggtccatgtaccgatcagccagcgtggtccggggctccgggccgtcgcgggggataacgcgacttgtgctggcttccgcggttccacctacgcacttcgttcggtggaaaaagtcctttttatttttctcaactaaagttttagtttgattcgcatccatggacagcaaaatcagatagagaggctaccttaacaatcaaaattgactcattttatcttttcgagtgatttaggtaacggttttttcctacatgacacattgaactagagaaatttaaaatgatctatgaaggaaatcatgacggccatggtggcagcgccacggcaatcgagctcgagataggagaaatgatgccacgggtggattgagtgtccaatggctgcgagtatgatacacgtcgaattattgtctttgttggagacctctagagagcgagctccgccccctcctagccgttggtcatctcgacgcttgagctcatccccctcgccatcagccagcctccccaactctttccttcccttcatgccgtagtagacttcgaggagcgctgctgtaggattgagcttgacaagaaggcagcggggt

SEQ ID NO: 102597 - DNA, 705 bp, Oryza sativa
aaagaaaaagcagccacttaggtcatcttgagttccgaataaggttttagatgtattgcatttgcttggttacaatactaaaataacctatatttaaaattagaaaaataatgattatcaaaactaagtgcatgccaactaacaaaatttccgagcgatccatatgatcatacaaattcggtgatgagcactgtaaaacatactcattgccaacaattaatctagcagtcatgtttacaaatacaaccaataaaatacgatgaaccataggtatgtaaccgtgtttttatcaaaatgcacatgattgttaagtttatgtatcagtttgcttattttacaattttttacattaaatcgcacccacctactagtttttgtaccgctggcgcaatttactctaagaataaactagttcgtccatggtactagagacatggcgactgcggaccggccgttgtttttgaatttacttttcaggactggatatttccatttatcaggatcaggcattgaaatattcctgatcatgcccaaaggtagtaatcacaaaccggttcacttccatccatctcgccgttgttccatcgcttccaacttcctccaactgaaaaattgtttctcggctcgtgccaggatatataccgtctcggcgaacgcgccgatcgaaccttcgcgagcacccatccatgcatcgatcagacgttg

SEQ ID NO: 102598 - DNA, 738 bp, Oryza sativa
caggtcttgaagagttcaagagctgcacgtggagacaactgcaacgtgcaagcgttcttctgcgcaggatatcctgcgcgcatcagttctctgaaaagagactgcttccttatccgatccagacgagacttgcgtggcgtggaatcaaccggtttccagaacgtccaagaacaaacaggcctgcggcgaagcagtgaagcacccgttctcgctgcctttgcctccgaagaggaaccacgcaggcagcgatgaggtagcgctgcagcattgcaaggcagagctagacctgacatgcaagaatatgtactgcactgcttccctagaaaaaaaatattgttccaatcagtccatattattcctgaaaaaaattcttgctccaatgaaattctgcattggtatagtagtacgtagtactccttgtatagctagcttaattagcaccatacattcatcatggctgatcacaccatttcattgcatgtgtctgtacgtacgtgccatggccgacgcatgggccgtactccgtacctcgcacattactcgcttggacaaattcaggcggtgcggcaggtgcatcgcaagaatcgatcgatcggcacacatgccgcagcagtggtcgcgacgacggccggcgcccacacggcgtgtacatgatacaccgtatctgcgtctgcactggcgcagttcaatggatctcggcggttgccgtacgtcttcatcgatcccctactccccctg

SEQ ID NO: 102599 - DNA, 566 bp, Oryza sativa
atataacaaattacactcctctggtcaatggagggaatggagagaagtccccggaagcatctacaccgcaggtctgggagggaaataagctaatacctctgtcccaaaatataataagttatagacttggacacggttattaagaaaataggtaatactaaataataggatgttgtgattggttgagaagtgaaggtaggtgaaaaaattgagtggtgaagggttgtgattggttaagaagagaatgtttgtgaagaagttgttatattttgggatggagggagtaggaaaaaaaaagaagatggcagtcgtaggtactgcaactctaccagcactaccagctgcaagtcgtctcctcaaatactccatacgaaaatatgttgctgtagaagaacgagctttcatactactcatcaatcaaaaaagaaaacaacaattggataccactgtatataattttgactaactcctaacaaagcaaatacaacaatttttaaaaatgccgaaaaccccctaacttccgtataacctgaaaaatggtccataaaataatagtgttgtaatat

SEQ ID NO: 102600 - DNA, 761 bp, Oryza sativa
gagctattaaaagaaaagaaataagcagtgctatcgttactacgtgagcatgcatggtcattggctgtggcgattaaacatatggggctcactgtcattagacatgttaatcacataattatctccagacttcagtacacgtcgacggattggctcgtctctgcgtcggcttatcacgaagattagcacggggcgctggaaattcggaggccgtttccgtcaccgctgcctatataaggagcataacccatctagagctgggacgcggacgacgccacaggagacacccaaccaccattttcattcatcccattcctcttagtagattaggaaaatcaggagaggagattgaagccggccggtgatagcaaaccggcgccgctgcggagagaattaaacaccgcagccggcgttcttcgtcaagtcgattcatttataacatgccgccattcaggatatttgcgttggatggtgagcacattgaataaatattaattttctagattaaacacaatagatgttcggtctttattggcgatcggaacatctgcgtgttcttaatcgatcttgatcttgatgattaaagccagatcgatgagagccgaaacacggttatcatcaaactccatttatacaatcaatggtataagggtggtccggtcctcattggcgatcggattatccgaatactatttgatattttctatgctcaaaactagatgtccgaccctcattggagattggatcatctatttgttact

SEQ ID NO: 102601 - DNA, 682 bp, Oryza sativa
ttctcagtctggcaccccataatgaatcatgctatacaaaaggtaaagccgttgcccacgctggcttgtggttggcacggttaatgtttcacaacagtagctcacgaaccggtccttaattgtcatgagcacgaccttcaaaactatgtgctcacaacccgccattgtcaagttttaattgtcaattaattatcatagcacgattaaccatcgtgagctaccattaagtataaccataaataataatgtagtatgattcatcccattagtgagctaatgtttctaagcatggcaaagcaattatatatatatagcatttagctgaaccaaaccaatatataaggttctagctaatcaaattataacccataggaaaataaattcatcttcggccattaattaattgggaaaggctcaccacccgatgacattcgaaaataatgcataagttaaaataaaacattagctttagacgggttcaacatgctcaaagggttgtttgggatctgtgtgacttgcctagagcttcctcaaacgcttctgaacctttctcaacgaaaacgctctcctccggaacgtcggaaacttaagcgaaagaacaaaatcaacaaaacagtataaaaacaagtataaacagtacatgtggatatttttaacatgtagatatcgattttagatgaat

SEQ ID NO: 102602 - DNA, 758 bp, Oryza sativa
atatgttttgttaatggagtaggatagatttaagcttcacaaaaataagacctctgctagggagctacggttattttttttatgtaaatcaagcaaccaaaatgtgaaatatgttttgttaatggagtaggatagatttaagcttcacaaaaataagacctctgctagggatcatgcatgggttttcaagcttcatgtaaagtcatgagcagagatcaaaatacagtagatcagtatcctttccatatatttggtcaacaattaagagtcaaaatagcatacaggaccaagaagccacaaaatttatatcatttgtatttgtacatagataattgaagaaaagccattcgagaagccacaaagatttccaacttttgtatttctagagaagtaattaagaataaaatcagccatttgtgtacatcccttttgtatttctagagaagtaattaagaataaaatcagccatttgtgtacatcccaatttatacaggccattttgataatatattatctctaagaggtcatgatgttccctgacttcctgttattgttataaatagaacaatcaaaatgagctagcatgacatctgtattttattgtgatcctgctattctgcaatgacagaagacaatgggcaacccaaactttggaaggaatatgtgaaatcattccctaagtacttaattacataacaaaatgataatatgccaacgaagaagaagaaaaggataagatcttgatacaagctgatgaa

SEQ ID NO: 102603 - DNA, 756 bp, Oryza sativa
acagacatgtatataacacttccattttctagtaatcttattttccaaggacattttctgataatcttgaaaaatctaaggcttgataacatattgcatatccacagatgatttaacctgccatatttcattatcttggccctagcttatttgtattccacaaatttataaagtagaagcatatctgtatatctaacctcatagttcggaatatatacaaagataaatgcattcttcagtcttggtgagacaaaatgaacagttaagaagacagtacatatggtcaacatataaaatcactcacactttgttgtggcttggattaataatgtaatctgaaattatagtggaaggttcaagaaaattacaaggacaactggctttgcatagtataccataaaagtggccaaaaggaaagcgataactatttccccagtcgttaactcatgatggatcagcaagcaatatcactgaagtcttatatcttccaactcctatttttcggagaaaaaaaatagagtgtgcagggaactcatagagttgattttgtaacatgcaaatgagcaacattcagtcatcgtacatttgtcatacagtaaatagaaagaaattaagatttacagttgaagaagataaccttggacgaatcctattcaatcaaacaaatccaagaatcataattcagtcataacgaagccaagaaccctaattccccagtgtaccttggatatgagattgtcgtcagtggaggtgtga

SEQ ID NO: 102604 - DNA, 513 bp, Oryza sativa
cctccgcccccattgtgaatccgcccctggccaccgcgctcactgagatgaggcggctccgcgtggtgggcgtcaacgacggtgaggaagaaaccaagcaggaaggaaccaaacaaaagtctaggaccaagcaaagaaaatatatgtgatttctattggtcgcttcccacggattcgatcgtggaagccatgaacatggtctccaatctcttcaggcaaaaatagtaggggaaatatctgcttgccgagcctgtctacttctcatggatgcaactgggggtggatggatgaatgcgtagggatccggtgggctgaggggattggatccaaacatacagtgtgagaggagagaagtgaaaggaagaaggggatgacgaagataaatctagcaagtgggtccctcgtgcagatgatgaagaagatggaaaatatgatggcagcggcatggttttaattttgtaaaattttagtagcacagctacaaatagatgaattgtaatgacatttatctga

SEQ ID NO: 102605 - DNA, 1168 bp, Oryza sativa
ccgcctaccttggttccccgcgtcttcctcctcactcgaaacatcatatcctctgaggcacagctgccggtccacctactcgcccatatcgtctcctcttctcttggtagggctttctatcctcttcctttacgcgcaagtgggaggtggcagatctggttgcctagagctcaactaccgccacggtccacctccgagtccgcagcatctcctcctctcttggcaaggtaccctatccacttcctctttgtgggagaccggtgcacaagtgagaggccgacaaactcgtgggaggtggcagatctggccgcctatagctcaatggtgccttgatgagcaggcagtagtggcgagcatctggaggtcgaggaggatcaccagatctagttgcctagaactcaacagccgcttgatctggccgcaacaagcttggggttagccaaatctagatgatgcagtcggctcaatgatggacttcacccatggcaaggaggacgactagaaaccctagccttctgttcttcggcatccttctctctgtgtatattcttccattttggtgttgatatattgatgttgattttgtgattgtgttcttcgctattgattttgttgttgatataaatatcggttgggaagtcgatcgatctcggggcgatgggacttccatgattatgtatttttgttcttgattgatcgatctcagggcgatggggggcgcttgaaacatcagcttaatttgagccgatgaatggaggaagccttttcttttcatttctagaacatcaaaggtgttggtttctaaattggtacgtttgattatttccattagtgccgctaatggaatatcggttgagaaaattacacctatatagggttactaatcggcactcacgatgtgttctatactagtgagaacatcttatacgtgagcactttcaggatgggcgatggaagagggacatgaaaaattttaaatttcaacccaagctagtacattatgtttcagaacctcttccatttcttccagctgccccctcttcttcctccactcattctctagaatagttttgttaaattactaggctctgacaaaattcgatgctaatcatggtgacctcatgaaccatgggttatcgtgaaaatatgaatacccgttgcagacact

SEQ ID NO: 102606 - DNA, 788 bp, Oryza sativa
aagtaagtagtgagctctactattaatattaaacttgctcttatgaggagatagctaaccagcaaaatcaggaaaatgtatacggtagtactggtaagtgctgtgcggtcaactccaccctgtcgtcccggactggtgtttgtttattttacgtgctgacgtactcgtcattaccaactttaactaaacaaccatccttcggctatacacatcaattatttatccgcctgccttgagaagactaataaaatgtccgtatgcaccggcaccgtcgtctcgtctgcagaagaataatgcaacgaatgtaccagtacatcaatttataatatgctaattaattaatgactgagattgatcatatcaactataccatggttgatgagctgatatcacatagagtagtctcattaacctcagaaagtacaaatataactttcaggttttgttgaccccccaattcccctgatcctcctatctcttaaccaaggtaattaaagacgcatgataaaggatgtttttatctaacacaggtttgggacagtactaattaacactgatcagtctttttggtgtggtgcctaaggcagtcccaacactggttagtactcttgttttcttcttttatggtattgtgtacgattatgtcaaatttaattacattaattaggtaccataaaaagactgattcgccactgattggccattgggcagtcccaacccatgatgtacataagtagtgtctatagtaccatgtcaataagacatcataatagaaactacactctaca

SEQ ID NO: 102607 - DNA, 526 bp, Oryza sativa
ccctaaaaaagttacatttcaaaatagggacaatttgaaccatgccacacaaattgcaaaatttgtgatatgccaccctgacccacatgtcattgactcatgtgggtcctacatgtcattgagatacgggtggcatatctcaaattttacaaatatagggtggcatggttccaacaaacccttaaaaataaatctcttgcctagggtggcaatcaatgttgttaatgtagtgttattgtttatggtgtgagtggcgtgacaaaatgctagctagtccaccgttttcacctatatggtactgttgtcctatcattataaataattgcatgattaaaaggtttaaataaaattctagataatttatttttaaaattatattgaaaggtttgaaagtaaaaattggtgtaataatccactataaataaaagaaaatccagatcctctttatcattgtcttttcgcaacaattgtggcaagtgtaagcagcttgtctagaaactcctaattttacgaaccaattcaaatg

SEQ ID NO: 102608 - DNA, 607 bp, Oryza sativa
tccttgatatcagagcaataaacaaatgatatgtaggagccaaacatgcaggaaggaattaataaacaaaagctgcaaaacttggttgacagaacacatattattcagcacaagcattggtcgaatagtggaattatttggctgtctgactacctcatataggcacctggcaaaccagcctttcataagattcgctcagtgtcacgacatcatagactccaagcttcttcaaccacataatattgctggggcatggatgagcagagagcagaacatgctgatgaaccaaaagaaaagcgcacaattagagcagagcaaactgaaactctcaacgaatcgtgaaatcgaaacatcaacgttgcagggaaaatggtcccagccatccacacacaggtccaaaatctccaaaacactaaacgagacgaaactggaacaaatccacacacgacaaaagctatatgaagaaattctctccattatgcagtaggaagacctaaccctaaactgttggagcgcaaactgccatgattcctagcaactcctggaagaagatgcattataggatgaaggcgtcgccggcacgagatgaatgtggaagccacagcga

SEQ ID NO: 102609 - DNA, 728 bp, Oryza sativa
acggagagggaattcattcaatatatagagtcgtgggacagtgaagttagctgtcctacgtacataccaaactaatcttgacaaaaaactgcttttttattctatgctacgccacggaacgaaattaactacggagaggaacaaaattaactacggaaagagaattcattcaatatatagagtcatgggacaacgaagttagagtcatgggacagcgaagttagctgtcctatgtacataccaaactaatcttgacaaaaaactgcttttttattctatgctacgccacggaacgaaattaactacggagaggaacaaaattaactatggagagggaattcatttaatatatagagtcgtgggacgaagttagctgtcctatgtacataccaaactaatcttgacaaaaaaactgcttttttaatctatgctacgctacggaacgaaattaactacggagagggacttcattcaatatatagagccgtgggacagtgaagttagctgtcctacatacaaaactaatcttgacaaaaatgactccatgtgttgtggtctatggcttatcattcgatgccgtcccctctaaagaagccaaacattcatcctacctaaaaaaacattgtggtctatagctcctaattgtagctcataattttctaaaaaaaataatgaagcaaattcccacagtaaatttcatcctagctaaaccgtataacaataatagg

SEQ ID NO: 102610 - DNA, 694 bp, Oryza sativa
caacatcataattaatcatccattcagtacaataatattgtccggttgttcatgcagatgccaaaaatacttgcaaacaatcatcaaatcaattaaactatttttgcaattgcaaatccaatatttcagaatcgctaaagcaaaaggaaataaataaaatagctaaccacaacaatggcaaaggctaaaatatccaatcatctattctctggttaactgttaggcattctacgttaccatgatccataaaaatctaaatggccaatgtccaaaattcccatttactaggaccaataacattttcctcctattgtccgcttgtttatttagacaacatccaaaatcgttcctgtattgttaatccatatcctttgtccattttaacatatccctaaactcgtacaaaatacacagccatatcgatgagttaagatagcagttctctctaactggttttcactgtgtagagcaaagaaaaagcatttttagacaaccaaaccttataatcaggatgccctggtccagcttcctcgcccgttccctgagagcatgttgtccatggaacttgttgagcccaccctaatttgttccaagaaagaagaaaaacacccacatgcatcagcaaccacaacgcatcaaaaccaaatgaaaacgctatacgattcaccgaggaagagacgcgtaccttctttgg

SEQ ID NO: 102611 - DNA, 816 bp, Oryza sativa
  unsure (1)..(816): unsure at all n locations
catatactcggaaagtaatacattaccaaagtagtataaagaaaaatattctaataaagtacaagtcttacaaaagaaagcagagctactagaggcatagccgaatccttccgaagacttctcggacaaagactcctattctattcctattccactagctttagaacactactaaactagagagagagcttgattcttcttgcttgaagtgtgtgttgaaatggaggatgagagctccttttatagcctcccaatgacggttgtgacggttggaatagtcggaaataccctccaaccgtcattgggagctaatccacattgtccaggcaaaaccctcgatcggatggcgctgaggagggttggaaccagggtccggcccaatccagcccattttcggctggtggaccccttgacttcctctttccacagacttgtgaatttcgggctgtttgggtcatgtcaatttagtgttctcagcccaagcgtctgactgattgatcatccattttgctgtcgattctcctccattttgtgtttattctctgcaagaggttagaatcctagtgctagtggaatataacttattttaacataaatatgcattgcaagcataactagttctctcttattttggttatattgatggtgaaactgatcgataacaaccgtcaacaaaacccaccaagcttgaacctttgctcgtcccgagtaaaggactcacagaaaatctaaacttggttattgatcaggagttgctactatgctgtatatctcanatgtacagatgcagggtatgtgtactctctctcaagttaa

SEQ ID NO: 102612 - DNA, 739 bp, Oryza sativa
cacatcaatgccacgtcaggtgaagagcgactcaaattagccacgtaggcaccatgtcagctaaaactgtcgtccaaaccgccatggaacctatattgcaccggtattgacagttgagggacccgttctatctggttttccggttgtaagacgaaaatcgaattcgttgacaagttaagggacctcagatgaacttattccttcaggatatggtagccgatacataacagtttttccttgggcttaaatccaaactgctcgcctattaacttttcagaacttcattgcctcatttctttccttcttttttctcttttatttatcttgctttttttcaactacaaattgatgaagacatcccagctacacttggcgtaaacaagggtgatggtgtacgtcatacatcacataaagaaaatgaagatgacgtaaaccaagttgatggattacgtctcagtaagaacgatcaagcatatcatggtacaattatgcgcagccatgctaaggaaaatacaacaagaggtgaactcgctattttctcaacttaacccaaattttagtgagaattttatactgcctaaatgctctacctttgtattgctaaggtgcacgcccgaggacatcatcactacgataagaaggatgggttaagttgaggactacaagggttacgccgaggaggaatcagcccatgcccaaccagcagctgtttacgcaaacaagaagatggtttgcgctg

SEQ ID NO: 102613 - DNA, 693 bp, Oryza sativa
atattggccacataaaatttgctatttgaactctgcagcattacataattgttatggtgctggaagcatcttatacagattatgaaatggaaaattgattcggaaaataaaaagaaaaactgaacgtagacatatctcactttttttctttttggacagtaacctgcatgtcttctcctctgaactatatttcttaattgttataactgacaagaacttatctgaaatatgtcatctttggttctcaaaacaattgcacataaagcaggggaaccctgaaaacttttgtggactacacttctagcataaattgcaagatgaaaaataataactagaattggtcaactagattcaaggataaccacttatacatatgggtggaaaatatatttcaatagcatgacagttagtagtagtagagaaatagaaccatttacatggactagaaattaaatatataagggcgaaacgactcttaaatccacaaaccggtctgattatggtcgagtctagattttcttttggtccattggtgcaaaaatccaataaacattagcgtgaccaccctttttttagagtacttaaacttgtttttttagataatgaaagaacatcctgtctttgtttcagaagaaggtacaatcactacaaacatagagctgctaaaaattccaaacatggcgaaactgaaac

SEQ ID NO: 102614 - DNA, 1478 bp, Oryza sativa
cggagcttcgctagaccgtaattccgctgctggtttctcttttcttttgtaagtatgtaacgttgtattattgatgaatctgtatattaaattgtcagtttgggtacctcggctgattcctggacgaggatttaatgcacaaataagttcggaaattactagtgaatttctgggcgtgacaaaacacctctaagcttctatatgacattcttaaattaaagaaaatatttgaaatttcagaaaaaaaaactatccacactaaaagtcctttaaatatcctataaatactcctaagcagtcaagtgagatattacaaatgctccgtggtagccaagcgatactctaacccgaccatcgatttttttttttaaatcggtggattcgttcttttattttagaaggttagttattttttaaaaaaaaacatccgaaagcacaaaattaaaaaacacccccgtcacgtacgtactaacgagctatcttcatgagaaattaaaataaaaattatttttacattataaaaccacaaatagacttcaacttgctaggtctagcagctctcactctatcactttaaacatcctacgagcccttttaagctactacatggtgctattaaattagagctatcgattagttaatttttttaataggaaaaacacaaacctctctccctccctccccatccccgtgcggcgttaaaatcttaaacatcttataaacactctaagttgttattacattcttctattagagtaaaatcatagaaattttggaaaaaatatcctaccattggatttgacataaatcaatggacacataattttagtatcgattgacacattattttgggtcagtagatttattttttttaaaaaaaagaacaccccaaacctccttccctccctcctccttttgtggcatgtggtgttaaaagtccattacatgtcttataaacattcttaagatgttacacctttttcttaaataagataaaatcctaaaaactctgacaagaaaaccaaacatccgaccatcggttttgacataatcatttaacacatatttttggttgttaggttaaccatttagaaaaacatcccaaacctccctccctcccttcccatgtatagcatgcgccatcattttatctctgttttttttatctccgtgacaattaaaattaaaattatctatatgggcaaaaaaacacaaatgaacctccatctattacttatatcacgttaggcatctaacaactttctaccaacttcattaatttctctaaacatgcatatcagggctatgtacctatacaaattgaccttggtacttttaaaatgatcttttaatgaaataaataaatattcttaagaagttactaatcataacaactattcatctagcaatatagacaacaagtttaaaataaaggtgtggtcagttgaacatcataccgaataccgataagcatatgc

SEQ ID NO: 102615 - DNA, 666 bp, Oryza sativa
ccgccgcggtcgcctggagggccttgacggtttcggcgagctgcgcgatggtggtcttgaggtcgtcggtgtcgctcatggcagcagcgcagcaagcggatgaagacgaggtaggggacgtcggcacggcgggcggtgtaggggaggtggtgcgggaaggagaggatcgccgggatcgttataccaggttggcaagtgcctcggcacccaacgacgccggaccgcgactacgtagctcgtagccgcgctccagtcctcaccgcgaggttttgcccctctgctagtggcttgtgattagtggagagagagattttgttgagttcgtgcggttttagacacgtagccagttgtcagggccaagaaaaagaacaaaaatgattgattatgctgtagcgctaatcgacgcgctgcgcgtggaatattaattcaagcgccgcacaatgctccatccttccggtttttcccttttttaccacctcacctttactccgcctcccacctttccttcactactagaaaaaagatttttccgggtggcccaaaaccattttcgtaggcgggggaaaggaccgccggtaccatctcgcctgcgaaaatagaccattttcgcaatcgggcctgtggcccgcctgtgaaattcatctcagaaaaataaaaaaaaaccac

SEQ ID NO: 102616 - DNA, 696 bp, Oryza sativa
atatgcacttctgcagtactgccttcaacttcctgtgatatttagtcctagatcatacatgtgcacaatgaggtacgacatacatataataacttcagaaagttaatgattaatctttaaccattagctccggtaatttcagtttggacatgtgcgtgatagtggatttgcatgccaaaattggttctgtaactcttgcagccttattttccttgcttgaaggctaactattcatagcgtggattagtgcccaatgcagagcactgccaataatgcatttctccctctcgcaggtaatggagctactaatagccttgcagtaatgtgcttttgttcttgcacttatggagaatttggatttttggaactcttagtttctgtttgtatgcaatgtaattagtcttcagtgtacttatcctagttgatcgtgctgatggatatgatgttaaaaatgagtaaatcaggtgttgcgaatgggtgaatgattggtctccattgacattttgattgacattttgttagcagctcaccttggaattataattatttttaggaaaatacacccacatttacgacaacttgtaagatgggtgtagtttagtcactcattttataaattgctcaaattaatcatttaatttgtttgagggtgcaaatctggtaaaaaaacatgtcacatattatttatgccaacgt

SEQ ID NO: 102617 - DNA, 659 bp, Oryza sativa
ttatataaaagagtcagcgggcagctatataaagcattactgtttggcaccttttaaaatgcaatgtaccaactcctaaaaagttgagtaactgcgatataaaaggattttaaggtattgggcacataatcacgcgcacttttgcctaagcaaaaagatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtgatatagaccaagtatagctcatatgaatagcttctgatctgagtgattatcccttatgggatactccgaaatagatataataattgaatcccgactgacacaagtattcggttgataacccttatagggaataataaatagtccagtctttgagcatagaaaatagacccatgtttatgaattcatgttgcatgtatccagagcaagtccaaattgaaggtatgatacttgtgtttgagctaagcccctgagcatatagcttgtccttctgtcgtaatcacagttgtccattgatcgtagctgacgcagttggcatagagacaagacgaccaatatgtagataatattgtctacca

SEQ ID NO: 102618 - DNA, 688 bp, Oryza sativa
ttttatagtgtagagacactttaaaaagggtctagaaaacttttactctagagacactttagaaatatttttagcacattttattagattttatcttgtagacgcattctttcggcactttaaaatgtgcttaacatgtaaagacatttgcttgagacactttaaactatgtagagatacttcttagaataaaaatatatactaaatgactaaatatataagtaagttaaggcacaaacatacaatgaatgacatggggttgagttggttaatgccttgaagataagaatgatttgtttaacaggtcatgagttcaaggattggcaaaaacaagggaaactattttattctcatttttacattggtttcatatggttgtgatacaatttaatgtctctagaaaatgcctctaccatgttatagacattttataaaatgcatcttcgtttgtagagacaattcaccataaggcacttattgggcacttttaaaatgcctccacagtattgtaaaggaatttgaaaagtgtgtctatagtactcgaaaaatgtttctacaaagcatttttcttgtggtgcatggtgttcaacacacatgacatctttggtgcggtcccccagttgaggccaagatccaatttgggaaatggattaaatttatctgatgttacgtgtatatgcaatcaatg

SEQ ID NO: 102619 - DNA, 666 bp, Oryza sativa
tgtgccatgtcatcgttcatgtggcgtgccacgtaggcaagaccacggtcatacgcggctttagaccgggatgatacaataaattaaatttagggatctcgatatgcgctttgcaagttcgttgacctaagtgaaacctcgttacaagtttaaggaccgctagtgcaatttactcttccgcatataacggttgagtttggatagtgcccctcatcttctaaaaccactttaaatatatagtcccgccatatgcacactatatttcttctctatggattacatgtacgttgacccacttttttttgttgttgttgttttatcgtataagtttcacatagacgccacattagataaagaacaaatcaatatggcacgttgaaaccgtcttcgttgggactacatttcctctgttcggtaaagataaggattgcgttagtacattgtttcgcggttgagagactcgatcgaaactcaaccttagatgagagaccggcagtgaactttttccaaacgtggttcgtggcccatcaaaattccaggattccagcttatgttgggccttccagatctgcgtcgttgggccatatgggccagcgtgcttgttcgtccaagcacaccggcccacgggcaccgttcgattacacgttagtagttccccaggccaag

SEQ ID NO: 102620 - DNA, 801 bp, Oryza sativa
agcaggcaattatgataacttcatagttaagattagcatgtcatgtttcaaatttgtgggcccaagtgcattgtcataatgccacttaaaacaactattaagtgaataattcagatagcatatttcctattaaatttctgtatagctaaggaataacattttccttctattagtctacaagtcggtgaaatatccactattttttgatgcgtccacagaggtcacgagggtaatttatattcagatgttcacaatgtgtgaataacttttttcttcctgtggtctcttactcccatgttgtggttggagcctggccatctaccttagctagtgtgccggtccaaccaatgtttgggaagtcggaattggtcaattgactagttgcacctagctgggaattcagggctgtgagacgtgattcgcatcttagccgaaacttgttgacctggcctggctgacttgacagatcaaatcagttcacgtcaatgatgtcttggccaaggatgcatgaggggatatctagaatgtagattcaccttttttaaggaggtacatatgttcgtgggtactccactgttaaggtggtcaattaacttggcattacttgaccattttacactaaaaagttaaaaatatgtcaataagttaaatgacttctgtaatctctacgtgactctaacatggttatttatatacttattggtcacatgatttcaaacaaactcctaccatttgtatctcatgtacttcctccgttccataatataaggcacaactacttttttttatgtcccataatat

SEQ ID NO: 102621 - DNA, 978 bp, Oryza sativa
ctgtcacggacagagtcctttcatttcttttcactctgtttttttttccttccttggggacaaaagaagcttctaatgattcttatgggactagaccacataatgcaacataggccaaggacatagcactcaaataggtattttccactatattttttttgacaccatattttccactgtatattagtatagctttaagcctttaaaggtggtttcaatcttctttgatactttctatttagccctcatagtttttcaatttatgtgaaagtccaaagtgttacactaaacacccagaacctagaaactaggccatgtttgggggagcttctagctgctgcagcttctcccaaaatcaaaagctcccccaaacagctcagcttttggtccagattctgagtagctgtagttgtagaatccaaaaaatgaactagaaaccagaagctaggaaacccagtttttccagattttcaaaagttggctaccaaccaattgtttctcagaatcttaagcttcccaaacagaccataaatctctcctctacccctccactctcccctctcttggaccctgcctcctatctcctctgccctctcccaccacctgacactagcagaatattttggttccatgatttcggtttaatatatagttaaaatattggattttggttttctgattaattttaccaccactagagtatatggttcaatgcagaaccatcgacaagctcgtgctggctgagtgaccgaataggacccaaaaaaaattaggggccccattttttctaattttaatctatcttaatgtgttccaacatgtttaaagctctttggttctatttttaaaaggcaaattttgctataggacataacgacttactgttttagctgtaggacaccgcacgaagtgagtattgggtaaagacaaatataaaaagaggaacttatggacttgaatcagacattgggttgacat

SEQ ID NO: 102622 - DNA, 986 bp, Oryza sativa
gcattctcgcgcccctcactccttcttgtatgactttgagagagagatagagataggagacctgatatgtgggtctagaggtattttagaattttcacgctatttctctcccctactctactagaaatgattattctaatgggcacgatgttcattagaaaatttccacgtttacaaagtaccttctcccaaaagtcattttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcgagcaacttagcaagcacaccgcacgccgcgtcgctccagacccggccgccggcaacggtgacatcggccgcaggggcaattactgctcgatcgttgctccactcctcgccatggcccagggatgccgatgccaatgccatcataggcagcgctggcgctgctactacacttgttaataaatggcccgcctgctggctaaggaggaagccaaattccactacgatg

SEQ ID NO: 102623 - DNA, 714 bp, Oryza sativa
ttttttagtttttaagcgtggcgtgattgtttttggatgtgttcctcttcctttgtaacttctcttaatgagatggcgtgcaattcttttgtgtattcaaggaaaaaataaattcattctgaattgaagatgcacaggaaaggaaagcaattaagttaatgtgaatcaaggaacacagtgcatttgaataaatttaagtattaagagtatatgtattggaacctcttaataattaccaaatgtttattgggttctgctcagcagtgttttctttgacaaaaagtttgtttttatacccacaatatataaattatgaagcttctgcaaaactctttagtattgagtaagctgttgcgaacagatagagcctcagccattattaaatgccctgtgcttatttgatcccgtgcatatatcaacataaggtgtttgtgttggtggtgtgttatatgtgatatttttacgagtaaatatgatcttcactagctgaaattcagttcaatctactgattaaagggtccatctttgggatcaaatttatgatttcttccggtttgaacattgtttttataaactcttgtagatggtactgtttggtcctcccacacttttagtgatttatgtcacagtgtgacctaactggccaaccaattacatcagaactggagggcattagtcgcgttcctccaccacccccatcaacaaccttcactg

SEQ ID NO: 102624 - DNA, 574 bp, Oryza sativa
cctccggttcagtttcaggttcctggagataaaatacttgaataaaaaaaatagaaaataatatttttctagtaagttgcttgtagaaagtgccttttatttataaaaccatttataaaaccattttttataaatttattttttatttgataatttcttcattaaattattacaatcattcaatcccatgtttttacctagctcatttatttcactgtagttgacatgacaacagctgcagactagcaacggtttatcgatgattcttatgttagagataatggaatatgtcaatatacttcaagaatcaatattgtctacctatggtaacatgagtaattagaccaaccatccacatgcttgcatttcactaaaatggtaaatctgcaaaacttttctgatgaatcaaacggaaaaggaaaagaaaaatcacaggagatcgaagaactggtggtaccttcttgtccccctgtgcttgcgtttacggctactgccgccatctccatgactgtttggatcatccatccttcgccgcagaagctcaaacttgtacagatcgattgcatcttgggca

SEQ ID NO: 102625 - DNA, 1501 bp, Oryza sativa
cagatcaagcaagaaattaaataactaacacagatatgttgtattgtacatgttatataggctttttctgacattattgctatggaacaaaatagcaaaagatggaccttttgtcttgaacaacagccagaatgggaggtttaatttcagctttaattgaaaaaataaaataaaaatcaagtcatcagtagcaatatgtaacacagaataacactaccaattttcagtgcatagtagctctcacgggatgcatgatacatgctggctgtcacttttcatcagcatgtgcatggtttattctgcaagaaacagacaatgaaaatactctgttgatacatgagcataggctaccttcccatacattgaataatgaatagtagaactgtatggagtgggaaaaaaggatagcgtgcgctgcctgcagttaaatactgtgcagtacaaatccacatccaaagctaaattcacctatatgtgatttcacataatatcaagcaagcacattgcattggaatttggaataatcatatatctcattacaccgctgataatgaatcttgattgaaaaggttgtaactatcacattcttttctttactgagattcctatgtttaagcccatacaatggaatgcactgcaaaactgtggcagatggaagatttctattggtattcagagttactatgggatacttaaatggaaaagaaaacaatatacacaatatcaaaacaccacaaattaacatagagagattacaggttagttaacaataaaataatttagctacgtgtttatcgagcaccttaaatgcatgtatatctcagaaattaagagatactcccttcatccaaaaatctaaaaacatatttcttttatcaccatgaccaagaagtaattaactcatccacccagtgacaaaactaatgaactacacacatgcatgtgacaatactccctccgtcccaaaaaaaagacaaaccctaggtttgcgtgtccaactttgactgttcgtcttatatgaattttttttataatttgtatttttattgttgttagatgataaaacatgattaatactttgtgcgtgacttgtgtttttaatttttttcataattttatcaaataagacggacggtcaaaaattgggcacggaaaccggggtttgtctttttttgggacggagggagtaagtactaaaaggacgtcttggttccggtcaacaatttaatttagcatatagagattacaaataggccttagacttttggaaaaccaaagaatgaaataggtattagacttttggatagaggaagtatctaaaagctaaatgtaaggttcatatttagaaaaaaaattcaatccatgaatgaaacaacaattgacaaactataatctatgttgacaaatatatagcatacgaaaagattcatgggacttgagaggcatttctgatggatccagaacatgatgcttattaatttcggggttcttacaacaagaa

SEQ ID NO: 102626 - DNA, 1046 bp, Oryza sativa
gccgagctaataaaccgaacgcccacccctactggttgccatgcttcttcccatcgctcgccacctttatccaccggcaaatgcacgcgccaccatctcgtgtagggccatcgtgagggagagagattgtagagagaaggggtgagggagggaaagaagagttggccactgacatctggggcccatgtgggtcctgtgctaattaagatgggttgaccgtcttcatctcgtcatgtcagctaaaaccattatctctattgcctaaggatctcgtgtacacctatattgcaagttgagagatgcgttatactttgtattatggtttcaaggacgcaatttaatctcgtcgttaagatgatggacctaaagtgaacttatttctttatgtgaagtgttgggtgtaattgggttgtaagttttgcgtctagtgtttttggcccaatttatgccaaacacggccaagactactttcgatatcgaagccgactgatacctattctgtcttgacaatactagcgtcgaccttcaggaggccgagaagaatggggattagagaggatagataagagaagatgggagaatcaccgacaggtgagcctcactttagtttttaatttctctaattattgggctatccattggactccatgtggccaaaaccattctaaaaccactgagagagtatagttttgcatagtttaatagttggaggagtaaatatacccagttttatagttgaggaataacaatcggatctgatctttaaggagggagtataaatagcctttttcgaatcttgattacttgaatctgaatggaccaattaatcattaccagcgggctgacccacgcccatcccagattcccaggcccatataagtgtgacttttagcccaacaggagaaatgaatttcgggcttctgcgcctaaaaacgagagaaaaagaaaaacatatgctcacttttctggcttactgctgtgcagcgtcacccgcttatcatccacacaaacatttcccgacttcactctctcaccggcggcggagg

SEQ ID NO: 102627 - DNA, 642 bp, Oryza sativa
ctggatcagccttaaattttaaaattgaacactattcaactctaaagtatcgtcactttcaatcttgcatcagatttaacgtggccctgacatgcctttgtggcataaggctgaaaattcttttgaattttaaaatttagtaaatgaatttaaaaatttgcttacgcaattatcacttcttccatagtataaacaaaatttcgacttcaccgttcctatacacttttttgtggtgcgtagatttcatagactgcagtgcattagtgccagacaccgtttagcacggaccattccatggcccatcctctgtgatgggccatgttattattactctatcctgccaaaattcccaaaatttgatgttgggataactgacgtcacatttgatgatggagtatatcttttgagatgaatagaatttgatctttggcaaataaaggccgaagtagtaccaatgtaccgtgcagttgagtgccgcgctgggtttttcttaccgtcggttactgcggtaaccgggtttatcgtcgtggacttgtggtcgtgtaatgaaaacaatctgatatactaccttcatcccaaaaatgtaataacttttaactataaatctggacaaaatgtttatatttgagacgaagggaatat

SEQ ID NO: 102628 - DNA, 503 bp, Oryza sativa
acttttttaaaaaagctgtttgctagttgtcctctcacacccttcttttttttctcgtcaataatgtagaggtccccttccaaaatcgaaacttacatatcttttatggactaattcatgagaaacttatgcctctagcctattggagctccaccatatggcacataacctatacatagaaggtcaatccagcaagcttgcaagagataaattaaagaaaacagtgttgtagccaaactaaagaatgataaaataaaattccaaattaattaaccacaacattttttagaacaataataaccagcttgtcaacatcaaataggtaaatcgcctaaatccgatcctcaaatgtagaataattaaggacgtacacgtatggtaatctgacccacgaaagtgaagtagagaatgacaccaaatttgttctcaattgattggcttcgccaacggacaatttccatttcactttcttgggggaaaaagttatggccaggctgaaaagg

SEQ ID NO: 102629 - DNA, 654 bp, Oryza sativa
gaaacaacacccgtttttttggaaaccgtttgttttatacgttgtagcaaaatattccatgaggtgatttggttgtgtttcaacttttcaaacgattgaaacattttcatctacttagtgaaacaattctgatctacttgctgtaacagcgctcatttttttcaaacaaaaatcggacgcctgatttgtaggcacctcaagtttttagtaggggtagttaccacatctaattttgggccatttaccatacccccactgggtttggtagtagtgtataggggtgaaaacgatcggaaacggtcggaatcggtagcatctcttcggaagcgatgctcgatcggccggtgattgaccatatttattatttaaacaactcaatatcgacattaatatgatgtataaagaaattagaaaaagcaaaaatttaaaaatagccaaaacgttacggtcggaaatggtaccccttaaacagaaatggcgcccagtcgatcggaaatttccgtaaccgttttacccctagtagtgtagtactaggaatcaactctaaccacccattgctatgggtattttagacttttaattgattgacgtggaggggcagtttagtctatcgcgatgatcccgagaggcaagacagccttgcatgttgactcg

SEQ ID NO: 102630 - DNA, 1888 bp, Oryza sativa
aatgagtagatttatttctcttgccccatgtatcctcctcccaaaaattctcctgcagtctgatgatccctctacggctctaccccatcaatttgtattgatgtacatgaatcagtcatttcctccaatttccttcccaccaaactgcagcattttggtccaacaaaatgcattctaacaacatttatattcagtttgtttatactatcatctacttatatgcttcagtttccaaggtttcaataccacatactatgtggaacaataactcttctcaactacgttgcttggtcctacagttggtatcaacactcatcaatctgaaacccgccgtcgtatcgacagcctcatcttttcgcttatgcttatcagccaaaatttaaattttcaaccataaatttgaaattgattttaacgttttttcatcgaagtttatttttcagattttgcttttagatcgcttagaacacctatataaaagttttattcacaaattatttttttttataaatatgccatttggcttgttccatctaaaagacaaatgatgggggccggaatatagtacgccgcttcgccggaaatcaccggatgtcaagatcaccttggtgtttacttttattgggatgcatgctactttgcttggtcttgcgaggccttaatcgccaagatgaatgcaggccggatctgatcgcaccatatggtcacaactaggagtgaaaactgtacgaaaactttctagattccgaacctatttttgaaaacggaatctatcagtcagaatttttcggaaacggaaatgaattcagcaatattttctcggtaacggactaaaaaatgagatgggcagtttccatcggaactccagaattggtcagaaacttttcggaaattttctcggaattactgaatttttgtaactgaaataccctggattcttttttcttaagcattgaatattgaataccatggtgtttggctgttatttttttaaaaaatatttgttatgcaaatctaaaattacataagaatatttttttcctgcatttaggatttatcaacagcattactcttttaaagatagataatttattccatagattgtgttttgtgatgtaccgttgatacttaacaattggacttatatgattgtgttttatgatgaattgttgaccgttgagacttgacaattggatttatcagtttgaggggttttttccgataaattttcgttaccgtattcgcgccggttcgttttcggtttcgataatattcaattccgttttcgtatccggggtttctgattccgattccgaaaaaaaatatgaaaacgaaaccgataaaagatggtttccgtccatttccgtaccattttcacccctagtcacaactactgtagaagcatggttgctctttattttttcatcaaaaaggaattcaattcaataagatatatgtaaaaatgcgtaaatcagatgtatccaattcaactattatagaccccttccaacccaacccctcctccttgcagcccaacccaattgacccacaccacccatacagctgcttcttgctagaacttttttatatttatatttatttttaaaagatttacaaaaataaattaccgtttcaaatatttgcaaaaatatcctcctcccgccctctaatagagagcgatttatgtgatgtagcagcacggggttcaaaaatatttgcatttaaatccttctcaccctctaaatgtaaaattttctgcaacacatagcatgaagtatttgtatgattgtaaaattctcgtatgatgtcggatgaagttaaagttacatgaaaattatatagctcgacaagatctacaactttgtagttgattaatttttcattaaaa

SEQ ID NO: 102631 - DNA, 565 bp, Oryza sativa
aagtagcctattcatgcaatagttacctatgattatatactacaccattaatatccgatcccacctctcatacacacataacgtcttggggtccgtgttacagctggctataaattagtagccctcttttttctctctcttctcttttcttcttgttatgtggttatagctagcttatagcctgctattgtacttgctctagagagtttatttctagaggttgctagacaaattagtactcgctcaatccaaaagtcttgagcatatttcattttctacttctttttttcaaatgaggatggatatatttatagtatttatgcatctgaggctgcgttcgaaaccttgtgttcccaactaccacttctcgctttttcacgagtacgcttttcaaactgctaaacggtgtattttttaaaaaagtttctatacgaaagttgctttaaaaaaatcataatgatccatttttataacaaaattagtaaataattaattaatcatgcgctaatggaccgttatgttttccgtgcgcccagtatatcttgggaacaatgggtgaaaccct

SEQ ID NO: 102632 - DNA, 565 bp, Oryza sativa
tgtcacaccagtaagcacggagaggaagtgtggtggcagcgagaaaggggaggagtctatagagacaaagagagtgcaatggatcggaaaaaaaattggtgcagtccgggtgcaaaccacattgcctgcagccccacttcggatgtccgacgcgtggataatataccaatccaacagcttgccttgtttggcactatccaacaaggctgcacatggcatgccttggcccggctcccaaaaggggattgtgcagatgtggaacgggacgactcgccttcaggcatgaccaaatcgctagcgactacatcgctggtgactacaaccaccatgaaaagagaaacctttgtggacaacgcagcagaagaagcacccggcgtcacaaggaagatggacatagcagaaaacgaggatctgtggtagaaaaaaacaaagatccatctgcgacgccagtggcaccaccatcgtaggagtgcgaccaccttggtcatgggagaacatgctgaagtggccactgcccatgtcccaaacggcgtacttcttggtgcgcgctgtggtgtcggcaccc

SEQ ID NO: 102633 - DNA, 687 bp, Oryza sativa
ttctaatcattgatcttagtgattctatacggtcaagtaatgcagtttatactaaccaagcctcattgaaatgcccaaagaattttgtcgccttcttactgacaactggaaggacttaattctgtcatcttgcggtaatattcaaattaaaatgatgaactaaacaaggaattataagaaatcatacatacatattaggagacagaaactttggcatgggaacactatgttcttaagaagtggtccagccttcagaagagctctgatatttcgagttttcaggtaatgcttctttcccactacacctgaacatcaacggtgtgttgtagctgcttcaatcttcagacttttgtatgaagtttcatggtaaacatgtatctagctttcgttccagctgtgcacctctaaagctgtactctgcaaaacatgcatctactcattatattactttgcattgattttcatcaagtgcatgtgctactttaaaatattttctgttaagtcaactgatacgtaaatatccgtgtgaaactataatactctagagtctagtgggaaatattttgtagttaatgtataggtatcagttccaaggggctattactaagttgtatgtattgtgatactctagtagcacctctaggtcctgggcccaactctctatagaagcgaatttcaggtctagtt

SEQ ID NO: 102634 - DNA, 694 bp, Oryza sativa
ctgccatatcggataaaaccggtcaaaactatctagagtgacttggttttgtaacaccgtgtttagttgtaatttttttaaaaaaaaattccaacttttccatcacatcaaaacttttctacgcacataaaaacttccaacttttctgttacatcgctccaatttcaaccaaacttccaattttagcgtgaactaaacacaccctaagttgagggatgactttgtaatccgatgtaaaaataagggacctagtatgcattttttttcaggagaagagtggaggggtataagaagtggacgcttttgcacgggctgaaagagtaagagctttgggtcagattcggcccaaagagaaggagaggattatatttaggtttatcatttttataaactcggaaattggtttttgttgctttaaaactattaagtttgcttcgaaaattcaagtaaaaattgggaagcatgaagaatttaagaaaaatagcagaatggcgcattttagtatgcatacatattggcacattgttcctgcatggtagtgatggtaaactttcttccggatactacaattttcaatttgctatttctcttttagagaaaaatgtttctgaaggagtagggaaggaatgcctatttgcctattctcttttaccatttgtgctctgaatttaagcactctgataaggttgtctat

SEQ ID NO: 102635 - DNA, 2253 bp, Oryza sativa
gaacgttgtaggctccggtggtgtacatgaacatggcctaggcttccttcttgcgggtgggattcttgttcgagttgacaccacaaggggaggccatgccgctgcagtaggtccaatggaagatgaggaaggcataggagaacacgtgaggaaggggattgtggagagagtcgatgggcctgggagccgagccaaggaaccgcgcatcctcgtcccaccgcttggtaccgagcagataaagtcgttggatcgttataatgtccatgtgtcaaccatctgtggtagggttgcaaaggtaatgctttgcatccatgctacaccaatttttttccccaatagatggtcggtgtcggagcatgagcccttctagcgggaaggcacgatacgctccctttgagattcagcaatggtgcaggtgttgagctcaggtgtagtggaatagcattttagataggtttaagctacttgggagtgtaatactctactcttgtgttcttgcttagatcacttggtttaagggtgttcttcaaggtctttttcccagtggctaacagaggtggtctcctcttgtcataggtacagaacccatctttttggtggcattagtctctattttataatagtaaggggataccccaatgcctggacaaacaagcgcgacccaatgtatagtagttgacgttgataaccgaatttgaaaaatatcggagctttccggtgaaggtttgtttgaccgcttaatgtggtcggtcagaccgtatgtctgagcggtcagatcttcagcacaaggttcgagtctaatttagatatttctcgtgtttccttttttagactaggatttatcgagacctagttgatttttaagcctaattagacatgtgaaagaccttaagaagagtccacccctcctataaatataagggggctaagatcgactgaagaaacaaccaatcatcgtcaaattcaatttagtatccaaaccctctatattctacatctccctccttgctacctatcccaagtctattctcctcaagtccccaattgctcgtcatctctcgtatctatggtgttagaggacgtcctagctggcctgccaagcctaggacaaaccgatgtatgttcaccctaacggggtccctcccagttgttcgttcagtggcatctatcactccctacagtggcgtgtctctgagtgccaccgtgggctgcatataacgtgctcaaggtttgcggcgtgattctacatcagcaactggtaatcttgatcttgcattggcccatcttgaggggccccgttgatgcgaacaccttctcctccttctgacgcatggtgtaggatgatcaaggtaggtgtcctggacatcgttgggcccatttgttagcctttgaggctggctagggggtcattaaccggcgggcgagacatgtagcatagtacgaagccacactgtcaccacttatccaggggtggcattggcaagtggagggaggtacgccctatcgtccacgacggcccacaattctccacagcagccacaccatttgtcattaatgcagaatgacacagtaagggagcgtgtatggtcaggtcatacctccttaattgttggggcgtatctgatataggcctctagccccgaggatgacctcggggtcctagcccattaactaccggtcaaagaacgtcggagctgacactatctttaggcatccttcctacctcagggctacctacaggctaacacacactggcgtcatacctttggagttcggggtattcatgtggcactacatggagggcacatactcaccatgatgggtcctaatgtgccccgagtattcatgaacagtagccccctggcctcgtcaccgaaccgaggtctgccatggggcttgcttccgaagcaagggaacacagcatggtgtgggccacctgcggcccccaggagacgtgacagggctctgctttaatgtctccctccttgcaaccgcttatggcttccaaaaggttagccatgattagacgtggtctttgattattgggtggtttgtgaaaaacatgtcgattcagtacttgatgcaaaaccacgcgtcatgctgtggcacttcactaagcctacctagggcacatgcgttgttctaccatggacattggctcaatcagccaccgcatcatggagctgaccgccataagaacggcttgtcgggctgcctgctcatgtacatgaggtggcgtcctcaaggtggtcg

SEQ ID NO: 102636 - DNA, 792 bp, Oryza sativa
ctagatgtttaatatggcccgaggagtttgataagatgtgtgacagaattcaaaaatatatttcaatagaatttttgttgtcacctctaaataaaagaataatgttctaaatgataactatattatgttgaatcatctctaaagagttccttctgtttttgttcccactggttccatttacatggtcatgaagcagtttgcttgctggaccttttgcgtcgcttacatggctcctcccattatatctggcttttaggtaaagactattcatttctttgattgttggataactaagccagggtgatgtgaattgctgattgctgattctactgtatttaatacaaatttttcctatctttttaacagtgcttcagagggcaatgaattcttctgaagttttccattgttacctgttttcagtttcagtaaaaaactaagctcttcaatgtaaatgggacaacaatttgaatagttactataagatcttttgggatcaaaagatttacttgttgcaggcttaactttcatttacattgcagaaacttatcattggtagataaggatgtgttaaaaggggcttgcttagtacaactcaaggcgaggctaatactatggtgggtatgaatttaaaattacaatatctgagttcaaattatttggtataagattgtagtttaagatgttgactgctaataattttaaagttgtaattgcatagctcactggccaaccacgtgctataatgaaatatttttttaaaaaaaaattgtaagcaagtactattaaattgaa

SEQ ID NO: 102637 - DNA, 787 bp, Oryza sativa
ttattaaaaatgtaaaagtttgtcgcatgagactattgtagttatgagtttttttgtgcgatacattatttatcacaaaatttagttttagataataaaataaaaaaatatgtatttatttttaaaaatcataaaaatgaggagcattcatacaaagataggaccaccaatgctcacaatattttttttatgaatgctcccgataaaaaaaaatcaattgtcctattaaaatttcaaataaatattttaatctattacatttgttttattttcaaaatttatgtaaaaatttcctgcactaattatttagtctcattagtttcataaaatgcacatactgtgcattcaaacaaaattttcaatcatttttcaagtttatattcaaatctaaagtatcaagggaaaaaatgatatttgcaaccaaacgtaatactgaaatgaaggaaaatgtaatagtagggacacggaagggatcaagttgaaattttaggggtatagaagggatcggataaatttcaagggtatgaaagggattgagtaagttttcatgggtgcacagggaattcacttaaaaaaaagatggacaatattgcgactaaacagtacatgtacaccaattagtttaacctgctaccattcttatatatctgaaaataaatgatatgcatgcatcatctctctcccacgtgggagtatgcaagaatgcaacagctcctaatagataagtttcaaataaaatcttcttgtaaatcattcatccgattatactactatattagttgtaatt

SEQ ID NO: 102638 - DNA, 1689 bp, Oryza sativa
attaaatcatcgtatgcctatattctcaacagtgcaagctaagggagaggatcacatggcttgatcgatcgatcgattatattcgctcttcagcagatatacgcaagactgaatttgtgcgtagcttagctcgtgtgtcgatgttgaattgggtggacggatcactcactgtaactccgatggaaacatgcacgtaattgttgagtgcggtaaaggtaatttaattagtttatcccgttagttgataagcagcatatataacgagaatcagatacatatcttgcacaaaattaaagattggccttacaaggatccaaatatacttccttgtgggtttataaaaaaaacatatcatatcgggaacaccaccgcgttgcaattttggagcggattcttcatgcatgttatatgcaaatgaaatggtggtgaaaagaaatataccatctattactagctagggtcatatcagaaactgaaagagaaacaacatacgagaaaagagaaattttatagttattaagaaagtatctagaggtatcaagattttacattaaaagttttggtacttcaattttattcaagaaaatatggtacctccggtaccttcttagggatagtaaaattacccatgagaatatagagaagttaggaacatgggatgtgtaccatatattttaaacaattaatgttagcttggtatttattaattttttttagattattagatcataaaaatattatgattgagattccaaaatgactataacttggtattcattaatttggaattttagaattgttaaatcatgaaaaaactacttgataattaggcataaggtataatgttatcaatcgtcctacttaatttcaaatttaaatattacttgtgtgaagagaaacataaaactagttttttttaaaaaaaagtcgtagataccaaatattcagcacaaaaatagctgatctgatagattaaaaaaaatctagtaatactaaatattagtttttaataagatatagaagaaatacatttacaacctcccaccacatatataagctacacacagcataattaaagaggtgttatcctgctgaatgattcccaaaccaaatgtggcaagctcttctccacttgtatggcctttcaattcggataccacgtggacaaccgcttaaaagcacgcaataattatataaatttctagtgcatggcggtgagctccaattgcaggaaagggaatagtcatgctcatatgataaaaagaagagaatcctctagctaatttatacagttttactttcctggaaatgaaattagtgcccatcagtcgtaggaaagcaagaaccttcctctatatgtacattttcaggaaaagatgctctgcattcataaatgcctgcttttgcagtactccctcccttagatcaagtttaatattagagctaactgagttgatctggagtggagttgtggagcagcttaaaaactccacaactctagttcattttgtgagagagctctacccagctccactcccagttttggtggagctgaaactgtttagctgagctctagctccagaaggggtggagctggagttagagctgtaccgaacatgccctaggcctgtttggcacagctccaactcctaaatataactccagaagttgagtctggagtggagttgt

SEQ ID NO: 102639 - DNA, 1788 bp, Oryza sativa
caagcatcctttatagctcgtttccaaaatgagccaagcccgagctggctcacgagctgcttgcgagcttcgttggctcagtacaatagagtcatacaaaattttgcaccttttcttactatttatttgttgaaaatgataactttgattgtcatattatctattttatgtgttgtgatgacatgttaaagaaaaatatcactttattacacattctatatggtaaaatgttgctcgatttctcttagaccctacttaagatttacttgatgccaggttcgcgagccagctcgagttggctcgagcccattaacgagccaatccgagctacagttttaactcgttgtttgtagcgagccaagccaagctgagcttcccttacaccaagctttcacgagccgagccagctcggctcattacctatacatggatatactaccggctctgttccactggatataaaaccagcccgacatcatatatgcaagcaaacacaaaagaacgtcatagaagatccaaacacaataatgactgagtcaatatttgttaatggggtgcaaccaaagtctacgtccccgaagtactgattaagtgcgctagttcccaatctagcataattacagcgtaacaagatatctaccactatcgactggcaaggtcataggccggtcatccctcacttatactactatcatcacatggttataacatgtgtgtttctctatttaagagagaccctaagacgaaatccgactcaactattgttttatacctattacaactctaagtcctaattcgtaagtcctaattcgtaaccggttatgtatcgtatcattttttcatcatgtccacgtggcacattgcgcaatgacaattatctgagcctcgattgtcactgttccataaatctatactttctatatagttgatacccactaacaactattagaagctaaaactcaacatgcaagcatgccacatcatcacccactagcaattactattctatctcatttaaaatcctatgcaaacaacatgccacatcttcacttactagcaattactaactgtagcatattgtaaatcccatgcaagcatgagtgcatgacacatcatctataatatactccctccgtcccataaaatcacgattcctagaagcccaaggtgactttagcagcagtgacaaaagactagtatgctctcaccaaagtacaaagtacaaccattaattaacggtaaaaaaaagacaagcatgaatttccttgtggctgtccttcccatcgtcaatccccttccaccataatagctgcatccgagcaagccacatccatcagcatgcaaagcaagcatcggccacataccagcataccacacgcatgcaaggctccaccgccgccgtcgcgtagcaaagccttcaacacaatggagggaggtgtggggaggtggactggtggagcctcacagctgtcaatgaagaacagagccaagaatagagaaaaaaagatactacaagaactagcaacaaccctaacgaatgaactagcaagaaccccgacgaggccgtgtccgctcgtcgccgccgccgccgtgttcgccggtcgccgccgccgacgaggccgcgtccgcttgtcggcgacaatgccttgtccgctcgtcaccgctgccgccgaggccacatgtacgcaagaacaccggcgtccgctcgtcgcctcccccgccagccgccgccggcgcgttgagcaggagggatgtgcggggaggaaggcagggatggagtgaggggga

SEQ ID NO: 102640 - DNA, 1675 bp, Oryza sativa
atcacctactagttaggatgatcatgccttcaaccaatcgtaacgacgcctctgtggatttttttttcttttaagggagcgtgtgttgatttcttgtgatggacaaacttgatgatcacttcagctgtcatatcttcctcccactgctgatgtgttaaaaaacgatgataattggtacgaactaacagtaaagcttcacatcatacgattattgttcctactggcggtgcaggtgctgcatcatcagagctaggttacgtccctgttgccggatgctagtagtcgttgtaatacctccattccaaaataagtgttgccatagatatccgtgttcagtgttttaaccattcgtcttatttgaaaaatttatagaaaatattaaacaaattagtcacatataaagtactattcatgttttatcatctaataacaataaaaatactaatcataatcttttttcaaataagacgaacggtcaaatattggatataaatagtgctaaaactgtacttattttgggacggagagagtattactcgcttgcatatcagcaagagcaaacagaggaaataattgccgcgacgttagctcgtgttccacaccaccgtgcacttaattacgcgacggcgtacgtggcgttgccgaaatgccgttctcctaggctcctagcctcgtacgaaatcggaccatcaaatgcatgcttttcccagaatgatatgattaaaatggaataagatagtgcaatcatcatgtgtagcgctctcatctccgttgtgccggagcagggagatgattagttcagatatgcgaacttataatccttactcggtatggtcgcttggttattttactccactacttaaaaaaacacatatagatcgacactataggtgacggaactattaaaaccggtacctataaatccttttcacacctctatggcatcgaaagcaaaaaaaaaaaacattcaatccactcggagggctacatgtggtttttaagctggcgttaccgctttcaggggagtgtagtatggctcggccccttcccactgtttagagttagggtttagccgtcgtagttttctaagcttcggttttttattttgccttttctcccttcccctggcataggccgatctggttgattgcgttgtgtaactaaaactcttttcttctaatatattgacgtgtaatccttttgcgcgtaagcgaaaaaaagccaagataaaccgacacatttaagcgacttaggtgtcgcttctatagaaaaaccgatcccaatactataggtgttggtttttaaaaccaacgcctttaatttatcataggtgccagcaatttaaaaagcaatacctataatatatataggtgccggttttttaaaagaccaacacccgtaaaaattgagccatgagccgagttgtgagcggtgaggagcggtcgagaggataaggctggggagtggggaggagcggtcgcctctatcaactcgcggtctctctctctctcttctttattttacctctctttgggtgcttctctctcggtctctctcttgaggcaccccacgggcagcgacggctccccagggcaacgacagcggactccccatggcagctctctcctcgccaaatctggcaggaggggaggtggcgggttccctacaacgcaac

SEQ ID NO: 102641 - DNA, 1785 bp, Oryza sativa
gatgtggttgattctaattatttaggtttggtagaaatgagattaagagttgaaggcattaccgctctatttggctcatattacgcaaaacatgcgtgagtgctggtaccattcagccagaaagaactcagaacatatttgccacgtgaaggttcagtagacaccactttgtttggagatggattctaatctctcgggacatgtccacccgtttcttgcatgccacttaaatgattatgaaaaaatttcaaaaaaaattagaaaataggttaatatgtaatatatcatttcacaaacatgtaagttcaaatttgacttctacaagttgtaaaaaaaataacaaattaaactctaactagtatacgtatattcacagtcaaatttgttatttttgttacaatttgtagaagtcgaatttgaacttgcatgtttgtgagatgatatatcacatattaacctatcatgtcaatttttttgaaaatttttcataaccatttagatgacatgtaagaaacaggtggacgtccacccgagtgtatttggaggaattccacatcaaagaacaatagtttggacgaaattgatggtggccaatgaaccagagatatatctcaagttctcaacaggtttcagcctctttcattaaaacagtccattacctggttccattgcaagaagagaagcacggtgttcggtaaatgtgccaataaagagtagactgacaagtagacaaccatacgggtacacttcaaactctacgatgaaatactttttttttctcttaatctctagctaatataatatactttttaaaaggctttgttaagttatactacaagagatatatcaacatgggatcccctgatactgataagaatgaaatgccaagaaaaatttagtttctttgcgttccatagtgtcgaccactaaattgctatcaagtgttaaacaaaacatgcgcaagagtaaggagcaaaaaacgaggttcagagtgttaatcaggattcaggagataattaagtaattagtactccagtttagtgctactactaagaagcgacagttgctgccagatgcgaagctcgatcagcgagcgaatcgaatcgaaggaacctgcgcgcggttgtcggagctggcgagggcggaggccatgcatgtgcggcttcaagttcagaaactgaagaaattgagtcttggtttttcctcatgaatcatgagggaaaaaaccagttgtgattgtgtttgcttatggtattactgtgttcaaaaacaccatgaacattccgattttagatcctgtgaggtctcgagatgttgtgatgcatggtcatcaatcaatttcgcagttctgaaaagtttgacgatattcggcttggcggcggcgatgccaccgtctagcaccgtggccggaggcaacatggacgggcaagggctagcaggattgatcatggtcatgcattggcctcgtgaggacatggaactggaagagatgggggcattggaggaaccagatcctctaacgtagaggattctacgttagagggacgtagaaagcagcagcgccgtttattacgcatccgacgaccgtgctcgttttcctttgatcagtccagaagcgcaatgcttcgcggcccagttgcgaacaaaatgaaggggagaaacgacgatcggagaaagaaaacgaagctgccactagtcggccatggccaccggccactcgctgtcgctcgtcgtctcccttgaacgcgtaacatactaacatgtgtgcaagccggcgtgggaacg

SEQ ID NO: 102642 - DNA, 1215 bp, Oryza sativa
tatgcccatatacttcatcgagtcctagttaattttgggtcttggagattgcatttgtgtcatgagctaaaccatagggagtgtgtgagtgtaaagagcacactccccatggcttagttcacacacacacacatagccatcatcatatagagttggcttttgtttagattattccgccacttgtaattttgctgttattttggattgtttgtagtatttttagatttcttctcctacttccttgtttgtattcttagtattcgcttatactaggagcctttagattatcaacgtcaagtccaccacaatcggtttatcaatatctttcagaagatcgggatcatggctaatcacatttcctcgaggaatcaaaattaaaattcccctatcctcatatattgaggactccctccatcccagaataaatttaattttcaccatctcacacatcccaataaaaaaagattaaaatacccccactttatcaaatcctgatgtgtttattcctcactttatctacttcgaatgcatttatccccaactttcaaaaactcagatgcaacaattattaaaaaataaacttattttaggacagatgggagcaacaaaaaataaacttattctaggatggaagaagtagcattttagtttaatttcttagtctacacatgaatgggtcaaagtcaaagctgagtcctcccaaaaccacaagttcctcggtgggaggaactagctggcttaccgtacaatttgcttgaagttattttgttttacccctatttccatttattcttgtatgtatgacttagcgtgtaacttgacttctactgaaaaactacgcatgattagttctaacaattagcatgttcaagaataaaataaatcgaactccctgcgatatagttttaggttataacggctgataatgacaagtcaatgccggatatttagcaaactataatttcggagtatgtgcaagggattgacaaattagcattataaattgaattatctgcaacttcagcctggaagaggtgatgtttggagctttatttggggaacagatatgtacacagcgaaaatattttataagcttaattactcctcgttgcatcctcctatacccatgatttggctgtggaaaaccaaatgtgtcatgaagataaaggtgtttgcatggcttttgttttgtgatagacttaacacaagggatat

SEQ ID NO: 102643 - DNA, 637 bp, Oryza sativa
ttacggcaacgacgacgatggcggcaaccacgaggagggcggcggcgggcgacggctagagttagggttttgattttattttttgggttctttttgttgcgtgtgggcgacgtaagccacctgcactcgaaaatctgattttcgcgcgcaggtgttaaaagtgaaatttggtaagccacggagtcatcatcgacctaaagtcagtatcggcttcatagtcctgaaatcggccaatgagagtcatcaagtcaccaatagtcaaattcctgctatattcggttaaggaaattaatcaattaaagaaagtttatccagaagtgaccgagatcaaggagtagtatgttagtttccttttaactttaggaaagtgtgtttagtgtcctacaaggagtagtatctacccatggatataaatatgtacgtcaggggtcattgtaatttatctcacagatcaatacaactactctcggtgcatcgccaccctctttaccgaggtttttacttatcatccgacggagcttggcatctgacgcgggtctacatcggttttcgatctccaggaaggggtaagtcctacgtttcgttggccctggcaattatattggctacattggcgtcgttcaaggctgcatcagta

SEQ ID NO: 102644 - DNA, 2798 bp, Oryza sativa
gtgtcggggatgtcaacgatctcggagcccatggacacagaaccaaagcaatctgataccaagttgtcacgggctagggaattggaaggaggattgctgcaccagccaatcgcatctctcgcagtgagaggtcgcggaaagttgggacccaagttctatgggccatatcagattatcgagtgcatcagctctgtggcatatcgccgttgtcttcctccgggagctcatctccatgatgtttttcatgtgggattgtggaagccgtttacaggagtgccaccggaggtcgtgccgtctttgcctccgacgcatcatggccaagtttgccttcagctggaaactgtttcgcagagtcgtttggctcatggtctacgtgaagttcttgttcaatggaaaaataagccggtggctaactttcagctcgaggacgaactacttctcagggggagagatgtcacgtggggattgcagtattcacgccgccgcaacaggaagcccgcgacaaccatgtgatgcgcaatccccaaataggaaaatttcctaaaggatttgaatcctatgaaatttaaatccaaaggggctcttactctgttgcagaaatcattctgtgacaactgagctatgcaggacagaagctccagattttgtgacatgcaggtttataatacacaatattacaaactgtcatagtgcaagcaaatacaacttcgaagtaccaaaattgaacatgtttatgaaataaaggaaggtctctaatcccgaagtcaagacaaaacaagcagtcctacgaattcaaaatctgagggcctttttgatttgtaggaaaagtgtaggaaatttgaaggatttcaatcctatggaaaaaatttctatgaaagcttttgaaacaaaggattgaatcctatactatcctttaaaattcctatggaatggataatcctatagagattttggaggaaagttagcgagaggtccaaccttttggaaaaattcctttgagtctatctctctcatctgattcctgcgtttttcctgtggtccaatcaaacggtcattcatgtgtttttcctgtattttccaatcctctgttttacacctgcattcctgtcagaatcctgcgtttttccattcctgcaattcaaaggggccctcaaaatgagaatcttacagatcgaatgaccaatagccatcacatcatttttttttcctcattgttttatctggtaatgaaaattttcagaagttagtaaaagcaagatattgcaagattacagaattacttaaacatggatttagaaaatgtagttatctactgacaatgcacatgtgcagtacaatgaagtgagtaaaagcaagtgagattacgtggggatattaaaaaattcttaacataagaaaatcaagtgggtcaattattaaatacttaacagtatggtatgaaatctaatgccacagggatcaatcaattcaaaaaaaaaagccagaataatgtaagccataatcatcgataattagttcaatgacttactctgccatccatgagcccatgatcatcgtattgttgcactgcatcatctttctgttgtcattacaaaaaaagccactactgaagcatcaactcaattccaccaaacttggtcctaaagtgcatcactcgactcagtgcacagaacagcagtaaggcaagaatttggcaacctcttaccaagtacgatttctagaacttgacagtatccttttctgaaacgcccttctgatttccaccttggatccaaactccaaagatagctcaagcaatgccttgaaatccttttgttcttgccacttccacaaacaatgcctaggcttccaggaagctccataacactgcaatataagaaattcaacagaaaaataacattaagcatctataattgtaacacacatttttttagttctgattagcaaataattagaaattctgtacaattaattcagacaattagaaaaaatgtttgttacagctgggaaataaattaaagtatctaattacatcctcgctactgcgggaaaaaaacattccttttattctttaaacagtgagataatacataaatttaacatcaatcatcatatttctaagtcctacatttcttctccgcattttggtacttagggaagggaagacgagtcatatactccctccgtcccaaaatatagcaacctaggacccattcccatcctaggttgctatattttgggacggagggagtagtagtttacaaataaatcaaaacaactaaccctatatccagaattatccaacattttattgctgatatgaatattgcatgatcgtaatatgctgcaaattattatgcatgagcatccaaagctttgttggtccaaaaatttgatagaacaaaatacggaagtacttgattgaggagctgataggttcccttttgttcttatgctgcttgcagcctcccacttcaattccatcgggcttgcagtggcacgatggtggtcacccttcttggtggtgctgctgccaacttccccatgctgtgcgcctgtgcccctgctgctgatgggctcggccttgtgattccttgttatatatatccaggagtactgatcgttatatccaagagtactgactacattgatccagctaatccaggtggcttgtatacacacctctctttcatcaaaaccctcaccttgtcagcatcatcccatttccctgcctccacacagatgtttgacagcaagacataatttgaggccttgcaaggttccaattcaaataactt

SEQ ID NO: 102645 - DNA, 704 bp, Oryza sativa
  unsure (1)..(704): unsure at all n locations
gctgacgtgcgggccccacatggcagtgacccgaggagggcgctccacggcggaccaggtccacggaccgggggagaagcggcgtaccacgtggcgcacacgtggcaccgacgcggcggtcacgcggcagccgaaccgacggccccgatctacccaagggtagatcggacggcgggtgtggctcgcggccggcgcgcgcaggcacggctcaagctggcccggcggccatggcgcatggcggcgcggcgcgcatgcggcggtggcgcgagacggcgaccgacggcggagagcggcgtcgtgggtggctaagcggcggcgcggcggctagcggcacgggagagagagagggaggggaaggggaggcctcaccgacggcgagcaacggagggcggcggcgacggcgggacgatctccggaatcacctaagaaatcgaaatggagggattagagggagagaggcaaaagggagagggcgagggcgccggccgaaggtnnnnnnnnnnnnnnnnnnnnnnngcgcacggcgcggagtggattccgacggcggattccggtggggaaggggtggacgggatggcccgcacgacggcgaacgcgacggcgtcgatagcgcagctcggcacggcggctagcggcgaccggagcggcggcggcggcggctgaaaagagggccaccgcgctaaggcgctagaaggcatgggaga

SEQ ID NO: 102646 - DNA, 1430 bp, Oryza sativa
cttctccaacgagctccccctttgcaacaacgcttgtcatgcaactaggcaatgcatcgaggtggacatgtctcttcttcggtgatgtgctccccgacatagcggcgaggcaaggcggaggaggccttctccaaccaacttgccactgctaggccttggtacaccgtcttactttcacatctctcttcaccaacatcgattgtgttggtcccccttcactcttgatggcgaactataggtgcgacatgctcttcctccttgcacgacggttctccccaacaataagcaacaagctagagtttgatggcttttatcagtgcttgtaagaagacaattttgtctggtacatttatgaattatgtgccgaagcgaggaaggactccaaaagagggagagtgccatcggtggttggaggaactgtatcgggaaggggggctcctgatccctagcagcggcggcagcaaccagcttcttgctcaagcgacgagaaaaggtaaggagagaacgatgcgagatttgataaacagaagggcgatcgatccattatgtattcaaggggcacaagcacaatggtatttttttggcttgctaatctttgtagaaaataataaaagaaattaaagttgggttaatccgttcaaagtggtaatcatcttatcatagtctatttatctatttattagagtgcaaatcgttgatttacatcttctaccaaatgaggcactgaatagcaatggatctatcaagattggttagggccggccggctgttccgttttcaacatttagcaatcctacctgactctgatttgggtccacctagggtgctatagggctactcatatctcgcccaatttagcacgaactaatcagctaccttgatttgggcacgttgggttgggccgaattggcctagacaacgttccccttacctggctcggcacagactcatctggtcaggtactcaggtcgtccacatatgctcctctcccagaaacattcccccgaaacagtagtgtagctagccaggacaagctgcaacaacaacaacaacaccaccactcacgcggtcgatttcgagttggcaacgcacgcacggaagggccgagacggtgaaacgccacgggttttacacgccaaatctaccccgtttttttcgcccgtctccccgtcaggtttccgcccgtgacgagcagcagcagcagctagtagcacaccgagcgcacaagcgtacgtatacgtgcgtacacggactgacgaacacatgggaacaagcggttaatccaaggtccaaacacacgctctggcccactacgcctcggcccatccacccccacccccatatccgtccccctgccaccggccaccgccacggccacggccacgccgcatctccccctccccctccaccaccaccccaccccgtgtcca

SEQ ID NO: 102647 - DNA, 644 bp, Oryza sativa
cctcgccctcccctcccccagatccggccggaggggaagtggcgagatgggtggccagctggcggcgggatgggaggccggccggtgagtcgattttttttttgattttttttaatttgtggtttggatgttttgatctgtgaatgaatttatgaatcgatattgtgaatgaatctgtgatgttgtgaatgagtatgtgactcgatgttgtcaatgaacctttgaatcaatattgtgaatatatttgtgatgttgtgaatgaatatgtgaatggatattgtgaatgaatttgtggtgaatctgttaatcgtgctgtggagttgtgatgtggatttggggtttgatttgatgatatgcataccactcgattcgggagaaaataaaaaagaaaaaaggactagctgatggactgccgctaccctctctttagtcccggataccgggactacagggggttacgacccgggactaaaaagcacttctccaccagtgcgtacaccctataccccccacttgattgtctagaatgtggttcgggtcatttattttgcgtcgtcagcatttaccaatcaccagcccctacgttatgtgcacacacatgttgtaattcgccttccagacatctgcgcacgcagtctcgtgtc

SEQ ID NO: 102648 - DNA, 1710 bp, Oryza sativa
ggcgcgcgaggaggcggaccgcgccgcccgggaggcggccgtggcgcggaagcacgcgcgcgagctgctcgacgccgcgtgccggcggcggagccggaggccttggaagccaagaagaaggccgaggcccccgttgcgcccgcggccgcgccgccaccgccgccgccgcagcccaagaagaaggcacccccgaagagcagcgaggcgagcagagacagggacaacaagccgctcaagctcaccgccacgcagcagccggcgctggcgttcgccgcggccgccgctgccgcagccagctcgatgccattgtcaatgccgtcacccatggaggtggacgagaagccggtgatagaggagttgcaaggtgagcagaacactgaaccagccaccacattgatcgaattgggagataattgttctgtacaatgattggtatataattcttcatcgaatttgggagctaattgttctttacaatgattggtcttcatcaaaattgggagctaattgttctttacaatgattgatatgtaacagtcttgcaggttcaggagacgggtcgttgatatatgatcgtggctcgctgttcgggaccttgcaacggtgagatttgggcgccgaatcctgcttcttcttccatggcattatgcatcgctgtagcgcattcgatcctagaagagaagggcactcaagttcagtggtacaaggattgcaatgtgattgaatccccatttttgagtgttcttgctgtaaattctagtcttgacttggtacatgatccttccatcaactgtagctcgcctgcatcttatataccctgtttgttatttgtagtacagcgaaatgtgttgctggtggatgaatcgcatatggttttggttttttcttaaatgaaatgaactagattcagaattcatgaatacataatttctttgctggttgtgggacctgttgcgaatcgaagacagtccttctgcttatttgtgtgttcttccatttttgttgtctgtcatggtatggcagtggtgagttcaatcaaagttgatggtgaggctgacaatgctggagaaatgctgcaaccatgtcattgctaatgccttctaccattttcatcagatatctgttgtcagtggtgttcatgtccaaaacaaaacttttgcagctctccattttgttgttttcgtctattttcactgtagatttgcaagtttgagcagtccctgtgtctgtgatgttggcattggtcttggttggttggatcgtccaactagttcagaacagatcttctaatcatccaatgtgataacagattaacagtgatgctgcagttgtttctcctgggctgttaatcttcattacctaaattttcgaagctttgcttgataacaagaacaaaacaatgctggatacagaggttgattagctgctggagctggaggtacacactcctctgctttagctggaagcagagtttcgctggttctggggtttgctcctccttttcgtctctcaaacaagtttacgcaatcttgtagtacgccttcggcaaagcttctttggaagctgtctcaggtgggcgcctttcaccacagaaaacgtaatttgccacacatctagcaccaatggctccgttcattgttccacagcaggtacggttgctgcagccgcaacgcagccacaagtagcacaaacgaacagccacaatttttc

SEQ ID NO: 102649 - DNA, 2712 bp, Oryza sativa
tggtggggccaccagttgcttgtgttgagaggtttgggatcctgcaaggctccaccatgtcaaccccccaaaaccatggggatcacattgattccttcatccattattcttaatcccgccacttggcggcgccacgtggcggattaatccaataagtctatgcatggggggtgagtcattaggtgaccacgtaggacccggtccaagtgtccagaaagtgacaattgaaggacatgatgcattgcatcatcacgttgctggggacaatccatatgcatgtgcatatgatcagagagtatgctagctaggaattgctgcttgtgcttgataatccgaatcaattgagggtgtgtttagttcacatcaaaattagaagtttgattgaaattggaacgatgtgacggaaaagttggatgtttatgtgtaggaaagttttgatgtgataaaaaagttaggagtttgaaaaaaaaagtttggaagtaaactcggcctgagtgtccgtatgatgtatgtgcgtatgactgattgataattctgttgaatgcagacgtgtgttcatatgcctgcatatctgttttgtcggtacaacattagtatggaaatttccctttttcctttccctatatgtcgagggttgagttttgtatttatccctagcttgtcggtgtaggcacaactatagtgtgcaacaatatccccttcattcaaaaataattagtttttaatttgaggagctacctctaaccaataatattttttataattaaattatgtgctcccccattttaaattacttgtgcgcttctagctttgtcctaaatcaatcttttctatctttgacgttaaacaatttctatctttaacattgatggtcaaaatgtcaaatatgatgttaaacatattgtctctttaaacatatatagattgtgtaaaaaaatgtatgtatgtttgttttggaaaataattttgtggtatcttcatttattgggatttcgcaaaatactttgaaacaaaaattactagtcaatgctaaattctgatgtccaaaacaatataatatgtttttatggacgggagagagtagcaatgctgttgtcaaattgtgttgataagtctaaatgcattgaattcaaatatatattttttaaaaaagctggacactaatagcaggtacaatagcaagctataagccagctataaccacatatcgagaagaaaagagaagagagagaagaaagcggactacagatttatagccggctgcaacacggactccaagacgaagaaagcggactacagatttatagccggctgcaacacggactccaagacgttatgtgtgtatgagaggtaggacagagtattaatggtgtagtatatttttatagataactattgtataaataagctattagattagctatagatgatttaaagccagtagttggctatactattgaacttgctctaaggaaggatccgatgtagaatttattaagaaagagggtgagtatgttccaccaaagtcgaacgcgggtcacagaaagcacaacgctacaccatgccatctgcgctacgtgcagcctcaattcaaatattcattacttttccttgttttagagatgaacacttgaatttaataaatatatcatcggacatcaacaggacataggatacaagagcacaaaaaaaacattagttctggctttaaaaaaaaacaagcaagagaggtttcttgcgatttgacaatccaacgaaattgatcgatcttgcgacgtacacgcgtacgagattacttaactcaccacgagtttgatcgcatatgtgccccgatctttgattctagaaaaccgataaattaacacgcacgctacttgtcttgatcatccaatttaggaattaaaaattcgataatcttgacgtttggtgactgatcacgcccccaacaacttttgatccacaatgcaaaaagtacagttctttatatttttcaaattgattccatgcaaatatagatttaatattttaaggagatactgagttgaaattcatagtacgtgcggaacaaattttcaaatgagggagaatcaataaaaagtgacatggtgtccgtcttctatacagtacggcaagatttgagggttttgaaatcgatttatattttttcctataatttatctttgtcttcttttcatgatcgatttcggtggcatgggtttctctaatgactatgctatgattgagtcgttgagactatactccatgtgcaccgatgagattgaataattaatccatcaatcttgttaaacaattaaagattaattaaacagagggaaagatatcaaggaggagagaagggaagggaagggaatgatatgacaagcgaaggaaaaagagacgacgagtacttaaatatgttagaaaacacttcgaaagattcatgtagttaattttgttatttatttcttggtgtgatttggctattgggtctaatttgggtaggaagtgatctctaagacaattcgagcacacaactcacggatgtctccatccatcgtgtctaccgctggcttcccattcgtcacatatagcacatggtttgtctagccgattaggtaacatttatgactgttgatatgtgggtatatatatatatatatatatatatatatatatatatatatatatatatatatatatatatatatatat

SEQ ID NO: 102650 - DNA, 536 bp, Oryza sativa
gtcttaatcggttgattacatctcatatttcatcggtttagctcgctctgttaagatttctcacctcctcttggatgtattattcatgtatatgttgtgtggtctggctaagtttttggtctgtcctgataaatgctgtttaaggattctttctttgttctttttttttatggacaaaatataatctttgtgccttactgtgaattgagtctgttggctatatcgttcccggtttattggactatagatgaacatgtaaccctatatgcggttgtgttttctccttacaaagatcagtagtacctaattcagctagttagaagtggtaccaaggctgtaaatttccatctttttctctgtgaggttcatttcccttttaatctctgtttcgtgagaaataccccactgtttgacttccagtaaatctgttctctatttctagttcagttaacctgctattattgattctacaatttaagcataataaagattaatgtctattagttttctcaattgatcatgtggcacgtatttta

SEQ ID NO: 102651 - DNA, 511 bp, Oryza sativa
ggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggcgggggggggggggggggggggggggggggggggggggggggggggggggggggggggggggggggggggggggggggggggggggg

SEQ ID NO: 102652 - DNA, 685 bp, Oryza sativa
ttaaaaagaagaaaaagattggcataaatactcctacagtagagcaagaaacaggtggagaaaaaagaaaaaactgaaggcgaaagcaacaggttggtgtgcagctgtggctactggatatttctctcgtcttctcgcagggatgcaggtcgtctgcagtactgcactcactgacatgtgggccccacagcccccgggcccacatgtcagtgagcagtactgcaggatctcaattgttctcgcaggctcagctcagctacccagtacccaccatggcgactgattgactggtgagaggatgggccacgtggaccaatggcggaggactccatggatggacggtttaagcttcatggcccatgagattaatttccttcaggaaggaaggcccagcccaactgtacagggcccatttgtgtccaaaactgacgatccagttctacatgctaaaatcatcctccatatcgacctcatttccagacaagaaaacatgaaaccatcacagattgcatttccaacatgaaacattcatctcttctggatcaacatacatagggttcatatgttacatcaactttagcaggggcgtgattataccatacttttttgctgtaatactactattgctcagtacacatcatcatatgtaaggcaaaggttgggctagttgttcaccatgcccagg

SEQ ID NO: 102653 - DNA, 1974 bp, Oryza sativa
agttaaatttaaaacggtttgactttgaccaaagtcaaaacgtcttataacctaaaacgaagggagtagcaacaattcagacaacttgccaaatgttgaccatggccaaatattttcatagccagaataattggtaaggctaatactggcatagaaccaaacaggctcttactctagtattcacttctttcatctaccactgttcctccgggtacaaaagcaaaatcaagaatggtagggtagcatcttatcttggcgactataattttagtcatatagcattgaaagttattggtttcagtatttttcttctcatctttgtcacattgaagccagattctattagccataatgcccttattttgctcgcattggaggcgtcagcaatgatagtgagggtgatggataaggcaaggagccacacacatgtttgaactctttctccattgcctttgacaggctgcctgccagccctagcaatccatcaagattgagctaaaatggacagagagggcaatgttagtaatgtgcatattgatttttggacaaaaaaatcggaggaaatctaacggttgtttggacggaatgttataagagggagcaaagacaactttagctgctaataatgtaaatccatgtccttcagtgtctcaatagaagttcaagtataattctttgaaagtatagaccataagtatcctgcttacattggtaacaacagaatgtacataaaactgttaccagtttagccatatgcccatatacgactaaaggcaataaccagaatttgtattcagacccaactcagctaacagctctattgatacaaagagatagaaactcgaaaaacactcttaaaggagactagtagactactgtttttacacaagatctattgatgcatatttttcacatccatgacccatgggcaccagatatgtctagaagcaaaaacaagaagaaaacaccttttttcacagctcttcaacaatgcaatccagcttattgagctcactcgtctggtccaatggcttccattgctgcataaaagattggatcttgttgtataaaatcgcaatgcagaggaggtaacattgtactgaacacacaattttcctgagttacaatatttgcagtaaaaacgataggattcctatccagttctacgagcgaaatgattcaactacaggaaagcgcattcgaaaacacccaaagtttgacaaaacataataggttaggtgacttgatctgtcttcaaagcatgcttccaacccattttctcttatagccaatttggttttccgaatgactctagttacagaataatatcaaaatgaatatctgaaattttcatctgcattttttttgtgacccatagatctttcatttaaacttctaccatccctccaaaagttagacttggtaacatgctactgtactaaaagcatatttttagtttttctgtagacaatctccactttctacgcaacgaaatgctgaaaagacttctaacatagctacatgcttgtagaaactttaacaaattatactgtaagaaaacagaaattgacataaagcaacaaactttcatgtatcttctttaaatgtggacatccataaaactacatttagttataacataaaagaataacacgctataattatgaatgcatcagtctaacaaaaaagtgaacagaaagcaagttaaattggtcagccaacagattaaaatcacagtaaggacattccaacaactaagtacatggaaataattagatctttttatgctaatgttacataaaaacaaggaactacctgcagtgtagaaacttgtgaagggatgacagcgggtgacgacattgcaatcaaaaagtttcttggactgcattgagtcaactcggaacatgtagaaatccgtatccaccactaaaataaacgcattaggatcctcggaatatcccacgatatctgttt

SEQ ID NO: 102654 - DNA, 686 bp, Oryza sativa
ctgcaccccgtgtgggtgtggcgaaaggtctcttcggctacagcccttgacgccatagcttattggtactatggcgaagggcgtgggtgggcgaaacctgttcgcccacagcccttgacgccgtaccttattggtactatggcgaagggcgtgggcgggcgaaacctgttcgctcgcagcccttgacgccgtgccttattggctctatggcgaagggcgtgggcgggcgaaacctattcccccgcagcccttgacgccgtgccttattggcactatggcgaagggcgtgggcgggcgaaacctgttcgcccgcagcccttgacgccatgccttattggtaatatggcgaagagcgtggcgtgtggcgaaacctagtcgcccgcagcccttgacgccgtaccttattggtactatggcgaagggcgtgggtgggcgaaacctattcgcccgcagcctttaacgccttgccttattggcactatggcgaatggcgtgggcgggcgaaacctatcgcccgcagcccttgacgctgtgccttattggcactatggcgaagggcgtcggcgggcgaaacctgttcgcccgcaacccttgacaccgtgccttattggtactatggcgaagggcgtggcgtgtggcgaaacctattcgcccgcagcccttgaccgccggcctttttagtacta

SEQ ID NO: 102655 - DNA, 633 bp, Oryza sativa
agctccgactgggtcggattcggctgcccagtgcccacgcagcagagagctttcccgacggcgctaacgcagtgttacattaatgggctaaattttattgactcgcatgaagtgctatgagtaataataccaccttaaaagtaaagaggtctcaacttaaatatgaagctagtggatagactttgttgaccggttgagaaaatacggtaactgattctgtatcggtaatattaacgagcacgtcgcttactgaattaagcacacggttgatggtcccgaatgttactcttgcgcatcgcttactgaattaagcacgcgcggttgatggtcccaaacggtaataaacacagtaattgattctgttttaatgagcatattggttattgggaattctctctgcggttgatggtcccgaacagtaataaacatggtaattgattctgttttaatgatgggaattctctctcgttttgtaacggacgataatattaacgagcacgcggttgatggtcctgaacggtaataaacacagtaatcgagcgcatcggctaccgaattaagcacgcggataatggtcccgaacgttactcttgcagttgatggttccgaacgttactcttgtgcacgcatata

SEQ ID NO: 102656 - DNA, 663 bp, Oryza sativa
ggaagaaaatataaaattgcaacatcaagaggccagtgaacaggaaacagattcagagctactagctcaagaaacatgtcagagaactcacaaattcagcagaggtactagctcaagaacatgcaagagaactcacagattcagcagagccacaaacactaataatgctaaatgacctgacaagtgattaacaacatcaaactggtacataaggatgttagtattaacatgtgttcaacacttcatttttcaatgacataacaagtatagtccaagccagtcctggcctgctaaccattcttagcgacttgatccaaaaccaaatctcacccaaatgcttattatttaatctgaagttcttattcaataatccaaatgagtagaaatcacttctcatcaaacaaatcccctgctgcttgaagaacaaacaaatcttgaaggaggaaaaacaattgaccggccgtcgtcgctgcggcacaaggtgtggccggccaattggaactgcagccctcttccatggcagctcgaagttacctgctcccagtctcccaggccgatggagccagtgatgggtagagagttggaggcagcagcacgggtagcgtagcaggctcgccccgaacacacgtgggggttggggatggctgctgcggcgtcgtctcg

SEQ ID NO: 102657 - DNA, 1800 bp, Oryza sativa
gaggacggccagtgtgtgatggctgcgcagcgggaggtgatgtcggtggaggtggagcccggtgaggtggtggcatgtggggactggccgggggagggcgtcggtgcagtgtgcccacgcaccggcggaggtctagatggtggtggagcattggtgtatctgtggtagattggcaggtggtggacggcgggtgaaaacccagctcgtccttgctcggaccgacaacgatggtgctcgagtgtcattccccctcctgagggcgttgtcgtgccgtctcacccctcaagggtggttgccgggcgaaaggtcattctctgcccttttgagaccttggtggatggcggcggcggtgttccgtcgcttatctccttggagacgttgtctaggcatcccctcgccgaaaccacccgagcaattggtgcaagcacgctctagattctcatcctcttgtggtggcgtcttagtttttagaagttggccacgtcggagggcttaggggaagaggtgttccatcttctctctcaccccctctccctatatccttaagacttggatagagttggactttgcgttggttgtaagggtcaagttttgggcgatcttggctgtgttccgttgttggcctagcggcggttagtcacgcttagcggcggccggtccggtgctagcctgctcctggacttgtatgttgacactatcggtgtgtgggtggtagtatattttttcgtttttcctggttacgatcttccatggttgtaattatgtaattttttcctgctttatcaatagaacttcgcccgtctcgtgcgagtcgttaaaaaaaaaaactttatgccatggttcgatgtgttcaaaacagtcttacttttaaaaacagtcttgcttctacagcacactcttgctttgcctgagagctcttgcttctgctacatgaacaagcatcaactatatatgcaacaagcagctggatgcagcttgttagctctggcctgtgaggcgtgcacacagcaagcaagcggtgaggcgtccaaatgcagcgctcaccttcctggagtggagctgcagcatctaggtgccatcaatgcatggaggaggaagaaagaggtctccaagtaaccagaggaggcagcgaggacaaagccgttgccgttcccaggccatcaaaggctcacctcccacgtcgcacggatctggagcctggcgtctttcactcctccgcggtggcacggagcactgtcgacactgcactgggctgaccacagcatacgatacgaacaatctgacggcacggatggaccgcgcgtccctgttcctctacaccacggatgccgcctcgctcctcacttaaccgcccgtggtggggctgcgtcagaactaggcggcctggatgtggaagccgccaaactcgctgttccccgagccgccgccgcatgcaattggttggccctcccatctcgtccgatgcggcgatggcgccagcaagaggtaaggactgagcaactcctgtcgtcgctcaatctggccgtcaccgatcaacatccctggtgcagaacgaaccaccacgccggcacccctcgtcgttaggaacggctcctcgtgcgccggcgaatctccgagcgcgcgcgcggtagggtggagaagggaggttgcagccggatccgagacgccgccaccatcgtctcctcgctgacgccgatcacttctccccgtaccaacaccagatccgcataaatcggaataaataaataaagaaaatgaaaactaggatttatgatgcactggtaaataggtgatgaaatg

SEQ ID NO: 102658 - DNA, 660 bp, Oryza sativa
tccggatgtatatatgttgtcaataggattgcgaatagatagatttcacccctcctagatatgctgactagctggtgcattttaacttggttctaatgcttcctctttcatacataacatgatatcttccattcaaacatgtttaaccgtccaacaaatgtaaatagttaacagggaatctactacctccgttctcaagtagattacgtcttgagatcttaaattttaatatgctaaaaaatatttggatttgatatgtgaaaatggtattaataaatttataatgaaaaatactttcatatatttatgtttcaattttttgtaaatatatagttgaaaaaggtagcaatggaacatgcgcatcagggactgttgatgtgcaaaatgtctagtaaaaaacgaacatttgcttcaccgaaacaaccaacattgcatatatactgctcctactttgtgacaacagagttgctcctgcactgtctgtcttgaactcgctagggtttggaaaaccagtgttctctggagccttatcctgtttggtctctatttgcttggctggttttctatttatttagatctgcttgtatttgcagtttgacctgaataggcattatatcacctgttttttaagattatatattatatcactttttgccttcc

SEQ ID NO: 102659 - DNA, 675 bp, Oryza sativa
tactgattgtaccctccctggctgtgttggatggtaacatttgcagctaaaatctccacaactttcaggcattgttgtctccgaagatcataagatcgttccaagggggctgtgcaagtgtaccatgatagaaccatggcacgtcagtcctcacgtataccgtgagatatattctatatggtcgcaattatgtaaagtcttggacatagacaccgtcttctaaggactccttcggaacaaaggggaaatggaggacttttcaaggattgaattcttaggggaaataattcttatgtgactgttttgaagaaaagaataactctgaaaagtctctttagaatttctatggaatgggccatttgatgggatttttggagaaatcctaaggctgtgtttagatccaggggtgtaaagttttggcatgtcacatcagatatacggatacatatttgaagtattaaatgtaatctaataacaaaacaaattacagaattcgcctgtaaaccgcgagacgaatttattaaacctaattaatccgtcattagtaaatgtgtattgtagcaccacattgtcaaatcatagcgcaattaggcttaaaagattcgtctcgcaaattagtcgcaaactgtgcaattagttatttttttaagtctataattaattttgggtgcagga

SEQ ID NO: 102660 - DNA, 866 bp, Oryza sativa
taaagtaatcttatattaaaaatcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataattttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctacaagatacaaaaagatgtattaggataaatgcgaagtaacatatatatatatatatatatatattgcatttcacgttaacgttcgtcctcgttcgttcgctcgttctcgttcatgttcgttcgcttgttctcgttcacgttcgttccctcgttctcgcttgtcttcgttcgatcgttctcgttctcgctctcgttcgttcgatcgttctcgttcttgttcacgttctcgcggcaacgtacgttgacgtgttcgttctcgctctcgttcgttcgatcgttctcgttctcgttcacgttctcgcggcaacgtac

SEQ ID NO: 102661 - DNA, 671 bp, Oryza sativa
aattcctgcagcccttatggaacgaagaacctgacaacgatcaccacacctgcgtcttggatgggcttcccatggagggagtgccgtagttagcacccgctagtcgctctgttgttcacgacattgtcgttcataagccgcttttctctgtaagtattgctcagtactttcggatgcgaataccagcgaccttcttgtaaacaagtggttaggtcgagaacgggattttctgtatcaacccactcgatgtatgcgcaagctgtagtgcgggtctgccgaatagagtagtgttacgaagaataaagcgattgcccatacgaaatgaataagcatatgtagataataaaatacctcacgttcatagttagggcacctaaaaaagcgccttcctcgaatatcagtattcctcgaagccattagttggcatcgatcaccgcataggcagagaggacgctggcaccatggtggtagtaggtatacataaggatcgctacgccagtttggatcctcaacaccccggcgtctagccattgatgaatgccggtcagatttgtaatgaagcaagtggggaagagagtactgaatgtgactgagttctgaaagattgtgaggcctcactcgttaaggcgacttatataggcgcaaaaaattgagtgatacccctgacatgt

SEQ ID NO: 102662 - DNA, 1767 bp, Oryza sativa
ggctgccagggctttgatatgccacattgtagattgcatgtgctccacttaggtgcaaaccaaaaaagcctggtttgtagtcctgtttgctcagtctgttggcaattagttgttgccctattcaatttttctgtttcctgttgatatttgtttaaaacaatgatgtgctaactggtaaatgcatactgtacgcgttttcactcatgaggtcaggttgctcttcaatggattatgccagaatactagtgtaaccataacttatccctaatgtccatggcctaatgtacttgaatacattcttcttcaattgggatcatcaactcatggacacatgaatacttttcaggtacaaaggtggaccagaactctcaagaagagtaatttgtagtagtccaacttccagaagttacattgtggatgtctatcccctccgtctgaaattatttgatggaagagacagcttggagagaattatcagaattagtagaaaggtatggtatatttgatttatattgtgacattgtgcttcatatgtaattaaccgtcaataatgcgactgatgctccttgaaacttccctggtttcataatgtttggcatttcttttgggatgtagtccctccatagttatccattgatgatgaaatcaatagtgtagttattacaatgatgattccactatccagccctaatttattgcttcaaagaggttgtgtggttaacatttggttgtatttcacattagcttatcttagccatcatgcctccttgatctgtgcttattgtgtgggacaaatcggagcatttcttatatttgataggttagatgatcagtttaggcattctttataccttgatcacattgttggagagtcacatttgtcaaataaaaaccagtgcttacacatttgcattatatgaaataaagcaatgaggattccctctttgtgatgaagtgtcaaagaaatcgcatctgttcatcacctgcttgttgcgatcttctactttggtatgctgagcccttgaatttcagaatttgatctgatatttttggttgactattaccagaaggaaaaaaatgttacaaatttgatgcgcaatggcaaatactttgaatgctggttttactaactgcttgaactaatagcacttttactaaaaaagtagaaagatgaactttctactatcttctttcttagatactcttttgttgaacagtaaatttgttaactttctattatcttctttcttggatactctagtttcttgtgcaattgacttgacttattttttgacgtttgtatttggtgctttcaggccaaagttagtgagctctatagcttggtttgctcacttttgtccgtcgaacagtctaaggtacaagcatcatcatttattcatctaatatctctatctgtagtgtcagttatggttatgtatatgattctttgctccatctactttaatgcttcagatcgacatctgggatttttaccaaaagacaaagggaaaaaaactgataaatcttaatgagacggttgaggaagctcaactgatgatggaccaggaggtattatgcactatgcaattcccattcacatatctattgttttatctgctgaaacctatgattgtttcctttattctggcagcgagatggtcgctggctttttgttgttattgttgctatgcgcccttttcatctatggtctgctgtctgccttaggatgtcaccttgcacatggataatgactttgtcataaattgt

SEQ ID NO: 102663 - DNA, 571 bp, Oryza sativa
agtcaacagcgtcatatattaaaaaacagaggtagtatgttgtttggtttttagtcaatacaagcaagccagctcctaaatatgtgagaaatactacatagatgttttaggccaaaagagaacaaacatatattcaaagaaaattagcaaaattaacagtggaagaatagatgctagaaaatttcattatgcatacaaaggcatcatattttactaccattgcaattccttcacactaaattgtctttggcaagaactacttaaaataccacataaaaatctttattttaaaaggtatctttaatttctgctcaaccttgttcctctctatgtttccattgatattgatataaatatagtaactaggaataatcctaggaagatcccctttcgaatgcaagatttttttctttgtccattgatatgaaacttgagctgattcttttaaaaatgacgaggaattccacattcaaataggccataaacacctttttagacagtaaaggatcttttccattccaaaatctagctaaagacctgaggggctcctccagttatatattaggtgcct

SEQ ID NO: 102664 - DNA, 2447 bp, Oryza sativa
tagagctactctatatatctatactaatataaaaaggaggagccacctctttcaatcctacaggccaaatcaacttatgaaatccctaccgttcatccgcatctgcgtcgccctgagccctaatccctgccgtccacccacatcgcaggccccattctatctccaccgctattttcgctcgatgtgccatcctcctagcgttaacaccgccgctcgcgataacaccgccgtttctccatcttccccagatgacgcgagcccccttgctcccgctaatagcctagcgctgcttctcgaggcgcggcgcgagccgctcgcagatgcagcgacgaccaacgaggtggccaacaagaagctagcgtcagcgtagggtgccctcgagatcatcgcgcgggcacagaggtggagctagggttacaagcggcagatggcgcacgtcctatcgcttctcctctggaaacgatgttgatgagatgccgctgcgccttggtcaccatcgctctgttgggaggccacctccccaaatcagtaatggctggcacctcccccaagctcccatcgaatccaccagtctcctccaccaccagacccgtttggccttcttctccatcagatccaagtatatatccaacgattccaacctctgaggcaccgtggggccactggatcaggcctactcagtgacgacggtgaggaggaagcttgtggcgccgcggagaggcaatgggggcggtttcaagctcgataggcttgtgagtggtcatgactcatgacatccgcgcgcggcggagctcggtgccatgaagcgcgtgttggaggacacggagtagtaattcagcggcgcaggctgcccttgccggtgcatccatccatccgctctgtctctgtctctctctctttctcttgatactcgatagcatttggtgaactgtctccctaattacagccagttttgcctgattcaactgggattgttttgttttgttgcgtgcagtgatgatcttgcttctccatgagtaaatatcaaagcctcgaaggtgggatctgatttggatgcacttaaggtcagtaatatccagtttccctgcagtatgtactgttgtttgctgttgaaattcgttaatttatcgtgacacactaatgtgtttctgctgatttgtatcattggaattagaaaatgtggatttgcttttgatgcctgaaataatggctttaaaagaagcttttggacactgtgagggtactaagttaataaggaaccttgtttatttgcggggatggggcaccattattttccattcgggtcgataatttatgctgcaagcagctaaacatacatttgcacctgcttgattcccgcgtaaacatgatggatcagttgaactcaaagataaggtacaaaatgtttgttctgcttagttgcctctctgagtcatgaagactttcataagctttattctgcatgttggacatgctacaactgattctacatctcttgcttccattgcttgcagccatgcttgacatttgcaaaacccattgggtggatcagtttaaagctaatatactatatactaacactctatttgaataggatatcaagggatctattaacgtacatctattgttactaccctatgcaaattcatgaggagttgcattgaccgcctcacttttctatgtttctgccaccatcgcaatctcgaggtcacaattgctcttggttcccatccatcacaaccatttgttctgaacttagatgcttgtcccctgagaaatccccttctggcttcacttgttgattgctaaaagtatggtacattgactatcctatttgattcctatgaacatcgatgctcactgtttgatacatttcactgccattcatttgtttaacataaggcatgccatttaagctaggtgcatgtaataacccttggggccacttaatggatctattcccttttacatatgcacacatgagtagttatagaggtaaaaaaagtatgcatagttttatatgatcagtttcaactatcacatgcaacatgagtcatcgaacttagtgtggagagaaaatttgctcctatttgttttgagatatatcattgatttattttccagtagttagcttcccttttcagcaaatgtgatcatttaaagtgattattagctgatttaagtagaaaatccctgattaaaagaaatgaatattggtggcattgtatcttttatatttgcatatttatttacattgttattttaatactttttgcagtagattttccttattaaatgataaactgagtttttttacagctgtaccatccatttttatgtcattgttgttaaattaatttgattattgattgttgagagcctcaccaggtaaaaaggagccataaaaagatgcttgcttcacttaaatttatggatagaaataaatc

SEQ ID NO: 102665 - DNA, 2139 bp, Oryza sativa
gttctacactaaatgttaggagtttacaatgtagcgtagcaagttctacgaaaattaaataaatgacatgatttttaattcctatatggaagtgactcattatattggtaaggccacctcatcattgtttcactactaagattctttgttgcaacccgcatgcttatacgatcaatatgatatgttgtctataaaaaaataacgctagatggggtacacattatgactaaaaacaatatcatttaaagtttttctctaatttattagtgacttcatagatcatatatataatttagatgctatgatcatttaaagattatttatttatctcctaagtcgatcatttattgataaaaagctcaaatatcaaattgtatgggcaaatagcccccatatacatgttgagagaatttaattaagttgatagaaagttgttaggtgtctaaccagatataactaatgggtgtaccagctttattaaaaattaaggtgggatattccgattttcaatgacgaattttaatatcttttttatttagtgtttgcctcaagatggatgtgggtctagaatgtaatttttatgttggcatttaaatatagtcaatatgaatatgaaagtattgatttcactaaaaatataatagttcaaacagatcgtaagttgaatatatgatttgaaaagttataattattttaatttatattgttccaagttatagtaagagaagaaagagaagaacatggacagtgggatacctgtttagaccttacatgtggaaggttcatttatagtttttttctccataaagataattttaattttagttatcataaataaagataaaaaataagagaaaaggaacaacacacaccgcacggggacagaaagggagggagggggtgttttttcataaaaaaatgattgttctaacaacctatgtgttggatgtttacggtcggatgttttgtttttcctctcataattttgtatgatttttttaaacttaaaagagacccctagtggtttagaaatatttataggatgtttaatgtagttttaagtctttaacattgtaggggcagggaggaaggaaatgaggtttgggagttttttaaaataaaaatctaataacaacctaaatgatatgtccacgatttaagtcgataccaatagttggatgttttgtttttaaatttttatgattttctctaatttagaagtgtcactaggtggtttagaaacatttataagatggttaatgtgctttaacgctgcatgggagcgcggagggaggtttgggatgtttttttaaaagattttatttttttagattttatctaatttaagagtactatatactccctccgtcccataaaaactcaaattagaatatgatgtgacatatccaagagcaacgaatctggacatatgtttaaaaatatttatatgatgttgaataaactatttattaggagagaatatataaagagttggctagatctaatatgttaatgggctttttaggcccataaaaagtattttattttaattgttatggggattaaaaaaaagagaggaacgatggttggagggatcatacatacatgcgcaccaaggctgacgtccggactccggacatagatttttttttcctttgattgaagataaatctaacgatcaaaattaatgggcccactaatttaaatgaaaatcaatgatcagatttttactattttattagagtgatacatggcgactctagagcgtttataggatgccacatgacagtctaggaacgtttgtaggaagtttaatggacttttagtatataatagatagaactgcatgagttctaaaaaaagctccgtccttagagattggttatacttatttctttttgatttatgtttttacatgaattccttcaaaacagtgtgatattagttcaatttctctcactggtggattgataattcctaaacaagtgagagtaagacctaacaaaattggttaagcaaaactattgagctgcacaagtaactgaacaaattaaagcacaggaatttgaatttaccatgaaaaaaatccacataaacctcaacaattacaaatgacagaatgaaccgagctcttttcgt

SEQ ID NO: 102666 - DNA, 980 bp, Oryza sativa
ttatcactatttaccaacataagttctgggttggaccaacaacagaagtatatgtagcacacattttttttttgaagcaaaagacggcaggagctctgccggatatattagaaggagaagcagttacagaggtcaagaaagagcagaccactaggtgacattttcagttttcatttttatgtagcacacatttcatatcagttaactccgaatgacttagatattatctccctacaagtcacttttctcagttaaaatattacatttgtacttcacgtttctctgatttcctgactagcactagctccacctctcctagagctagagctcagccaaacagttttagctccacccaaaatgggagtggagctgaatggaactctctcataaaatgaaccaaagaggtggagctgggtttaaacggctccataaccccactccagactcaactcctggagttaaatttaggagttggagctctactaaacgagccctatatcatctaaaatttcaagcgcagtagaggagctgctaattgtacttccttctctttctgaacccaatcaaggattgagccctgaagctggacaggtgcgtgcgcagcccaaaggctgaggaagtcagagattccatctgtgcgatgatgcatcttatgatcctgttgtcgcaacagctttgatttcctagctcctcgaatggtcctccgtgtgctcagaatgttcacggtcgccttcacagcatgaagatatgcaacaccatgtttaggcttccaaagcatctgatacactgtcgctttcgcattctgatgaaaataatctacggccctcggcaacatgatctcttccatttgttgcaaggcaatatttgtatgcaagcaatgctgctcattagcattaatcacctctatcacagaaccctcgactgatgggaataggctttctgaagatccgtgaggcgtataggcaagtagacattcagat

SEQ ID NO: 102667 - DNA, 715 bp, Oryza sativa
ccaaaatggcaaaatgttactcaactcaccaagctggttgaaacttgaaactagtgctttcaatatactgcagcttgacttggagtggtgaagagcgaaacaattgtgtgccgaaggaggagtttcagctccttctcaatgtcagttggagatgtcaattcgtataaatggagtccggatttctattcactatctgaaaaatgtcaatttaacagtgaaaagtctataagtagcaactgtaccagaatctgctctgcacaccgtctgtatttctccaaatactcttcaactgaaccaagttttttaatagatggcaccgttaacttttggatacatattttactattcatcttttttttttaaaaaaaaacgtaattataatctagtttgggcgtgggaaacggaggcgggagcggtgaactctgggagagagccggatttgttgggcgtcgtcgtcgcaggacaaggaggcggcagcgcgagatgaggagggcgtgcgtgggggacaggtgctcatcgggatgcggcggaagcagcaggacagacgacggcctcggctcctctcccgtcgcccgttgcccgcagcctcctccgtcgccgcccgtcacacgcagccgccttcgccctcacccaccgcttgccgcccgccccggccacggctcctcgcccttgcccaccagccacctcctctcttcaccaagagagagagaggggg

SEQ ID NO: 102668 - DNA, 650 bp, Oryza sativa
tagtatccgtccccaatgcccaattccccccaccattgccgactcttttcttcgcttccggccgacggccgcacttcccatctccgcctcccctagttggctactcctcccagcctgcctccgatccaccggatggcgtgctcgtcgctccaggccgccggcggcaactatggtccatggactgtggcagctcgacctcagtcagatccatggcgaggtggccctcaacttcaggcggtcggcattgctccaccttgcagatccaagtgctgtggaccactgcttttttcttccctatggagcacccgttccttgtacaaggggtgctgacatcatgcgaggtcattcctcgttcgtcttctccaccacgctgtgcataagagtctacatgaatggtatccgatgcaaggccactcgttgtcgcctgggcaacgcgtcactgggaaaatgtcaaaaaggccgtggcagatgaaaacgatctggatggagatgtgatgccgattcatcagtttttcaggctttgaatcatgaaactagctgcaattttcctatacgtgaaggactggattggcaaaatgtggaaaattcatggcaggtgaaaacgatatggatggagatatgccgtaaatttctcccatttaagcccttct

SEQ ID NO: 102669 - DNA, 1289 bp, Oryza sativa
atggtggcccgcgcagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttaattatttgtaaattatatatattcctatatggactctagactcgtcttttaatatttcttttttttaattccgaattttctgtaaattgtatttctatatagactcctcttcttccaatattatttatttttatttctgaatttttattatttctaattgtatttctatgtggactctaaactcatatttcaatattctttaatttttaatttcgaatttcagtcacttctaaattgtattcctatattgactttaaactcttcttcccatgtttttcttaatttcgaattttagttatttgtgaattatatttttatacggactctaaactctacttttaattttaattttattatgtttattccaaattttagttagttttaaattcctatatgaactctatactctacttctaatattccttattttttaattccgaatttctattatttcctaattgtatttctttatgctctacttcttatattccttatttttaattccaaatttcagttattttctaattgtatttctatatggactctagtcacctcttctaatattccttattttttaattccgaatttcaactatgtctaaattgtatttctatatggactctagtctcctcttctaatatttcttatttcttaattctgaatttcaactatatctgaattgtatttctatatggactctagtctcctcttctaataatccttattttttaattacgaatttcagctatttctaaattgtatttttatatgaactctgcttattttttctccgattaatgtgagaatttttaggccttgagagcgaacatgttggcttctttttctatggatgatatataatagatagattcatatagacgaaagggttatctattgatgctagatgacagggacagaggaagagggaaacccattaaagcatctccaatagcatcttcattccactctccaaaccaaaatttagctattttgaacaaaaatcgcactccaagagtctctctatcccactctccaagccatccggatgaccaagttcctttcctcactaggggcgcagga

SEQ ID NO: 102670 - DNA, 1798 bp, Oryza sativa
ttcctgcagccccgaaaagagtactactccctccgtctcaaaataaatacagttttacattgtttatatcccatgtttaaccgttcattttatttgaagttattttatgattagtattttattattattagatgatagaatatgaatagcactttatgtgtgatcggctaatttattttaaaatttttcaaataagacggacagtcaaacattggattcggatacccacagctgcattattttgtgacggagatagtagttatcaagttttgagaataatttatccaactatcctctatttttttttcgtttcagtttttctcaagttgaccgtaggccgtactatattgtttagaagatggcacatggtttgatgttttagccttttgaatcatgccaaatctattttttgaagtgcatgaaggccgggatgttttctctatgtatttagtgcgtgggtcgatcattttgctaaagagattattttggtatgagtattcttttagataagcttctctatgaaaaaaatttgcacatactgacacaagtgatatataagcatggctcaaactcaactgatagctagtgtcctagagtactctacggacatctatgtagaaatatgtcatgagctctatttctttctttatgtttgagctataatctgtttataccttttcaattcggtggaaaataagtacatatagtagaacgtgcttgatatgtctattgtcgttttatatcaaactcaatgatacaatgcaagaggcaaaatagcacttgaaacaaaaacaagtttgaaggaagatgttggaacattgtggtctaggattgtagctacttttgtgccccttctgtgtaacacttgatttttttaatctattaattactcaaatatcatatagccataaataaaatggaatatataatcaagctagtgaccacatcaatcttgtagataggctctatatatatgccatacgcaagtgagcaccccactagctagtttgttgcgaataaatgatatctcccctgtacgatgagataagatatcttggcttttattatttctggtcatagtacacattgtacaaagaaaagtacaaccccattttcttgtattgcaagaacttacgagatactcatacttgcataagtcgtatgagttgacataagttaaatcaagttattcgtagtcccaacgtgtgaaaaaattactcagatacatgttttcgtctaatatattaacatacaattgttggtacatgcacaatttaacctaatcccccctcctatgatcaacaataaatatacatacttttttaatcatagggtgaaccaacatcaaatccaactcctggtttggctatgcggctatccaatctcaacattgagcaagctattttggtctatagccgaaaatcaccatgaaaacaactgcataacacaaccactaaaagttgacacactaaaagttgactcgctaatagtggtatccagctctacatttatatgcagactagaaaaatactcatgctttgctatgggtagaatgttcatatatacttaatatatgttattcacttgatttaaacaaatagtatattagattattatataatatcagaaaatatcagtgattaatttataaaaaatgcaaaagtagtggtggtaggctgtggcagaaccaccactattgtcttttacagtaggatagcgtattgagtatttccataggtgtggtgggagttactgtgcatgattccatctactacatttattctaaatatataaccta

SEQ ID NO: 102671 - DNA, 2253 bp, Oryza sativa
ttcctgcagccctttgtttagaaaaaaagaactttttgaggctcatactcctatgatagtagtacctttttatgttaaaatgatgcactcgtggatatatgtgctttcgtataataaaaagagtgcgttatttgtatttttttaaggattattatccatccaccccttgttgtaaaaccttattaaggtaggccgcagtatgtatgcaatttcttctacaatacctaagaaatactctatgatcacctccacaatatagagttatactaataaattagaataataattcacatatacgatcagtcacgagatgttccatttcaagaataatgcaaactataggatttagcttcttttaaatgtaaaactaagttaattactagggcctaggaatcctttcttttaattaatgagtggatcatttccttaaaaaaagattgagtggatcatgatacacacacatcaaggccctgtttggttccatgggctaatatttagccatcaccttttagcctcaaattagccctcaaggatccaaacaggtgggctaattttgagttagctcccctcaaaacattagcccctccaaggggtgctaatggggctaattttgtgtggggaccatcaaaaagcagctctctttctctctctttctactctctctctccaccttttagccttgaattagcctatggatccaaacataccaccctagattaatatttagcctaccaattcatgactaaacattagctctcaaaattagcactgggctaatcttctaaacatggcccaagtctaattaatgtagtggtgatgaaccaaatgataaggaagacttaattggctaattgtggccggctaggcaccgtactacgtatatacgtcaatacgtgtgcgtttgagtgaagatatatgcactttgacaccaaaaaagtcaatgtcacgaactcacgatgcttactctctgctaactgcacgcgttgaacgaggtgttaattaacattttctttttgaaagataaaggttaattgacatggccgccgatctctggaatcctgtagattgggaatatagtaatttgttagtgcatgcgtgcctttaattacaactgttgttggagtagcatacagcatgcgcagtgagcattttagcaccagcaagcaagaagcaggacgttttcatcagcttactaatataatccctatgtcttattttaagtgtaattatagatttatatgtccaatatttaaccgttcgtctcattttaaaaaagaaacatactttgtatttaagcatagagcgaataacccgttttaataattcgggcgaataatctaaaaaagtaaaacctaaatacattgcttaattgactagaagacatgcaagactgcaaccaacaacatgatacattaagggctccatttacaaacgaaaaataatttataaataaaatttttatatatgggctcttaacgacctaaaagtaaaatatgaaaaataaaatttgataaaaagaatcttaaaatcaactctaaatttaaggttaacattttaaattttagctgataaatataagtataagtataagaaaaaaaaaagatgaggtttgaaaagataaaaacctacagagttaaagactgcaggtagagaagcatgcggtgtgtgttgagcgagagattggatgaatggatggatacgtagaagacgacgtacagttgagataagagattcggttggagggcgaggggaagggacgccgtctgcggtggtggggcccaccgaacacgtggccgcggtcgggggtggaagcgtgacgcggcaaacactcacctcatctcctcgcctcgtctccacgaatcgatcggttcgccgcatcgcgccggcctccggatcggatgcaataattccccctgtttttttctttcttttcttttcttttcttttttttcaccttcttcagttcttctctcactctcctctcttccattttcaactactcgtcagccaaaatttaaattttcaacctttaatttggaaccgattttgagatatttttatcgaagtttatttttcagcatttgctttttaatcgctatgaacacgcataaaaaagttttatttacaaatgatttttcgtttgcaaatatgtcgtttcgcttattttttcgtttgcaaatataccgtttcgcttatttacaaattatttttcctttgctgttgtaagttgtataaccttctgggctgcaggaa

SEQ ID NO: 102672 - DNA, 2392 bp, Oryza sativa
catgaaatctctcgtccctttccttctctctatgtatatcgtgtggttgcaatttgtttggatttaaaaaaaaaaccttcttttagttggaatattgacgataggaatttaggagtatctaggtgagacaattttccatcatcctttcatgttagggaaggagatgctcagagttactgcttgggcaggacaagagcatcaggatataggaatcatctatgtacaatttgcaaggtatattcagaggatgaaaacttctctcttggtttttgggaatcgtggcccaattcatgtaaatatcttgtaaattacatatagattttcttagcttaaacatggtctttcctagggaaaaacactttacatatctctgataatatcatatgacacacatcttgttatttttttcttttctatttaaattgtcagtacattctctttttcgctgagttagaaacgaagaaaatcctaccgaatttttttctcaagtccttgaagaactgaaccaatccctataaaaaaccctacacatgattttgaaaatttctactccaaataagtcttgattgcaacattctatttggcctttctcaaccaagccaaaatatttggcaaactaaaaaatcttccatctatttggtttcagagaaaaatagacattggcaacttattgggcttagttaaatacctaagtgtgactttgccagcaaaccaaacaataatctagccaacttctattgaaatttttgtcaaatgacctatttttaccaatgccaaaattttggtatggttacaaatgacatactcccaagacttttcaagaaccaggggacaaagcaggaaattaattgggtgatagagcagtttattgccgccaccgttggtcttggcatccatgaaggtgactactccaacatctatcttgtcatcaaattgacattattcaccaagagatagccaccttattcgtttttaccactagtgaggcactagctgttactactacaattttaacccctgcaagaatggaaaaccccaactgggccgtaattaacaatattttatttactagataagcatacatgtatgccatgattaaggatttgacaactagatcccatctctttgtcacaacctaatctcaactccctccatcacagaataattaagttcatttttagcctctcagatttatcttaaaataaatttattgtttataatcactgcagtcgagtttataaaaatagaggataatacattatgagtagataaaaagataaataattacattagaatttgataaaattatgagattatattttttattgatatgtatggaatgagtgaaaaataaacttattatgagatagggagagagtagtatgcctgccctacctggccactcttatccaaaccttagggtgtggacaaattcaggcacgagagcatgcctgcactgtgggcccttgtggcctaatccataatttgtattatatatgttgtctgcaagggataaaagtattgtatactcaatagtggtgtaccttgaaaagtaatgtaatgagttgaaaccatgggcttaattaagacttgtaaggaatggtaattacatggtatgatcctatctgtaccttaattacttattactactaatttgtaaaagctatctgtcggtgtgctaattaaggaacctagtgacaaatatatttttgcacctaacaagcaggggttaatatgcaaaaatctcatgttctcatatcaatggcaattaattaattaacagttctaaaccaatgcaagaaaggtcagatatgataaagaaggcatgcatgtttgaacagggtccatggttgaaagattcgttcaagaagtaagaatcacacattattctgtcatggctgtcaagaacaagatgctttcagattagaataacactagacctgattatacttttatcccacttcaactgagaggactcattaatttaatctggagccaataaattccagacacaccagagactttgcattgctgatgagatgaaaagaatttaaaccaaactactggaagggcactagaaagcacagaaagaaaccaaacaaatattgaccatctgtgtatatgtgcaccaaaagagagaatccagaggtagcaacatgatgggatcttttggcacctttcaaagtggtggattcaaaggcaagcaaagatgagataggtgagcactttggatgtgtgcactggcttaggaatctcttccatcccaccatctaaaagggaggaagaaggaaggaagacatatgcaaggagaaagctagcttttgctaggtaccatcaaaggacacatgaaagctagggcaaagcactaagctagcaagcatttcattagtgc

SEQ ID NO: 102673 - DNA, 666 bp, Oryza sativa
acatgggcctgttcttcgcaattgaagcaatctttgagaatgttccacaggggaaaaagaatgttctcaaacctgtgttatcacaacaagtaataaatagcaagcaaaatatgtaacagatatttccatataattaataagcactaatgttctcaaacctgtgctatcacagtatgtaaataaatggcaaaaaaaaatatgtcacaaatatttccatataattgacaagtaccgaggaaagacaaaacaagactaatttctatataattttttagtagaactgatcatctttgaccctgctagctgctatcatagcattactacttcttcagtaattggctaccagcatctcaacagtaatcagcaaggaaaagaggctaaaatggcgattgttgtttcatccactttactattatctagtaaatcttaaccattatttttcatttttgaaaggcggtagtttcttgcagctaagcaagtataaataacaagatatcttcttaagtcgctgtacataatactccaagaccattagttataagatgatccttttacatagttgcatgatcctactcccccaaaacatcagtacaaagtattgatcaactcatatatgtagaaaaaggatatgtctaaggacataaatcatacttatagaatgactaa

SEQ ID NO: 102674 - DNA, 660 bp, Oryza sativa
atcctagtatgtttagccccgaactatcttttcctaagttcactatccctaacacactgcaatagtggaaaaattatcttttcctaaattcactatccctaactcattgcaatagtgaaaaacgtggtcataggacagtaacatcacatacaccctcgtcatatcctcaaaacatagcaaacactctctactaccatctactcaaaacacagcaaacactctctactaccatctattggtgtatcctgtatagatgcaaaaacgtcaacagaggttgtatgtcccatacaataggcagaaagcccctcctctctatggccgttggagtaaatagattattaggccatgcctgacagataaggtaaagtaatatcgtcgaagctgaaggagcaaccccaaagtgttggtccaatcattacgaataacacataaaaagaacatttgtaatttatatcactcaatttatttaaagtgttagtagtatgttctcggctactcaaattttagaccgtatacccactgttgggttgggacacagggattccggcctaatcttcgcatcatcggatcctcttcctcttctcgcggacaagataatcctcctcgttctctcctccacctctcctccatgccggatcaactatggggacaacagagtcc

SEQ ID NO: 102675 - DNA, 1551 bp, Oryza sativa
aataatgcaagggtgtacgcatatgtggatcgagtgcccccgaatgaacaaaacggttagcatgttttcaaagaagcaagatatgacactattgctaatggaatggttttttaaactcttgaagatgtttattgtatgttatccaaataattatgaaataatttgataagatatataatatgtgttatatcacttcacaaaaattaatctctataagtttaaaaaataacaaatttaactatagtagttaacgtatatttatagtcaagtttgtcttttaacttgtagaagttgaattctaacttacatatttgtgaagtgatatattaatctatcttgacaaatttttttaaaaaaaattcgtagatggcgtgtgaagaacaaggggacattcccttgagagtttagaattgtttcccttattactggtgtcgatcgacaaaccggtattttgtatatgtgcagaattagttactccctctgttacaaaatataagcgatctccaatattcaaaattagtactacaatataagcatttctatgacactatgacactgattctattataaggaaattcataggttttcaacaagtcaagtgtttgggagaggaatataagcgattcaaaatttaaccattatggtgacagaaagggaatattttcccttaaccttagtgtttgtaaataatctatataaatgcttatattttgtaacggagggaatcctaattacgctgtaacacatcagaacaagaaattcataaagatatgcagtattctactagttgatcatacggttctggtggttgacctaaagtactgaacaagataatgcaaattatttgactatttcttcaatgcgtcgccagtggttggaatagaaaaagagaagaagttgtggctgcaaagggtttaagggagttgagcctttagttagacacttagacagtactgaaaggacaattaattaagaagtgaaatactcctactactcgcttgtccaattaagaaatttgaaatatcccttacaaattaagaatttcatggaacgaaattaggtggccaataaatgagcataggcatattttcggtgtggattatttctgatcgatatataaaattgacatgttacagcttggtacgtcaactagcagaggatatgctagtagcaataattttattttttgagagagaagcggaggatataatttcgttagccaaacagagtaaaacaaaatgccctagtcgactggaagaatggtactccagttcagctatagcagaaacattcccgtgcatgcgtgatcttcggagcatttctgttcttccctttcacaacgatcgacttctgttcggttttaactactcgacttgaagaatgctaacatacgacttatagtttctgatgcagcaaacagtgatcatcacgcgtaagtcaatctctggacgttgcagagccatgtgcaagattcaataatgcatatgcgacaatcattcattgttatgcaatccatatccattcctctttgcaggcctcctagatcactat

SEQ ID NO: 102676 - DNA, 1828 bp, Oryza sativa
tggggagggggggggggtattctgcaacaataagactgaagcatccaaaatacaattcatttttctatatgaacaaactttctgcaccttggtaattaagcatttaagttccaagagaatgactacgtctgaggactgaatcatttcccatgaattgttacaagtgttaatgtttttctaaaagaacaaccaggagttataattgcactcaaatgtcagatatgttggctggtcataagcagggcaaagagagaaactagccactggaatgcaaaaagaactgtagaaaagagacaacaaaggtagaggctgactaaacagtgaaaaggttcttaaaagtgctaatgttgttgtaagacaattacacaataggaatgttttgtgatgcagatagttagaataatggaaataaagtgaatttgaagatgctctgagttgtttttgctttgcaccggcacatgggacattccacaatatggaatcatggacacatatttcacatgactatacatggatgattaaaaaaagagagagaaaacttattctatgccataacatcatgcatgtcctgccaaaaaatatatatcaatattcattggccaggaattaaaatagatattttgcttcttttacaactctgactgattctgacttatattgtttcgtgtaggtaaaaaagctgactaataacgtgcagtttatcttggaaacagttctgcaatctaccgtggttgaagtacaggtgatctttaattctcataatttacctttgaagtaatttcatattttgagtttcaaacagacttatctgccatatacaagtgctgtaatttataaatatgcaagtaatattcatgttctgctatgtgcggactgcggaatgtactgctggtttagagcatgtactataaggatttaggtgttgcctccaaaagtgccacataggattaggtgatgaggtgtagagagaggatgagccacccttcatgcaagggacaacctccgcacaatctccaagagaaaaagagagaatgagatagtgtgggagtgaaccaacacaaaaaaaaatgatgtttgtgtattagaggtaatatgttgtacatgttgcctcttaattaatggatagatgacatggctaaaattagaggtagtagccaactctactataagatttgttcttagtgagcagttttttttaagtatttaaacttgatttagtgagcagcttaccattacaaatcttctcttcactagatatttcagaaagggtaaacatgacattcaaatgggctgtaaatggcgtggcatgctgtataaaaggaacattctagggaaatatttttggtttctgatcttcaaactgacattatttagtttcagtttgtaagggatgctgtactttactgatgatctttagagcagcattatttagttccaatactttacattcaaaagcttgttcacctttattacaaccaattgggtagctctttatgctatatctgcatgacatattagtttgcgtgtctacctaggtaactcggcctatatctgcatagcgtcttagcttgtatgcgcacctttggcgtaacgttagtagtaggaatattggagtactcagactgttgtgcatgcccaacttaagtccagttgcatccttgtagaatcttagtccaatcttgtgtgtacattggatctggatccacatgttgaaatgtgcgcacgacgaacattgccatggcgcaaaggaatgcaccattgatttttaaatagtatattttttagcaccctagatgatctcacatgccaggaagcaggccttctctat

SEQ ID NO: 102677 - DNA, 717 bp, Oryza sativa
cattaaaatagcatacgcattcttccaataaatcatgaagagaacattgggatagggaatgatgaatgcaactgattatcatggcattttcacagttgacggttgacacacagtcgaacatttttatgacctgagttaaataacataatagccatgatgttgcgagagaaaatgatgcaaatatgttataaaacagtgcaaaaattaaagacactaattcatgatatcatctctcactttgttcacagttgcaagaactatcacatagtgagcctgacacatttatgattaaaaattgtgtccgcaatggaaccccaatatggtacagtgctcactacaaaaatgataaaaacaaggtctacttttcaatttggctaaggctatgagatacagtttctttgggaacggaagaactgtgaggagtgagatctaatcagatgttaccaatttagcatcaatattaactaccaaatgtatcactcaaaaactaaagaccgcatggacattaaacgatcttacaacacaccttgttagttgcccaaaaccctaactacgatcacaggtatcttggagttctcacaacattctgggttagttttgataatgaagcactaaaatcatctctccccaaaacataccaaatcatcacttagtttcaagtgaaatactatacttcagatgtttacctacaacaaaattccgttttgtaacctgcta

SEQ ID NO: 102678 - DNA, 654 bp, Oryza sativa
agtggcaatgtgctatacgccatactagctagagtagcactcgatcagacggttaatttgaacattgaagtggatagcaaatgaactgaaagcaaacacaggattacaacaaagctgctggttttaagctgaattgagtagcgaggtcactttaacccgccttccgcagcttccctgaaacaacactcgaaaatgcacagccccacaaagtttgacaaggtagaaagaaagaagatagctctctctgtaaaacgataaaaatgatccacagatgaaaggagctccctttgcaaaaggctgcggctggttttgctctctggaagaacattatacaagaaccaatctaatcatgcgttctttggctctagaccagcaaagcacaaagctttctctcatcatttcgtccatataggcatatagccgatcactcattcactctccacgctttcacttcactcgcccactcccactctcactctctcaatccatccaaccagaaaaaccaccacgcgcgtgcgcccgccgcgcacgacgcacgcacgcacgcgcgcgcgcgcgagacgcgagacgagagagagacgatgcctccgcttcgccgccgtctcctcctcctctgcctctacgtggccgcggcgtcccgcctcgcgccgtgct

SEQ ID NO: 102679 - DNA, 613 bp, Oryza sativa
atttggcccgtgattccaggacagcgaaaaaggagggatttttaacgaccaaagcatcggatcagatcatcctcctgcctaattatgtcctgcactgatcccacgataaacttaaacatcaaggaaaacgcataaagcaggctcaattatcctccattgacattagaaataagaaatggtctgcattttgatcactgataaaaaaaaattctctgaagaattcagtgttcttggacaattgtcatgagttggcagcatttactaaattggccgcccgccgacacacacacacgagcagatgagggttggatccacggcgaaatgctcctcctgcttttgaagagcatatccagtgatctttcagactttggtcatggcctcatcatggagacaaaaacatacctgaaccataaccattttcagttttcagatgtactactagtagtataaattcagaggaagagatggatcggcttcgatctactgcaagtgcagctaactagtgtacttgagattagtttcagtcgatcatattgctcgttgatctgatgctcgtacgtatgttcaggcttgagaagtggtgggttcagataagcttaatctctgcatgggc

SEQ ID NO: 102680 - DNA, 525 bp, Oryza sativa
attctaaaaataaattttgtcataaataaaaattatttttgtgttgccttcgctgtggcaaaactaaaatattatttttgttaaataatatctcgcaaaacaaacttgaagttttacactccatttatatacttcgtaacgttatattttcttgatatctaagggcaaaatggactttatcttaggaatttaacggtccactaacggtcaactaacggaaggggtatagaagggatccaaactgaaatttgggggtatggaagggaatgagcaaatctcaggggtatagaagggattgagtaaactttcaagggtacacaggggattttctcttttcattccaccatgccaaaatgtctcactcaagacaatcaaatctatttataccctcagtgttgcagctacttgctgcaactcctacaaagaaataaactcagaattgtagctacagtatcttctttcagcttaccataggaggcatatgttccagttccacattaacacttgacaattgctgtagggaag

SEQ ID NO: 102681 - DNA, 1346 bp, Oryza sativa
ataaaactatcattcttaataattgttgttcttttttcaccttgaggtttgaacccttttctcatgtcattcaggagttaaaaagggtgaaaaggcatgcaatctttgttttgttaggggtttttgtggatgtaattttcatgataagttaataagatagtacatgtcatcttatcacactctttagcattaccacctttttaaaaaaaccaatgcagggtttacttatgagatgatcatatgatgtcctttcccaacttcatcgtgaaagtttattgtcaagatcattgctcgaaccatcttagtagacggagagtagggacaaacatgtaaaactcacaacatttaatattttaaaccgtaaagagtggactcatctatcaccaactatgtcatcatatttttgtttgtcataaatataataaaactaaataaatgtactgccagctataatcttaataagaattgattgtcgttccgtcactagcctagtgataagtgtattgctattcttaacacaattgattcttcctaaacgcgttaatgctatttttgtctatattagattgactacttcatctaagttatttgttcacaatcgggtcccggtacattggaccaatacaatttagaatggagagtggagccctctttcttaggggctccgcatttctatactcgtgcgatgtttataattttttgttccttctacgtatcataaatttgaccgacattcccttaaaaaaagaagaaaagaccgacgtcttctttgggtccaccaaatcaaaaactttatcgtgtagttatatgttctcagctaatttaagattggcactcttgattatctatttatctttcagctcaacttttactgcgagtctatgtctgacttaaaagttgtttttatcacagagaaaaaacacctatttttcattccaccatgtcaaatttgaaagggccttgatgtcgcctagagaggggtggtgaataggcacgcctaaaatttacttcaaatcgcagcggttaaaatcagggcccggaacttcctggcaaaaggtccggaacttcctggcagctttttctcacaagcagagaaagctgcccggaacttccggggttcttcctaggaacttccgggcagttgtgaattgctatttcaagcacctcacaaaattaaatcacaaggaagcctaaaccatagagaggtacaacatgtctcaaacaagagtaatacacatgaaaatacacaagatagtacaagtgatcatacaatgggagacatgatagcacaactaggcaaataaggagataagcatcacaatcacaaagataaagagagtgagagg

SEQ ID NO: 102682 - DNA, 726 bp, Oryza sativa
ccgatgataaatgtagtgccagtcttgacattgttgattcatgataaacgcgttaatgctatttatgtctgcattaggttgactacttcatctaagttattcgttcacaatcaggtccaggtacatcgggttgttactaggtagtaaggagagtagaggccatctttcttaggggctccatagtttcattgcacacttatgtctgtgtgacgtttatattttttttcttctatcgtaataaaattcggacaatgtttgttttgccagtccagcaaatcaaaatacttcatcctagttttttttatcctcaattttagttgggcattccatattacctttagctcaacttttaccacaacttgaaaactgactttagttgttttatcgaaaagaaaagaacacccatttttcattgaggaaattccctgtgtacctctaaaagtttgcccaatcccttttatacccttgaaatttgttcattccctttcatacctctaaatttcaatttgaatcccttctatacccctttcgctagttgactcttaaattcctaccataaagtccattttaccctttgatatgaagaaaatataaatttatgaagtatattgatcgagtacataaatataaatatattgtatgcgactattatatctatgagtttattttgtgagattgtatttaacaaaaataatttttatcttgcataacaaaaaaattatcata

SEQ ID NO: 102683 - DNA, 668 bp, Oryza sativa
gggagagaggcgagcgggggaggaatctgtgggtgttttgacttgttcccactttgcccctcgctatgaaaaggagtacgagtaaagaatgtttttttttgtggtttttggaatttggattgtatagtaaattgtttttttttctcccaccttgtgtttgagccatttttatcatgtcacttagtaaccttttgtgttcgagacattttcctcatgtcattcaatcacttatctttttgtgtgagttataaaaagggtgaaaaggcatgataatctttgtttggttaggggtttgtgcatgtaatttcctggtaagttaataagatactagtagtacataatcatattagcacactctttagcattatttctttttaaaattattcacagggttcacttgtcagatgattctatgatgtccttcctcgactttgtcgtaaaaagtttatcgtcaaagatcattgctcgagccacctagctagtagacagagagtaggggtaaacatgtaaacctcacaacatttacacatgatttaatatcataacaagcggactcgtctgccagcaactatgttgtcacgttcttgtatgctttataaatacagtaaaaccacataaatgtactgccaactatagttttaatagaattggtcgttggggctgcagga

SEQ ID NO: 102684 - DNA, 608 bp, Oryza sativa
atctcccattttccacgtacatatttatcaaactattaaacggtacaaattttataaaactttttatacaaaagttattttaaaaaaatcatattaatcatttttaagttattttagctaatgcttaattaattatacattataaaccatcatgttttccgtgcaaggagatggagttccaaactctacctctcaaacacatcctaaggatagtgatgatgcgagcgatgcctacatctctaacatgtgggtctaatgtattgacatcaatggagggagggtccgcgtgccagtcagccagtgtatgtattaatagcatgacggcagtgtctagttattagaatattaaggagctaatgacctctcaattatcatggttagttggtaattttatatggcttacagtttaagcgagcattttaatacgcatcctgcaacggattgagcgagacaggggagtagggggattaagcccccccatgatctaatcaaacgatattcatgggggtgatacatataatagggtggaagataagatggaataagaaatgtcttgcgggggagcatttaggtgggtaagttaagttgacgatcaagacccgataact

SEQ ID NO: 102685 - DNA, 732 bp, Oryza sativa
attcctgcagcccgctagatatgcactgaaggtacctttatataaaaatgaactaaaggtgtgggattctactttctgaaattgcgttaggaatttatgataaaatagttgatgatctcttttatatcacccttgttataacaatgttgcctatctgacttgattaaccaaagtagaaaaaaacatgcattacttgctgggatggtcttcttctacatgctttagaacagacataatatgttgcgagatgctagaaggtcaataaaaagggggttagtgaactctgtttagactcaagacattccattttgtgtaatgaatgttaacaaagttttttttttggaaaatagacacgaacccttatttgcaaacatatgatcatacattcatacagcaagtctgaacgggtgcagaatgtgtttattctctgatacattatattttttttcatgcatgcaggtgataaatgacagcattggttttgttagcccacttttactcaacaagtttataaaatttcttcaacaaggtatcatccttttagaaggttgcagggctgattattaatgtttttggaggcaataactgctatattcaattttggcactaaaaattggcagtatgtatggttagttgaagttttcctttagttcacttcatatggtctgtgtcaggcaaaccaaacatcattttcaacctttaggactctgctggtagttctcgtagaagcag

SEQ ID NO: 102686 - DNA, 737 bp, Oryza sativa
aattggatctagtagtgggctatattaaacttgctctaaggcaacaagctagttgcatgctgtaatgattcaatctttccttccacgcttttctatactgctagctgaatatgaccatgctttactataaataaaacaaaatactgttgaaaatgtgagctaaaactcatttaaattaaaactaatttctataaaaatcacatagccctaccttataaaaaagatgcatgtgaacttttaatactgtcttattagttctaggagagaccttattataaagaatgagtattatactagccacctactccatccgtccccaaaaaaaaagacaaaccttgggtttgcgtgtccaactttgactatccgtcttatatgaaatttttttataattcgtatttttattattgttagatgataaaacatgattaatattttatgcgtgacttgtctttttaatttctttcataattttttcaaataagacggacggtcaaacgttgagcacggaaaccagggtttgtttttttttgggacggagggagtaagtaatgcgcgatgagaagaaccagaggagcacacactcacatgcctcactaggcatgggtagcgcccgcatgcacgcaacatgtgtgtgattgatcaccaaataaccacccatatatatacttgttgtgaatatacggttttcttttgcagtttttttttatgtggtgcgtcatgctgctccacatccccaa

SEQ ID NO: 102687 - DNA, 774 bp, Oryza sativa
attcatacaatagttgcttattatactactaatatatgatcccacctgtcatacatacattgcgtcttggagtccgtgctgcagctggctacatatatgtagcccgctgctcttctctcttatcttttatctcattaaaatatgtttacagctggctaatagccttctgttgtacatgctcttatgcgttaatactctaccaaaaccacacgtattaatgtatcagtgctttagatttaatgcagggtaagctaccaggggtgatttgcagttttttgcacacggtatcaaggcgataacatcgttcttcctgcgataccacgtgaaactatccccattcaaagatgagtgcgtcatgtggaatttgcgtcgacgtgttgtcttgtctgacattttcaaccgcatagaaaattcgcggcgcactgttagcacgtcccgtttctggccaagtctgcagaattattattcatctcgatgaactactcctaaatccaagcaattaaatatctttagaaaacaacaacctaaaaattgaaaaccgctcaattcggaactcaaaaatcaaaattctgagacacccgtgcaaactttctcgctgatgatgcgtagtacttcggctggagccaccgacttgtgggccccactcccgcgccgctgtagtataaccaccacaaggcgcaggggccgccttcgcctcgcgttcccgtcttctcgtgctcggacggcgactccgccaccgcgccaaccacaccaatcttcccgcggaatcaaaat

SEQ ID NO: 102688 - DNA, 1033 bp, Oryza sativa
aattcctgcagccctaatggaactccctttctcaaataggctttccatattggtaaaatgactctgggtcgcaaactctgtagcgtagcaaggttgtctggtaactttctgttgtattaactcaagtgatctattgtgcttgcaggtagatcattaactctgtatattatgctgcctctcataatgcagagacacctaaagcttttgcatattccccaaaaacttcagttaaatgactaatgaattgtactttactttagagtaagggcataggagactacaaatttctcgacttttcctacaagaatcttattctatgtttacacactaaaattaatcatttccatttttatcagtaacaccataacattatcatgcattagaagcgcatgaggttctctaaccgattatgcacttctacaaaaaaacaacttcaacaggcctataggttatccagcggtcagcatcagcagtgaatttagatttgcagtatataacttacaaatgacacctgttgccctgttggaacacaggttctccaaaaaaattggaatacaaaacacagcatacacacaagaggaaagtcacacctacttgatgatctgagatgctgttgttgaagctactcttgtctggtgctgcaaaaggaagaacagcaattcattatccaacaaagcgcagcgcctaaggttcaaaccatggggcagaatgtaatgtagaatagacagtgttaaaccccccaaaattgcatgacctataaacaattctgaaatagcccatgaccagccaattgaaatctctcctaccatccaccatctctgttgactaacaaacaaattttccggtgagccagtgcagatctaggaggaaggcactaggagggcaaggactcgtaccctcgggggtgtcgctatcggagaactccttgtcgagcacgcggccgaacatctcggcgatgctgccgtccccggtggcgttgcccgagccgttggtgaccagtttcccgtaaaacttctcccgcatctccttgtcg

SEQ ID NO: 102689 - DNA, 2171 bp, Oryza sativa
atggaattatgatctagaaggcacttaggaagaacattatcttaccttgtttcacatgcatatacacattggtccggctacccgaagaaaccaatcacagattaactgagaactagaaagaacttttaaaaaaaaaacaaatcatattagcagctttatgccaattaccaagaggaaaatgcttcagatgcaacaattatgtgccatatccatattgcaagtgatctcagcttcgataatttctcatttccttaatatataacaacttccttcaatatgcattgttaagattaaatgtagtatgcatgtattctaaacttgtaatatgtaaatatgttcagatagtcattaaacacaatttgagcttacttagatttttgggggagcacatatggaaattattaacattatgcatccatttcaggtggaatatatattacggcaaaagaaagacctgtcagcatacttgcgtccatgcaagaccttgcagcttggtccagatttcttcattcctcatgatgctgatgatgagacaacgcactcaacccttgttgatgttgacgagcccatgggatcatcagactcagagaatttgagtgcaccatgcccaaattttgtccgaaagaagcggagtggaccatatatctgtgcacgatctgcaaaccgagtttctgatgatgatatggcaacaaacatgagcagaagaaaaggtgttcctcatagatcacctttgtgctgataaaagatcaataattaaatagtttttttcccttttttttgctttttttgagttctttatctcttggacaaagctggtgcactattgacagaattttgtctccatggaaccctgtgatttcaatgtacatcaccagaggcaattgtactcaaattcttcatgtagatgcaccagttcatatatatgtacgccttaaaatagttcatattatcccctttcttcttagtatggtattactgttattttagaggaagcaaaatgcactggacttattttgggttggtcattagttagttaagtttaacacctagatatgataatgggaccattatgttaaattaccttttatggcagagggtaccatttttattattgaaatgtgcacaagcatggccaataatcaattcacaaatttggatatcagcaaagaaattcaataattctatccagagagtgtcaatctggaccaaatagtatttggagactgaaaatttttctgtcacttgtaacaaatagtagtagtaaagaagtaatatcatgccaaaatgcattttaatataatcaaggacctggaatactgcgaacatttctagaggaattttgataattccagttttttcttgtaattaccttaaaagttattcatgtaacaataaaagcatatgttgctaaatattcagctatgtttaagcaactacaaaaccagcgaaaactcagagccccatggatataaaaaatgtttcaagctcttgtctgaatggtaaagatccaaattagaaatgtgagatgggtactaaaaatggcagcctacaaatgctacagatacattcttattgtaacaaatgttaagctctagctagctatgttagtttccataggagataggtgtgtttaacttaacagaggtgcaattctaaagatcaactgacagaataacagctttctcctaccaaacacaaggttgcaaaattctcggtctaccttgcattgtattgcccttttcatgcctacaacaaatcttaagagaatatacaaacttcttgaaactgtaaagcctccatgaaatcaatcatatcagagaaagacaacactatgcttcttgtttgattacgttttgcttcacagggaagggtaggaacacaaagttaaaataagcttgaaatcattggaagttgagcaattctagttttaactagtgaagccctcagcaatgcctactcagatcatctcgagatcagaacgtaagaataatatttttctccatgcacctcgtgatatgattcggcgcatatagctggaaagctcgggaagtgcactcgtgcgcgtcatcgactaaatattatatccatattaagataatctaatgtctacttaaacagtgaaatctttgtcatcctcctatgatgatgattataaaaaaggatcggtctag

SEQ ID NO: 102690 - DNA, 606 bp, Oryza sativa
tactgcgggttggcgaggaagctcaactgacctgggccagcctcctgcaaggtggccagcccggtaatctgcagcgcctcggggcccttgagagtggcgccgagggcctcggccaactggcctagcgtcatggtcacggtcatatcaacgggcttggttcatgcgctcgatgacctggcgggtgatgtcgtactgaggcttgacatcgatgaccgcgccacgctcgaggaccaggtcgtaaccacctttcttgatcacttcctcgacagcgccatccaacttcggcttcagctgcttgagcatgtcgcggtcagcaacggccttggcttcgttcagttccttggactggaactggaagtcacgggccttctgcttgaactcgagttccaggcgctcgcgctcctgctgctgcatcttgtcgccgcccttgatcagacggtcctggatgcccttggcgctgctttccaggcttttcagcttggtcagttgcgggccgaacttcttctcggcatccaccgcgtatttcttggcggcgtccgactccagcagggccatctgatagttcaggacggcaaccttcatttcggcgaaagccggggtggcgac

SEQ ID NO: 102691 - DNA, 932 bp, Oryza sativa
aaatttgaatcggatatttgaattcaaattcaaatttgaatcagatataattcaaatttaaatttgaatcggatatataaactttaggtttataaactttaggtgtataaactttagatgtatagaaatactatatataaaaaatatttgaattcaaattcaaatttgaatcgggtatataaacttttgacttataaacttttggtctctaaactttagatgtgtaaacttgaggtatataaactttaggtgcatgaatttactaaaataggaaagtaatacggtgccaaaaaaggaaaccaggtggagggagggaggggggaatcgatcgctctgggcaacgctcagtagcatttccggatgccacatcagtgaataccactatcaatactgttttaggagttaaattatattggttttaatagttgaggggtcaagatagttggtattgcagtttagcggtatggatcagattggatctatattaagggagtaagagtgcacttatttccttgttatagttgggctggtcttggtcgcggatttatttgggcctagccttttgcccctgtcgagagatgccattgggatcagataggccttcagccgacgctcaatctgtggccatttcagcaacggcgacaaaatcacatcatagaggcagaaacggctttattcagattggagaaaacttgcacatacgataataattttcagaataaactttgttaagcatgagcaagaagcagatactcaactaaaaaaaataacttgacggatgaaaatcagtgaatgtaatttcatttcctttacgctgtccttcagttttacatgattcatttgaagcaggaagctctggaagaagatagatcttggcctatacatggaacatcaatacaaaattgcagtcattacaaactaattttacagca

SEQ ID NO: 102692 - DNA, 1319 bp, Oryza sativa
agatggttgagtcttgtttcaattattccctaatcttctgtcaagaattaaactcctggtatttatgtactactactggctttgttcgatgctggttcaattttgggtattttgtgtactgctacagtcctactagctttgttctttgctgattcagggaaacagggaagcaagttctgttaatgaataatttatggccatatcttactcgtttgctttatattctgcatgagttaattaattatttggcttaatttatttgtaatgtatgtactttctcatccatatacacttgctttgcttgttgaagttaggtatcttgattcttgttatgcttgctatactacgatgaggtagctggacctggccaaactaggttctactctgaaacatcaagttcaaaagcatatgctgtcgccaccaccccttcaaaataataatttcatatttcagcaggagtgagaaacagcctattgctagagaagatgaagattacaattttgttggagatgaagttgactattctgctaacaaataaatcagccttgtctctgaaggtatggatgagtctccacataaccattagaagcaatcctgttttgctgaacctgtctacaagcccgtcccaccatctgaccctgctcaagattggccacaaccggtaatcccactaatgttcagtaacttcggttccacaatgctacatgtaaaaattgaattttgcatgttggaagtttgagacaaaccaaattaaatttgaactatgcacgttgaatgattgatacaaactaaatatttttttgcccatggtcatgatcttatactgaaattgccattaactattagtttgtgctatcttgacctgtatctcataaaagttaacgtctcttctgatgtcactggaaacgatactgttcaagtccgaatggtaactgctggatatcaagaagagttgtcaggctatcagtttggtgagcaacagatggcctatccggaacagtacatgcaacaaagcagacccatctatatcccaggaaccaaagcttgataactcaagcagataaagagttctttggttctgtttcaaacatgataattgaaggcttgagcggctaagggaagaggatgcactggatggagaaagatcctaattttatttcagggagcgatgatgaggatgattagtcgaagatggacatgggtactgtattctgtgaatctgtccttaccttttgcctgtttcccttgctgtgcggatttcttgagctcatatttgatataccgttttcatcttttgccctatatttccatacctcatt

SEQ ID NO: 102693 - DNA, 2963 bp, Oryza sativa
gggacggggcctaccgcgcgtcaacgacgatgacgacgacgactaccgagcgacgatgacgacgatgactaccgccggccgcgtcgttgccccttccctcgacccctcccctcccagatccggcggaggggaagggcgtcggcggtggcgcgggcagagggcgttggctacgacgacgaagactactgcaggacgacaacagccctaccgcgcgacaacgacgactagcgccggccgcgtcgctggctcgctgcccaacactcccctcccagatccggccgaaggggggagggaggcggcggcggccaccacatgcaatagaggagttcgccggcgacgatgacattgtgtttttttaagtttacatgttcattgatgttaacttgctgtggatttgaatccaatgcttttgtgttgcaagtttataatgtctgtgattggattttgtttcctggatgagatttgtgagaatttatgatttgtgatttgaaaccctagggaggggtggggttggcgggaaatttttttggcgctgaggatattttcgcaggcggggctacagtagccccgcatgcgaaaatagcacctgcagctcttgggaagattcgaactactgcctgttttggtccgcctgtaaaaattagggatttttacagtcgtttggatacaggcggaaggttttgccacctgcgaaaatgtgttttgaccgcctggaaaaacgtttttttagtagtgtactacattagtttgctaaatctattttctctgggcttccacagttttagcagcgtatatgatagtcaatagaaatttgtaacaggtaataaaccattccaaaaagtatttctaaaaactgaaccttttggccatgctaattgagagtggctggcgtggcaggctggcatggcaggacaacgctgccacgccagctgcttgtggcatggtagaattatttggccacggcctgacgtggtcaaaaggttcagatttggaaatacgttttggaacgatctagtaataaaattaaaaaaaataaaaaagtctaaataataataataataataataataataataataataataataataataataataatctctgagctaacctgtgacagaaagcaaaattgcaaaatcacaataggttgttgctgcaaaatgcaaaatcctgttttgtgaggctcctggctgtcacaataggttgttgaggctgtattcctgcttataaaaaaatcagccaacaatgacgagcatgtaaattagttttggttgcagcaaaaaagcttattgcacagctatatatagattacaatcaagattgttcaattttgctatatatttgtcgacaaattttctcctgaaaatttgacagatgtaattacaatacagtcgtagtgtaattacattgtaatttcaatgtaattacaccacaactacaatgtaacttgtatgcaacttttaaatatctctccataacatgtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggatgacttcgccaggaccggttcgccccggcatccagcccagagaaggacggcttcgccaggtccagttcgcccccgcgagggccgaagtagccttctcggcccaccaagcttagaggccatagggccggcgatcgcctgatggcccatcaagggcccatgagcctccctttacgttatgtaaccctgtaaacgtccctttcataagggcaactatgtaaattcctcagtacaccctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacaatgttattttggtaaaatagaggtcatgggaacaaatcctctcacgtgtgtgttgtgacttttttcttcctaacctacaaaaaacttgaaatagatctaacggtttaaaattatgtgaaagttacatacaaattacattgcagttacagtgtaattacatgcaagttatagtgtaattacgctacgattgtactgtaattacatctgtcaaatttttagaagaaaatttatcgacaaataggtgatcccagattgtttacatgaactttcaacactaaaacagggctcgggagttactttgctctggttgctggaccaattagcttaaatgaacatcaccttataagagctatgattatagtcctaatgattgaggataactttcttaacactgaccaaaaccatatgagagctaatgacccatgtatggtcaaatcactactacaaagatggtttttgcatacgggggagaagggttttcgcatgcggttggcacaaccgcatgcaccaaatcgtcagcgaagatcgtgatctttgcatgcggctggcgcaaccgcatgcaaaaatccgattttcgcatgcgggagcttaagacgatcacatgcaaagagaaaaaatcacgaaaaaaaaataaaattccaaaaataaaaaaaaaagcaaaaaagaaaccctagcgccgccgcccgagctcgccagccgccccggttccgccgtcgccctcccgcccgcgctcccgattccgctgccgcccgcccgcgctcccgctccagccgtcgccgcccgctcgagctccggctaccgctggccgctcccgcctccggatccaggcaggacgaggcccgccaccgccggatctggcccagctcctcgtggtcgtcgttggcgacggtgaggcggggatgctggtggcgccgctgcccgcgtcgacgcccactcgtcgtcgtcg

SEQ ID NO: 102694 - DNA, 929 bp, Oryza sativa
agctgcaggaagcgcaggtgagcgaggcgagggagagcgactgcgctgtgtgctttgagggcttcgaccaaggagagaagctgacgaggatgccctgctcgcattgcttccatgcgacctgcatcttggattggctctcgctcagccatctctgcccgctctgccgattcccgatgccaacggggcagtagtagccatcagctacactattgtctgaaagtgtcttctagagtgattggcaacggaggaactgttctgccaacgctcaagaaatcttttgttgattggcaacggagaacaatatttaccattacgaatcccacacctgaaaaattgaaaagaaaaacagataactgaaatggttaaaagtagtcgatcattttccccagcccaatatccatgatgaaaatcaaatggtcctgatcatctagttgtcaccaaaatcaagtaaaaactattcaaataaatttatttcattttgtgcttcacttgaaaaagtaatcgacaaatctgagcccatgccaaaaaaaaatatagcctttgtgacaccaaacagagaagaaaaaacgtactccttaatgctaccccatgatccatttctacacaaaatggaatgctcattaacatcctaataactatatgaaactccgcgctttgctattagtatgaatcagtaaaaatatcatagctagacatcttaagcccatagaatttgtatttttattgatcattggaaaaaggttataaaccattatgttgatgtggtttatgataatttaaatagcatatagattgataatccaaaagtaaaagtaagacgatatggcttcatgagagaagaaaatgaagaaaattatttaggctatagattaatcatctaaaggttagaaacaaggcaaaatttgctataggacacttaaaaatgcgta

SEQ ID NO: 102695 - DNA, 1505 bp, Oryza sativa
tcagcaattattggtattacaacttgcagatgcacacagaatatctattgagaaaaacaaatatcttggaggttggttgtgcagcagtcttatatccttttcatccttttggggacaaggagtcactttggcttgtatgctataaacttttttttcttgctttatttgtttgtactttatagacatgttctcatacatgtgcatgagtggttgaaattatgacatagttgcttctgacttctgtggaaatgagaaattgaatctttctttggaactgtgttatgtccacatactgcagcaattccagattttttatttggaatatgaactatgaagagtgaacactcgcttgattgttaacttccttttaatttgaaatatcaggggctagtgtgtacttggtatttggaccgagtcagtcagttatgcagagctgaatattaatggtggatactgtagttggacattttttctaagagcatatgatatattcttgtgaaaatgaagactcagatgcttgaactaccatgttgattgacatttaattttcaccttttgtgttttaaaggtgatatgcaaatacacatctggtcattggattggactatgctctacttcacaaagtactaagtgaaatagaaaagtaggcctgacacagagggtgggaaagatacacagccaaggtactccccaccatactattgttttagtctcagtgttccataccatttgatcataccttttcttgatagtttagaatccgtagtattgtggacaacctgtcagattcatggttcatttcaaatgctgtaatatattggtaagagtgattactgctgtcatatttcttcagtataggaaattacggagttgattccattgtttatttatgacacaacaagttgtcaacctcttttagggccagtcctctttctttaattggaggtgattaagagagatccatttttctcttgttggactgccaagccaaattattctgttattcatgattcttccaacctgtttcttgagagcattatgcacaactaagtagttggatttgtatggtgatgcttctttaatgccttctttatttttattccgagtgataaaaatgagacatatgttttacagtggctgctggatcattcttagtgaaacattatttcatgtacactattgtgaggatcatcattaccaccttgtagaataatacaataattggttgcatgcatctcttgatttgagctataccaatatgaaattatcgcctcatgtccttcacccttgtctggacgcagacacctttgtaagttagttattaagtagatggtctatatatttagcctgtgcacttgtgttgttgagggcaacaaaagaagatcaggcatctcattcagcacggcaactgtaaaggtatatttccttttagttttaattgatgtttgcttcttatgtgatggaccatataatataatatggacactaaatccattcttggttca

SEQ ID NO: 102696 - DNA, 547 bp, Oryza sativa
agctccaatgatccccatactctatgttggcagtatctcatgagacccttcgaccagatctgccgaaaccgtgcgaccagtcaggattcaggctcaaggtgttaagttcatcggggcaaagccccatggtgaaggcggtgaagccacatggcgaagacaatggagcgaggacggcaaaagatggagccccatggcgaagactgtacatcctgggcgaagggtgcccgccgaaggagggtgacttcgccatcctggccgctttggccggcctttgggccggcattcgccaaccaggcccattagaggcccatgtatgccaatgacactgtatacccatgtaaatgtccctttcacaagggcaaccatgtaaattcccctgtaaaacctaaaccctaataggggggcctgtaacaaggatataaatagacccctagggccatgtaaaggggatcccaagaaaaattctcaatctaatacactttactgttttccaaccatcgttgagtaaccacatccttcgacgtatacagttgttatttcgacaaca

SEQ ID NO: 102697 - DNA, 649 bp, Oryza sativa
ttgaaccttctatgcacacaagtttacgatgtatgcttcatgcacacaaactaacaaatgttatagaaaattctagaaaaaatgtacttgtactttcaatagtattacatatatctgtaaagtatcaacttcaaattcattattctttagccataaccaaaaaaatacgatagttcataaagcatatatatttaataattttgtgtttttttggttacgactaaaatataatgaatttgatgcaactttgcatatatgtgtaatactattggaagtacgagcacaattgtttctataatatttagtggtatttgttaattggtgtgcatgtatgtacaccataagcttgtgtgcatatatacattccctatttaataaggggcatctaggtcattttctttcctggtaatttgtcttttgaatcctagtagtagtattgcacttatttagaatagagggagtacatctcaatatttattaattttgaaattttaaattagagtaaagtgtacgggcggtccttaaacttgtagtggtgtgtcatataggtctctaaactctcaaaatgtatatccaagtctcagaacttgtcatggtgtgtcatctaggtgccaaatcgccacaaccccttcaggatcctacgtggcgt

SEQ ID NO: 102698 - DNA, 1079 bp, Oryza sativa
ccccgcgcgccgccgaacgggtcgttcgtaatcgcagcaatggcgcgccagccaatccgtccggactttttatttattttttgttgttgttgtgacaaaatcctcaaatgcggctaccgagcaccggcacaaacggtgagaaaagaggcgacttcacttcaaaagagtagcctgagtaggctgcactggagaggtgaaacaattttttctttttagaaagtatatataacctccagccactgcagcaactaagaatacacgtggtcataattatgatattactacatccgtccccaaaatagagttttaggcttaacgtgagtattaacaaagtgggtaaagttaaatggtaaaaatattgtgatcggttgaaaatagagagttggtggagaatatgaatggtggaatattatgattggttgagaaaaaaatgtaggtggagaaattattatattttcggacggatggagtaacgtttaaaatctgataggttgtgccatgcattttccattctaccactacaccaataatgcttccgcatgaaaccgaatatagagggaggaaacaaacaatcttttgttttttaagtggggagaaagtgattctgttagtcaattggattgctttattatcactagggccagttgttctcatatgttgttttcgtaaattctaagacgtcactgtaattttcaagacccattagctctagctctacaggtgtttgtttttttctcttagcaaatgagggtgcaaggtttgtttgcagttcagctgttccattcaggaaacccaccaactctcagagataagcactctctgatctcccctttgttgctttttaaatgtgattctgttaatgattattggtacgaaaaaaagggtagtacatcgcaagattgatgtcccactgcttttttttttgtcacgttcgcaatcgaagacttgaagttgtacagtctgccgctttacgacttcgaaaaatatgtaaagttgttttcatgttcaaagtaaaataaacatctgggtctggtcagtgctgcatcggcctcagtatttacataaattgggctgcagga

SEQ ID NO: 102699 - DNA, 1188 bp, Oryza sativa
taaataatggatgcattcaaaatgaattcagaattcttcagaattcgacaccagagaggcaatgcatggtcgtatgggatccgcgttggttggtgaggtgcttcactgcctaaaaaataaatttataaggaaaacaaaatggagagaagtttgatcatcgatgaggacttggagtgagttcaatggctgtttggtacgactccactatatatgcacacatatcagtactgttccctgactttgttcttcagttaattgcgtatgggagaaacctctcaacagcaacaactactgcacaccaacttgtactagaattgcgccttgttagcaatatgatagtacactgaattttttttttgtcgaaatcacaatgatttaatgattttaagttgtttggtaagagttcatgactagtgattgattaggtttacggccatagagtcaacgcatcagaatacatgggcgatgacaaacagctacagttgttctattccaaatactgcgtacaaatttcatgcgaaatatctttcaataagtaatgatgtggagtatttcttaaaaaatagtagaatatacattttatacaagggcatatgtatatatagtgtatacatgttcttttttttttgcatcttctttaaaaaaaaagaatttatttgatatgtacttgcaactaccccaatgttacatcttgctaatcttgtcaatttatttgatatatagctgcaactactctaatattgtaatactgcatttactagtcttatagatttatttgatatatgcttgcaactgatatataatactatattttgcttagggtttagggcgactattgcaagaaaattgtcgaggaagacttcaatatatgtatattaagaccagaaaagaacaaaaaaggggggagaaaacccaaaaatatttcaaatcaaaacaatgtcagaagaccatttacactaaaattttgattcttttctataaaatactaatgaatgttctgtgactaatgctaagcaataacaataaaacaaacaaaaaatcctcaaaagaaaactctcctccccgttgttcttgcgcaagggaggccaaccatgcaaatgggggcattccattccacgacatgccacgtcacgtcgccgtggacccatcggtgcacgaccgcgacagcgcgggctcgccgccggcgcc

SEQ ID NO: 102700 - DNA, 661 bp, Oryza sativa
tgatctacacgcggtagacgcgtagaattaacagggatgtagagaagaactccgtgttcttgatttcgatagatgaactttcgtgcaattatgagatacagaccggcctaatccgtgtacattcttgtactagtttttgtgcatttttcgtgcaagccacaggggttgaggtgtcaattgcattcttgtactagttttttctgtctctgaaaaagtttgcagttgaggaaacgaaaccctgcatctttccatctttcttctaatctgtgttaccttacaaacatttcactaaccttgcagtgttcttttatgaatttgtgttggtgataagataattaagctggtgcaggagactgttcagacaatattgtcttgatgttaggttagctcagctgaatgcttcttgttacgtgaggacataaagattttgagaacacaagtgtgcaacaatctgaacaccgaattgctgcgtgttgcgccttttccagagacctttcctgaattacaattttcctcgtgacagtgttgtggccttttcaatgcgaatgatgcagatcagtctgcgcttttggcctgagaatcagtttttagttttacctggtcatttttttggggggaaaggttcttcagagcctttctttacaaagattcctagagcaaa

SEQ ID NO: 102701 - DNA, 761 bp, Oryza sativa
attatatttctatatggactctagtctcctcttctaatattccttatttttttaattccgaatttcagttatttctaaattgaatttttatatagactctgttttttctttctctgattaatgtaagaatttccaagccatgagagcgaacgtggaggctcctttttctattcctttaataatataatagataaatggagaacagtatatactctcctgcaagattagtgatagaaccaatcgagatttgtatctgatatggtttcttccatatctttattagattcatagaataacgcactgaatttgagtacttttaagctaagttcttttcaggttatttatcggatcgttgaaatggattatttgatccagcttcgaaaaatacatttccttaaaagaactttcttctactatattatccaaaacacttattttaagttatttgctaagtttatttatataaaaattaattcattcatataatcaagtagataattcttaactacaatccgcttaattcgttaacccttcttggaattaatactgttctgaacactctgattgcatagtactagtcaagtttaattagcatatcccagcggacggtggtgaaccgagcgaaccttctaaaatgaaatgtaataaagtagtttggtgtacttaatccataaacaacattggacagttcaacacttgcagtgtaagtttttatcccatttcggcggctgcaaaaaaaaagaaaaaacaaatggctactg

SEQ ID NO: 102702 - DNA, 1188 bp, Oryza sativa
tgcgtgggaggtgtgatcgtaaatcatgtagatactctcatgttatggcccatccaatgccacccccaatgagggatattcccatgcaataccctgatatggtaagttgttgtaccgaacatagtcttacagaattacgctgttgcttgttgaaaataatttcttatggagtatttgtacttgccttatttaatactccctctgtcccaaattatagggcgtcctctttttaaggaaaatcaaactcggtaacttttgtctaataatcatactaaccatatatatgctaaatattatgcatgttatattgctagattcatattttaaagtactttcatatgatgctaatttcatatttgttgggaacataacatggaataagttaatggtcaaagtatgtcattgaagatcgtgtaaaaaaagtaggcattataattttggacggagggagtatattttttggaagcaagacagttagtgttcctttaactcacatagacttgccattatttgttcagaattcagatgcaataagaaatgaattgttaaatagataattgcttgtcttttgatcgtaaagagtgttctactgttttgttttctgttttcataatttgattatagtaatatagtcttaaaattttattcactgccttcaaggtttacatgccaccaccagcaccccttggagtacctatgatgatgcctcccccttcagcccctgcagccttttctggtaaatagtgcatgatagaccatttactactgatgttcagttttaatgaatttagcaaaaaggtacattagttttccctattactgttcagccttttctggtaaatgaagttttgagtgtctaccctattctgttgctattttggcaagcttttgatcgttgctcttctgcaggtaataactacggagtggaagtttgcagggactacttgaagaacatgtgtaatagagaatcctgcagatttgcacacccggatttgaataatgaggtttttataattttcttcttctggcatgaaccatttgttttacaggctactaattagcaagttctttccaacattttctaataggtgatgaatacccaagttgaagttgccgtgattttaagcgaggagaatgcaatcgacctgcctgtcgcttttaccatccacctgcaagctcaaattctat

SEQ ID NO: 102703 - DNA, 697 bp, Oryza sativa
atcctagtacgttgtcgtgactaattaccatcatcggtactctacaattttactgggtgcttacattcgatccgaagctactttgtttttaagatataaatggagcgtataaaggatgtccgtccttttattccaataagaacaaacacaaagcacatatggcaaatactaaatccactacaacaaaatcatagaccatacaaagcaggtaaagatgtagcaatccacattgattcttcatccactactacaacaagcgcatatgaaaggcggcatatgcatgatcattgtgaatatgacatgcccttgtcgagcaaacgtgtcacttcatgcaaatatgttgtttcaagcgacatcaatatatggttacaaaattttaaacattggtatattaatgactttcatatatgcatattaatttcaattgaaagacatcttgttgtccatccttcctaaaaagaggtagtgtccaaggcattatttagttgagctctcgctcactttgcatcacagaagtataacctagacatagctaattcattataaaatcaaaaactgcagcagaacaatgagggtaaaaactagaaagaaggatttattatgttccttagtttattcagccacgaaagagtgacttaaaaaaatgtacacttcatccaaagtgaaaattatgagatgtcttacttatggaattctc

SEQ ID NO: 102704 - DNA, 955 bp, Oryza sativa
tccgttgcagaggctgcgctcgccatgagatccagtaaaatcgctcttcgtcttcacgtcgacttgcagagcagccatagattgaatttctaaccgactccgggacaaaatcaacccagatcggagaggtagggtgaaactccaaggcgtcgcgttagaggagagaaaccctaattttaggcgtgagttagtgagatacaatgtcaatcaaattttaatggatagtcgatgcgacagtgatcttgatcgtttgattagaaaccaacggctagagaaaaaagatgacgtggaatcaccaggatgcagagaattcctagtagtggggatgatttgtataggtatataggataatagctcacaaaacataacaaatatagctagataatggttgcaatccttaccaaactaacgtataaagtgagcgatgagtcatatcattatctttctagcctgctaaccatcatgtacaccatccgatcccaaaaatgacaacttctaggggatgaacctggacaaggtttagggtttagggatgaatctggacaaatgattgtccaggttcatccctagaagtgggtttctccttactggatggagggagtatatgtgatggacacaaaagttactttcgtgatgaaatcaaaggggatttgttggggcacctaatagaacatgtgtccgaatgacatgactcacttggatcctaataggacatgaaagcaaaactaacactccaaagcaaccgatgaggaattgaaagaaaatcagtgccattgcatctataaatagacaagcgcaatgaaaaccctccccatcgttcacacagttcaagcattatacaacaaaaaaagaaagatctagtgtcccgtagcaatgaagatcattttcgtctttgctcttcttgctattgctgcaaacagcgcctctgcgcagtttgatgttttaggtcaaagtt

SEQ ID NO: 102705 - DNA, 1272 bp, Oryza sativa
actcagtcttgctgaatttttcccaaacccagaagaggagcccctggaagatgaaggctttggtgtctagctcatgcctgccgtcaagcgcctgtggtcgtcgccctagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttatt

SEQ ID NO: 102706 - DNA, 846 bp, Oryza sativa
tagtatatgtactacttagtgtgagtagagcactacatgggcttggcattaacactctagatattatgtagtgaatcaagcaacaaataatgtataccttatgaattctgatgttattcagagattctttgagagattgctccatcactcttttattatggccaatatattctcaaccttctctggaccgctccaataattgaagaataacatgcaacattgttatacatgtccattaattccctttaattttctccctattatctatgagaatctaccatgatttttggcatcaatgtgatctgtctgaataaggggcccttttaagatcatatgccaccaagccactattgagttcatcaatgaatataaatatttacataattattgcagttttatccaattagagtagataatttgtgccacaacttaactgagctatatacctaagacacctttggacatctacccttaacattgcaaagccccaaggtgacttgacaattccttccaaacaattgactgaataaacatctgaatatcagagacatgaagcaggaaataagagatttaacaagttgttatatcgttattgaattgttgataagtaccttgacaatctgacccctgcaaatatacaatagattcaaaagaattgcagagtgagaatctttctttgcaatagacatttgtgttattgtatatttttattccatgttatagcataagctggcagaaatttactctgagccaaagaagtccggaatatttgacatcatgatctagcttcttgaatgtcttattaaggcctttggaagagcaaaaagaaattgatctgatctatct

SEQ ID NO: 102707 - DNA, 900 bp, Oryza sativa
cctccctcactttgtatcacagaagcataacctagacgtaactaattcaatatagaagcaaaaagtgtagcagcaacagcgagggtggaaactagaaagaaggatttatgatgttctgtttattcagtcacgaaagagtgactttaaaaaaatgtacacatcttccacactatgagatgtcttacttatggaatgctcctacacgttgaggttgttcttgctgacaccctcgtttctatgagaagtttattctaacatagcaagtcgatagtttactgcaaacaaaatggataataaacttgatgtttcaacaaaactagaggaactcacgcatgatgtacccaaagaaaaccggttcttgacacactacaaatatgtggtagttcttttccatctcgaaaacgaatagggctgtgtttggaatcaactgttcccaacatgcaaagtgcgcacagaaaacggagcggttcattagagcttgattagttaagtattagctttttttacaaaaaatggattaatatgatttttttaagcaacttttgtatagaaactttttgcaaaaaaacacaccgtttagcagtttgaaaagcgtgcacgcggaatacgatggagatgggttgggaaccctggattccgaacacagcccaagtctatccaaaatgtttagacaagaaaacacgtaacaagttggtttacaagaatacgaattgcgtcaatcctgcactacaagtagagcaacatgttgatttctcgtaaatctctcgaatggtgatttaagaattcagtgcaaacctaattcttgctagaaaattgaatgttcggtaccgcatcaacggaacaataaaaagcacttggcgtaccataattttgtcattcttgttgaaattttataatata

SEQ ID NO: 102708 - DNA, 2030 bp, Oryza sativa
acatgcatagagcattaaatatagataacaataaaaactaattgcatagtttgcatggaaattgcgagacgaatcttttgatcctaattagtccataattagcaataagtgctacaataacccatatatactaatgacgaattaattaggtttaaaagattcgtctcgcggtttcaaggtgagttatgaaattagttttttcatttgtatccgaaaatctcttccgacatccggtcaaacgtttgatgtgatatccaaaatttttcttttcacgtactaaacggggccttaatggaattttagaaacaatggcatatgccttgaagttacaaaactcattaatatcacaatacatcctgtatatatatatgattaatgattaataggtatccaagttccactagtactctacgtacccaaaaagccaaataatgcatgcatgtgaatatgtgatgtgatgagcatctgcatgttttcaagagcatggcacgccggaatggatctaatagaatactgcagaaagaccatatatatactccaactattacaaacatattactatgtacaagacgacaacataagttttaagtttccatgctgcaacaagcccatgtgttcaacttgaaattttgaccaatggatttgcgagatgccaaaatgatgaattggattcttcttcgaagctacatttgagagtttttttttcctcttttgatgacatacgtacacctgagagttgacgccttccccggagagaagcataattaatcgcattattgctgaaatatacggatttaaaatgccaatgatacaggaatatgcacaacgcatatgttacgcaataattccgggtatcttgtaatataaatataattatctatcaccactataaggcaagaccgctgcacacgtgccatcatatcatttgacatattttgctgaatggggtaggtcattgcagaggcgtgatttttatatctaaattttataaaactaaacttgactgatgtggttgtcggttcactaaaagaaagagagcaacaagattcccgccccagtttctagaaactaattgatcattttattccgtcacactcttgtgttggagaaaaatcgagcgacttttttttaattattttgacgaaatgttccatattccataagccagagcttagataatgtatgctacctgatcacttcaacattaaggacatatgactaagtattagaaagtatggtgttggcgctgttattttcagctatactttattgggttattatcataaattaattaaccaacgtctctaaaaatgtttctaaaactctttcttcactgtattacgtagatccattattataagcatatttgttaactttggactccaccggttggcttaataagccaaagccaaagttaaaatttaaattttcaaatttaattttgaagttacttttaagatatttttaatgtaatctttttggatattggcttttaagttattaagaacgcattaatttttattttctaataaaccgtttttgacttattagggaattaatgtcaacaaccgataagactatttattaaaatatttaatttatatctataatcttataaataatatattatgataattcaggtactaatcttttaatttcatttatatacaattgatacccacggcagcacattaacttctacaaaactgatcacacatcaggtcacatcacctgtaaatataacccgttagattgatgcctccaactgatatgtgcaacgggattaacttcccagtccgctgcttatgtcaacgtagtggactccagccagtcggcaccgacgcaatttattattccctcgatttcaaaatataaaggtacaactactcttaacctaaaaaatataaaataattattatcatcttaatgcaagcatctaattctataattagagattttgagggatgatgatttaaaaaactgtaatttagtgaagaaaatatgctagttaattaatggcatgcatgtct

SEQ ID NO: 102709 - DNA, 2306 bp, Oryza sativa
tagacgattggccaagtaggcaccatggttccagcacacttcaaataatttgttgtttcactttcacatcacaatcacattctttttcaagtgtcaagatgacatagataatattttttagatttcaccataaccaattatgaatataaacgtgaaccagatttgttagatctatgagtaattttaccaataaatgatcgaacttctgaacaactttttcacccaaatcttaataaacaacgtagtgcggtgtttaagtgttgggctaggtgtaaagtaagcgtcgggctacggacttcaggggcaaaagaaaagttgcaggttgacagatcaccaccgacttaattcttaaaccgaaaaaaaaaatccattgaaaagaacatccccgattaaactaatctcatgttttggaggaaaggctttaactactctcatgtttatacagccgccttgatagaactagcgcaaaatcgcgacgaaaacatttacacggtgtatcaaagttcggcaatcaaaccaaagcgcggacgcgcgcacgtacggcggcccaacgcaccatatccagcgcaaggacacggttgcgcacgcgtataactagatcgatcaacgggggtgaggtgtatatcaggggcgcgcggagcatgagggggagaggcggaaacgtacccggcggtgaggacgaggagcctcttctgccaccgcggcgtgcggcgcgcggcctcgacggcgcggcgcaccaagctcaatccccccgacgccgacattgcgatccggccacggcccctactacgggtggtgtgggacggagcagggaggaggaggaggaggagacgaggcgaggcgcggaggcggcggcggaggaggagcggtttgctcgcttgcgaacacgcggcggcggacgagggcgacgtgcctcctggcctcccggagaaaagcctaattataaacaaaaccacaggagaggagagagagaattttgtctgcgtgggccgtggagcttttccactttaacccctcataggttgaccgatttgcttttaaaccccggagatttgactctggaatgttgggtagggatacgattaacaattaaatgttttacagggggagatcagcaagacagacaaatgacagtttcgtactgcgtaataactgcgtttcatttccttccttgttcagtcgcggcgaacgcgttcacaccttggacacgatcgagcggtgcaccttgtccgaggctgtccacgtggacggcgcgatgttcgcgagacgggtcttttggcttgtgagacaagaaagaaagcgagatctttttttggtcgtacctgaaggttggggttgaggagatgggaggggagtggggccagctttgctgcggcggcggcccagctgtaccagcactactgtggctgcgttcttttcagggtagtcctcctcgttttccgttagcacgcttttcaaactactaaacggtgcatttttctgtaaaaagtttctatacgaaagttacttaaaaaaatcatattagtccatttttttaaaaaagaatagcagatacttaattaatcatgtgctaatggatcgctccgttttccgtaatcactgttgagaagaagaaagaacgcagcctgtgtaacaatggcgctatagggtttttttatgttgttttggaaacgtgtgatgcttttcttttcaagcacgattacccagttttttttttttgagaattgattacccagttttttatggcaacgtttcattggagattataataatgggtaccttaaataaatcagaattgctatatttcttgtgacaaaaattcttgtgaaagaatctgtcagataatgtacccttatatttgctcttatacgctatctttctttcgacatattttcttggaaaaatccgtcagattttgctcttacatttgtgcaagtggcatgctatatttatttcgatataaattctaggaaaaacatttttgttagattttctatcaaaatgttgtatagctctctgtaaataaatttgttgaaagacgtgcgactttcggtatataaaagtgcaacttcagtactagtaatatgcccgtgctaaacgctacggtgcaattctatatgtctttaattattttttaaaatttcatgttaccaaaataatatttttatatgatttgtgcatttaaactttaattaaattcatatcgtgtataaaatatattttatataaagtgcaatattatgatattacgtgggcacaataaaactttgcaagacttaattatatataagcaattaagtatacaa

SEQ ID NO: 102710 - DNA, 647 bp, Oryza sativa
aacgagagtgtcagcaagaacaacctccgcgtgtaggagcattccataagtaagacatgtcataattttaactttggaagaattgtacatctatatctatactaatataaaaaggatgagttgagcctagcaatgcttcaggccaaatcatcgtccctaatccctaccatccatccgcatctgcatcgcatcatcaccctaatccctaccgtccacccacatcgcatcacaaatccgcactaatccactgcaatttcaccctcccacagcgacctcatcctctctccaccgaattttttggcctgcgctcccgccaccgcgagatgactctgcgtctccgccctcagcgccacggtgttatcgggccatcgcgcttgcgcgccatcctaaacactccccgcaaacgtcgccctccacccacccctctagattaagcccacccttcctccaagctcccaatccaccctttctccaagcctcccagggccagccgtgatcccctccaccgtgccactaccgacggtaccccccccccactccctgacgcagccagtcctcctcgccgggtgcacccatctccgtcgttgtccactcttccggcggcatcaccacccagttgcgccacccggtcgtcatcccttctacca

SEQ ID NO: 102711 - DNA, 563 bp, Oryza sativa
ttttgatttgccaatgaataccaactaatgaacttatcagagccataacagaacatgtaaataaaaatttcttccagctataatgaatagcacacctctgctgctagtcttcttcactttcaaaacagaaagaaccacaagagaagtattcactaaaattgcttgagacgcttacaagattttgctacatggcccaaaaacagaaatctggcaatacaaatgttatttcacttttgtgatcaaacaatatcatgaacagtatctgctgtgcacaattccaatatgatcccgggttacaataagaaatatgaaggacaaaccatcaccatgaatctatctgggacaaacatgtctagcatcatggattaatagctatagcacattctcttaagcaaaagggtgagaatacaatctgcttaaatgcccactcctctgtcccacaaaaccccaatatatctgaagatgtaccaggacaacgtgcgtgtctaaatacatcttcaggattggactttttattggacgaatatattattatttattatttatgacgttaaataaacaag

SEQ ID NO: 102712 - DNA, 682 bp, Oryza sativa
aaaatcactcttatgcacaggaattcaatgggatgcaccgaatgtgctaaaggcagacttccagcggaagcattcattcgttcacgttcctttcagaaactggcattcgagttttgagtttctcgagtcgctcccctaaacctaatccccgaattctcccgcagcccaacatttcattcaaccacgaaatcacgccgcgcgtacccaccagtcacctcgctgtagcaagaattcatccataagaggcgtacctgatctcacaaccctagatctcctggaccccggagaacccgaggcggcgaaaccctagcccacccaccgccggcaagacccccgacctccgcaaccgcggagagagagagagagcgagcgaggagtcggaggcgagcacgaaccctcaaggccgcgaatccccacacccgcccgtcgccggagttcaccggaaggcttcgcggcgcccgcggcggaggccggcgagcagcgaatcgtcggaggcggaagagacggatttttattttttatttttttttgggaaatttttgaactctggtttgttcacttgccgcctcccctccgaaatggtacgcccgtatttatacccgtacagtatgacagacgtgttgggctacgactctaaatgggccaccatttggtggcccatgtagtttgggcctccattcct

SEQ ID NO: 102713 - DNA, 710 bp, Oryza sativa
caattgtactagttaagtattacgtcagatgtatgtacataagagccatgaaaatgtttagtgaagcactgaaggtgctgaaatcaaaaccacattgccttttgagaattcattcagtacaataggcaggccatagcgttcccttttctttcctttttcctttttttcccctagctctgttgttattccagtatgtgtatgcggctcaaatccttgcctgatgcttctcttctacgcacagactgagattgagcacagagcaggggaggtgccggggtcattgcagcatacaagtgcacagccagcatgtcaatttccttctgcaaatattcaaagcaattcgttctcttttgggaatgtaacggatgcacttaactcccatacagcgcaaactggccaaacacaaactgccggcgtgttaaatgctccgcccaacccattgcggcaaaatttacactcaaatcatcatccgattcattgttcagcgtatggcactatcaactccctaccagatggaattggagctcaaagcaacatcctccccaacatcagaatttcatgcactgcaactcgtatgaaccctccatggatgagtcatgatgcttgttgaggatgtgagccatatgaaaacccgcagcttgtttgcttagttcccccggagccttcaagatctgatatcaccttaattgctcgagaaggggctgcaggaa

SEQ ID NO: 102714 - DNA, 2467 bp, Oryza sativa
ccgcaagcgcacggatataccattgtagcatttcacccgagagtatttcatgggtatcgtatttattttatcccatgggaagatcatgtagagtgaacttgactaataatttatatattacttgtgataatcatagtctaagcaggggttaagataacccaagggtagagtgacacacaagcattaactactcattctcattatatattatctaagttaagtggacagaaaagagaaagaaaatctattcctatacttctaatatacatagtatacatacattctagttaaccgatatactagctaataccctctatccgatgccctccaggtacttcgagaagccacccctgactgccgagttccttacgacagcccgtcatgaccatacaaccggggctaaatacggaggaataccctccccagggaattaacttaggattatatactggcgcggaggaatacccgtactgagctgtcaccatcagcggcccacctttcctctgcaatatataaccccgaataatgatatcccgtaatctagacaccacgtctaaactaccagatactactctaatatcatcgtcatgacatagagtaatttcatatgcaaatattatacccacaccaaagcatctgccagataagctagccgtatattcagtataacatgaacataatgtaaagtaggtactcatatacttggaaagtattttaataccataaatgtatttagaagagtattctaataaaagtacaaagcttacaaaagagaagagaaaagctactagagccatacccgaactcttccgaaagcttccggactcctgatttctactctattcctattccaccagctagatactactaaactaaacttgagagaaatgagagagctattgcttgaggtgtgtgtgtgaagtgagaaggtgaagtccttttataggcaggtatgaccattgtaaccactgcgaaatgtctgaagtaccccgcaaccgccatcaggagaagatctggagcgtcctgccaaaccccacatccaacggtggagaaggaggttcggctgaaccaggggccaacccaacctggcccaaaatcagcaggtggcctcctccgttgcttcactttgtagacttgtgaattttggcccaattcatgcataagtctaattctcgatattgtccgattgatttatcgtctgtgttgatgtcgattctcctccactttagtgtcattctcagcaaaaggttagtatacctaatactagtggaatatgattattctaatagatatatgcattgcaagcatcactagttctcctctattttagtaatattgacggtcgaaactaatcgataacgaccgtcaacaaagagcaaggagaagggggcacggtgctacaagtgtcatgagttttgacatataaggaggaattgctcgttattgaagaagaggaaaactacgattgcaagtttagcagctcatggtgatgattcagagagcaccagtcatgagattctcacagtgtctaacgagaagtctggagaagcgtcaatgttggactcagctagttcctatcatgtggcattgaagcgggagtggttatcttcatacaaatctagtgattttggtgttgtttacttgggcgatgacatgagttatcgtgttgttggaatgggcgatgtcaagttcaagatgtatgatggaaacgaggtgctactttcggatgtgagacacgtgccgggactaaggaagagtatgatttcgcttgagagcctacatgagacaggttggttgtatcaggtggattttgataggaggaccatgaatatcatgaaggaaggcaagattgttatgactggtgagagggcaagctcatgtttgtacaagttacaagggagtgctgttgcaggtggagtcatggaagatgggtatgctggtgttgttgtgcacaatcctgaaggcggcgagcctggtggaggctcgttgggcggctcggcgtgagcggcggaagaaccaactcaattcctggtacacggagattcgagcaagtaacagattcaggttggtgtggcatattcgccaaggtggagtttgttagagtttgtgtcgaatatatgtacatagtaggttacagtttaggacttgagttgtaatagcgagagggagcggctaccggcggcgaccggccgtgagtcattgtaactctaatacgatgtatatgctagatcggggaggagcgcccataatcagtgtctcggagatgtagacctcggctgaactccgttatcaaatatcgtgcctcggtgttgtcatcgtgtttggttctccaatggcgtttcttccccgtttggttaccgatgtgatttctaggcctgttttctaaaattatcttcccgacggtgtttatcccgttattgatgtgcactagggttctcaatcttccgaaaggttctgataaacaacg

SEQ ID NO: 102715 - DNA, 1197 bp, Oryza sativa
tcccacgaagcaagtcgccgccgcctcccacggatcccgccgcctcccgcggagcaactccaggccgacgaagcaagtcgccgacgccgcctactctcacggatcggatcggatcggatgggaaggggatatttgctcgccgccgatttggtagaagaccctatttccctcccctggacacttctacgcgaaaagacaaaattacccttccaccactccaaatattccggtaccacctcatgggcaaatttgtacctggaggtaccacagattttccaccatccgattgagctgattggatggctcagatttcataccggacagtatcgatggtacctgctggatgggagcttctcacatgagtacctccgctccgatgtttgttctgcatcagaggtggttgttgtggagcttctcacatgagtatcgattttttttggctgtctgacatattttataggcattttatatggtaatatgggtgatgaaatgggaaacatttttttgtgagaataaaggaccaagaagatgtacgaagtgataaaaaaccgctgggcgttggatctggaacaatgctctgaattaccatgcttgaattctcaaacatgttgctatgttgatgggacaacctgagtttttgatctctgctgtgtgataagttctgttctatgcagtgttcgcctaaacagccgcctagcccgtctagacggtgattaatcgctagtcggcgacaattgtccagtttataccctaggcagtgaattagtcgttttaccgcctagacggtcctagtcggtcctaggcggcctggacagcttggacaggacggtgcctgggcgcaattggacaatgggacagtgtgtctaggcggcgactaggtgatagaaatcaaaatttgggcacaattaaatttagaaacgccgcgcgggaccagctcggtatagaaggggatttaggttaccttatttgagagcctagagagagagcgcaacccctacctactcccctttttcacgccgccacgagcgacggctccgccaccgtgcccatcgatcttccaccgtgccgctgcgttcttcccgatctcctcctctgctgctccacgttcttccccctcctcctctgctactactgctctccctctcatccttcatccttaccgtcaatggaaggtggcaaacacaccaattgaagcag

SEQ ID NO: 102716 - DNA, 1862 bp, Oryza sativa
ctgctggctggcccaagttcccgggggtggaatttgtattgagatatttcaatgaatatatggagtgtggctgaatttgttttcctaaaacactgttgcagtacccagaaacctgttcaatcaacttattctggtgagattgtctcaaggtagcatctagtgaaagaactgctatacctatcacactagaatagaggttcgagagtttttgtgttaagaaataagaggctccagttacctgcgaaatttttttattttttagactttttattttttttaattttatagataggcctttcgaaaaaatatgtccgaatctgaaccttttggccactccagcccgcctggcttggccaaataactttggcatgccacgcgcagctggcatggcagtgctgtcctgtcatgctagcctcttgccacgccaccgtggctggcgtggcaaaacaatgctactagcctatcatggttacggataaggtatatctcctatcctacgatttatggaatatatggatacgacataccttcgtttgtacgatatatttccgtatacgatgaggaaattaacaagagattatggaaattatcctcacgagcaagtgaacaacagagtcctactcaaaaagggttaggttatactatatcgtgtggggtccatagtcaccgagttttacttggagactaaggtgattcatgttataaaagacacaccccttaaggggtccagatcatcgaatcatagcaccaacaccaccaccatagcctacaatccggaggacgtgaagcctactcgctagaagatctcgtcgaaaccatctcgacaaggatctcgctggtaatctcggaatcgttggttctctattgtaatccgtggttctttcatatcaatctcatatagattggattatggctattaccttacgaggggtctgaatcagtataatccttgtctccgggtttgcttgatgtcgtattgtgtagatcctcgtaccaacataccctataccctattcttccagtgtgctagtatcccccgtcgacacggagacaagaaatatactggttcagttttcggaaatatatattgtttatactagcttgttcaaacctcttgataggtaaatagccctaatccaatttatatgtatcgttcgatgatgtttcacaccgattataaaattagaagcaagctaactaatctaagcctaagtagtcttcaatgaggactaatccgatgacttgtagtcggcgcctcggcggctagctttaggtttcctcatggctagttggtgttcgatctggcttatggctatggtttataatttgatgctatgtctcaatggaagtctttgtatttatacgggtatgaccgttcaattagaacttgaaaactacaagtgggataggagcatataagaccttatattacacgaatcgattggattctgacatattgaatggcatttacatgttattcgtagaattcccatattatttttttaagccaatagaaatttcatactcgaatatatatatacccttccatataaatctaggtatatggtattttcgttccatataaagctatagagggctgctagctagggtacggcatcccgtctaaacgagatactttatattgatgacgttagctccgccaccactttatccgctcacgagtccaccactcagcgccgccctacgcgctcacgccctagctggcgaaggagcacgcgcgaggcgctaggagaaggccacagtaccagtagtggcttaggtggcaaagttggtccctgcaggctgtagcagcctggtgacccttgtaccaacaccagattgagaagaaaaggcatggagat

SEQ ID NO: 102717 - DNA, 726 bp, Oryza sativa
agatccgctcttcgtggaagttgaagccggcgtttgggaaagcgagcaaggcaagtcacatcatccttgaacatattgaatcccagtttataaaattattttgatttaaattattgcatagtcgctttatttaaattgcccgcgttatcactgttttatttagccatgcctatttacctttgttatgaccttaataattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcagtcctgcctgcctgtcccggaggttctggccgtaggcgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcatgtaccca

SEQ ID NO: 102718 - DNA, 514 bp, Oryza sativa
gggagagtcaagcatgcatatcgatggctccactctcaaacctcacatccctcaccagtttaacactaaagcactgtgttaacttaaccgtggatgggttcaatcctttcatcacatacagccaatactcttataaatagagaatttttacggcaataataatcatcgctgctccatagcaacggatatgttctcagaggtggcaaggaccaaagttatgcctgcaggtggctccttccaacagctggtacgacttgatgtggacagtatctcagcagtgtttgttgaaaccatttgtagcctcctcgctgcgaccctcatcgagttgagattcacgtctgacttgattacagaaagcttcacagaaaagcaggagcaggtacttcagctccttgcctccctccaatacctagaattctatgggtgttctcgcctaaagtccctccctaaagggttgcatcgcttttcttctctctatggactagacatctctcgatgtcctcaaaaagaatgt

SEQ ID NO: 102719 - DNA, 530 bp, Oryza sativa
ggaaatacattgcctgctatctgtatctataccactagggtttaattgccgatggtcatctttagtgcttcctcgagatggggagcatccaaattgttcttctgccacatcacctttgacctttttctgattccggataaactaattaccaaccaacgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcatatatccgcatctttcaaacgaatcctcctggaacttgtctgtattacacatttctccctcat

SEQ ID NO: 102720 - DNA, 1085 bp, Oryza sativa
gtactcctcgtttattccttagcccaatggtgtgaattataggcttgtttactcatattaattctgtattatcagcctatctatccacaagtctacttctcgacaacgtctgattgatcgttcatctattttctgtcgattctcctccatttatatgtgcttctcctgcatacatgttactagcatagtatatagtggaagtagatattttatttggaattatgcattgcaagcatagctagtcttcatacattgggtaatattgacggtcgaaactggtcgataacgatcgtcaacagcggtggccgttggccagcagcatccaacggctagtgctaacgccggagggccgggcgaagttaaaattgatattattatactgtaagaatttgctacataatttaaaattagtagactaagccaccgcataaacattaataaccttgtaaaaaaaattacatggttttttagtcacatgatttcatatccgtggagcattcttaagccgccatgtgacacttcaagaaattatggatatttctacgaatatttatactacttaaaaaatacgcaggagggatggtgaaccaatctagacgtactgacaccgcaccccgcgcctccccctctcacgaccccaccagcgcctcctctcacgcccgcacccgtgccctaaaaacggcccgcccctgccgccacgcccacaccgccgcccctatcatgcctgccgctgccgctccgccgcccctctcacgcctgctgccgctgctccgccgcccctctcacgccgccgcccttcgtgccgctcgggaggagttgcggcggggtcgagcccctcatcgccgactacccttctccgctcgcagccgccgtcgtagcgtgcgtcgtcgtcaccagacaccagcgatcaccattccctctgtgtcgcctcgccgtccgtccatactacacctctgccgccgagcagccgccgtcgtagcgtgcgtcgtcgtcaccagcgatcactattccttcagtgccgcctcgccgtccgtctgtactccacctctgccgccgggactcagggccgctggccaccatctcat

SEQ ID NO: 102721 - DNA, 878 bp, Oryza sativa
ctctaataaattagaaaagaaataagaaaaattataagaaaacaaaatatttggccattgatatacacgtagctccattattttcaaccattacattagatctattccaactaaaaagccatttaatcccttcgtatgtacgtatgtacacaagatatgtaaaaaagaataaaaaagaagagttcatatacgatctgctctatctgatagtttttttttctttaatttgaggcactaaagtttttttctcaaattgtgcatatatgatatatgtaatgacactcatggcaatcttctcgaagaagtcgtgtcgctgtggcaccgcttcatgccatcccaccaaactttttgaaagtattttttttactaaccatgtaaaaggcaatcgtaagcgctcatataaatgtgtgcacaccatcctatgaatacacatactactattcacaaaaagaaaatatacatacttagaataaaaaaatgtcacatggaaacatattatatccttatgtaattatgccattctcatataaaaagtgttaacagaaattaagcagcaagataaatttgtgacacataggacttgattcacttgcgtactattagcccatgcaaccatgcgccagcgtgagcttagatgctcatagctaaaaagaaaaagaagcaagaactccatattagactcagtatagtactgtgcaaagatggtgaaatagcacgagtcttacggtataaccaggaataaacgtgaatttggtttgaatataatagaccattgtcatttagtatataaaattttatggtttatttcatggtgtaagtatttctttcttttatgattataatgtaatttatagttattacagttgaatatggtgaga

SEQ ID NO: 102722 - DNA, 716 bp, Oryza sativa
gggggtatattctctgggtgattgtatgccgttgatggtgacagctcagtatgggcgtctcccccgcagtttatattcctacatacaatttcctggggttggatacacctccgtatcctacttcggttggagggttatgacaggttatcgtaagaaactcggcaacccggggtaactttgcgatgcatcgggagggcatagctatgcttaggcttagctatgctgcattgttaaaggggttatactacatagtgtatactagttataatatactaagatgttgtatactagaagtacaggaatggaacatatctaaactactgccacttagctataattaggagatgtaggagttagataaatccttagttgtgtgtcactctacccttaagcttaacttacccctgcatagaccttgatgtatataagtaatatataactattagcatagtactctcttatcatatcttcccttgggattaaacaaatacagtaccttagaatactcccgagtgaaatgctacaatggtatatccgtgcgcttgaggatcacatctgtaaccataggaaggcgaagaccgagtggaggtcggcgcggacgctggcggtgcgccaggagctctgccgggacgctgatgtggaggcggtcgacttcgaccctgatgacgacgacctcatggacgaggacgtcgccgaaaacatgccggcgcccgccc

SEQ ID NO: 102723 - DNA, 698 bp, Oryza sativa
aggtccaatttttaaaggtttggaacttctaaaaaatataaaaaaaccaacgataattatgtttgatttttaaaatagcaatggcaataaagagaagatgcagtggacggttgtagaggagtataatggcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtggtagcaacttatgtgacttttaagaactataaaattacaaacacgaggatgataagatttggtctttcaaaatctcaagatatcgagataaatttttaataaatcttaagtaaaatcatattaaaaaatatataattttatatgggtgctagccgcgcaattgcgcgggcagtttaaaaaactctgtcacgtataaccagccccagacgcaaccacggtggttgcatccaagcgaaggatttcataattaagtcattaatggccaatttggctctaatgggacttgttaattaattttctcctgattcttgccagctaaacccaccatctacaccttacccatgagagggatgggatggcatctcaatctatgggcgccgggcggttgatgaggcagacaa

SEQ ID NO: 102724 - DNA, 700 bp, Oryza sativa
tttaaaaggattatttagtttatatggaagaagatgcatcgatttgttttaaatagccctgagcctggtggtgacgaagatgaggagccccttgatttgtgaatgtggtctaatgatattagttcgtcagcgtaaaataaaaggaatttgttgattgacacaactactcgaaaaatagaagtatccacttggagcattagtatagttaagtggtggtatcacccgaattttttagatgtaagcacatgcaatccagtaattacaaaaataagcacgcaacaaccacatttagatgcataggcaagatgctcacatgaagcacggtgcttccattgaaccacttgaccaacagactaatgggccgctgaattaagaacgttagcgcaataacccacatcaccaattggttaaatgcatcattacgggagcatgcatggtttaattgtgttgttttcatttcacaactcattgtagcatatgtatttcttacattatttacatatgctctacaatacaatgtgagctatgagaccaaaactattgctattagttgaagaaaaagaagaggattaatactattgggctgctcgcatgttagtgctagaaacaagaccgcaaaacccccatatactacttcgttaggtcctcttggtcgacccgatattgacagtggtcaagtacttgtgcgaaggtttgttag

SEQ ID NO: 102725 - DNA, 1579 bp, Oryza sativa
aatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatgatggagtataaagtaagtatagtgcactactagtatacaatagcaattaatatttagcagaaaaagagtgtgcatataggtaaagaaggtatttttattgaattgtttaacaaattggtcaggaagacgtgtgaagaacagatcaaaagcattgtttcttccagggaattgattaagtcagatatgctgtagtaggagactttccctgctcgtgcttgtggacaaccatttgtaatgttcctaaggtaatcaaatcagctatacaaaatataattttcaactccaactaattatgaaactttgccatttaaatttgcagacaaacaaaaacaagttacatgttacgtatactgtatacagctatggccaacttatatgtttagattaattatttttttggcaaattttgctacaagatatcacgactttgtggttttagctgtagggcaccgcacgaagtcacttttggggaaagacactctcaaaatgtggttatttgctaggggacacttcattcattaaattaatatttttgtgctgactaagcgagaaggggcctacttttttacatggcatgaccaaattgccctcatctctttctcttcctctctcttcctccttaacagcgaggccgctactgaggcattgcaacggtgtgtggggacgggcgtgggcggcggtgcatgggcgatgggcgcggcgttgcagcggcgcgtggggatgggcgtgggcggcggcgcgtgggcgatggg

SEQ ID NO: 102726 - DNA, 629 bp, Oryza sativa
agatacacattctaaagtcatttgaacaatgataaaaaatcaaatccgatgggaaaaaacaagaaattgctagaacatgttggacaatcgccatgttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtaccacacagccaacatgaaagaaacaaaagataaactcat

SEQ ID NO: 102727 - DNA, 1973 bp, Oryza sativa
tacctgtggtcatctctcttactcgtgaattcacctattttaatgacagggcaactgctgtagggttgttgctatcgggagtcttccttgagtgacacaaatcatggttctcgttatcctttatcaatcacctttcgacctacttcttttcccagtaaccaaacatcttttccgatctcttccattaatcacctttcgacctttctcaaccaggtactcttcactccgggtgttgaggatgcttctggggcaatgaggtgcttgggcgtgctgtctttcagagaaaccttgaagtagttcgtcaaaagctagactgacgattgttgcctttgatccgaagagacacatctgaaactcttagtccaaacaaatgcctctttggttgatcacttgattttcttcgccatcaatcgctaggctatttgattcctaacagattatgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattggcatgtctgcttccttaacaggtactacagtttgtaacagacaataactttcttacgctcgggttcttcatcttgtacttgatttctttggctgctgtgcacgggcgggagggcggctcggcctggaggggggggtgcggcttgggccgggcaggccgggagggggggggagagacagcccgggagagagagggaggagggtgctgggccgaggggaagggggcccaagaggagggagagaaggagagggagagaaagagagggaggaatgggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttcttttcgaattttaattaattctattattccttttagcgaatgatttttaattcgggatgaatttatcaggacgtgacaggagggtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagtttgctgctgacgaagaagatggccaaccaacccgccagttccaacggagagaagcatcaagatggatgaagtcgggggtcgatggacattctccagggcaaatgaaggctacacgagctgcggcccggtagtcgagatgtcatggcagagggttggtgccctgctgctagggtgctcagtcctgcctgcctgtcccgggtgtcccggccgtagggggattgggtcggtactcttgt

SEQ ID NO: 102728 - DNA, 645 bp, Oryza sativa
aattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacacatgtgaggaagatgtgtcttgtgggtaaagatgtacacctctgatcagagtataatctattcgaatagccgcgccctctgttatgggcaagcaaagcaatgtacccaagttagtgttttaattcttaaaatttgctcaacaactaaatgtggaatggttggcctgggttggcttgagacgagctgggactcagggtcgggttgctagttcggactgaatc

SEQ ID NO: 102729 - DNA, 691 bp, Oryza sativa
acaacacgggatattacactagattcattaatatgaatataaatgtgggaaatactataatgatttacattgcgaaatggagggagtactaattacagaatgctatgcccctggttgcatcctttcaacgacggcacaggtgagttggttactgatgctgatgatccttttcgactcgccgacgctgacggcgtgttctcaccaatcaccccgctaacagaacttttaaatatgacgacctaacaatgttttaaaccaattgtatagtaacatgttatattatggcagcgattccttatacaaagggatctgtggcacacattcataggaggatcagatgtaggtttttctgtacgaggtgtacgaggcccccggtatattccagacagaccgtaagtggcgccgcctggaaaaaccggtccaccggggccgggtcatcgcccgcacgggataatctctattatcccgtgcaggcatcttaatacgaccgcatgtgataatatctgcatggctcgttaagtgaaccgcacagaaaaatcatttttcgcgtgcgggcctaaccatacggggcggaacctataagagatccgtacacaaaaatacccctcccttttttgccactcactcactttgaattttttacttccttcttccttttattcactcatctctctctcttcctctcctctct

SEQ ID NO: 102730 - DNA, 684 bp, Oryza sativa
ctgcaagcagttcatcaagataaaaggtctaaacttttttccaaaaaaaaaaagtattacagaaagaagagaaataaaacagtgaaactaggtcattaagtcatccgtgaatggtatgacatgttttgaactccctacgaattgccaaaacatctattcacacgtttcaacgagtacccaaaaccaaccatgatcatcatagtcacaatgcaacattaataacccctaataaccaacagagctaattgacagtatctgagcttatacagcatgtgacaacatgaaattcctaacagtacatgttggagttacctgcaaaaacaatatgtagcagaaggcaaattgcacctcagagcaacactagtcaaatgcactgaactcatgttaagtcccatcactctttggtcaaactgattggtcgatcggagaaatgagcacaaaggcatcacataaacgctcagcctagccacattatcaccatcctaactgatacttatgccgcattaccttactcccaataaaagaataaaatatcaccaatcttatgcaccaaaacttcaaaacctgaataccgcaagctgaaaggcaggcgcccatgccatcgacgcaaacccctgcagaaatgctaaaccccacaaaagtgcagcccagacccaaagcacaagtaggagccctaaactacag

SEQ ID NO: 102731 - DNA, 563 bp, Oryza sativa
ttggtgctagacaccaccgacgacgggtagcacttctccggcgtgggcgggaaacagcacaacttgatggtagacgcaggcgcagccgggaagcagccgaagttggtgctcgacgccaccaacgacgggatgcacctcgccggcgtgggcgagaagcagcacaacttggtgcttgacgccgtcaccgacggattgcacctcgccggcgtgggcgggaagcagcacaacttggtgctcgacgccggcacgggcaggaagcagcagaagttggtgctcgacgccgacgacgatgggttgcaccacaccggcgcaggcgggaagcagcagaagttggtgctcgacgccgccgacgacgggttgcacctcgccggcgtgggcgggaagcagcacaacttggtgctcgatgccgccgacgacgggtttcacctcgccggcgtgggatgccgccgacgacgggttgcacctcgccggcgtgggcgggaagcagcacaacttggtgctcgacgccggcgcgggtgcgaggcagcagaagttggtgctcgacgccgccgacgacgggttgc

SEQ ID NO: 102732 - DNA, 1128 bp, Oryza sativa
tacccccttgcatgcatgcaaaacacattaagctagccacatagattgatagatatatttaatatgggtataataggaaatagtcactctaattaattactcattggtatttgaactcttaactaaagcgtcaattaataaagaaccggaggactagtttttaatatgtcttcaacctattacactttgaccattagttttttccatatataatacattatcaacagctacaaaattaacatcataaaaaatattttcaaatacaaatatagtggcgctaaacatatatatactcgctctgtttttaagaattgacgactttgactttcccatttaaactttgatcattaataactcttaaattattaacaaacattttaattcttatatttaggacataacataatttaatagcatggccttatttctagtgtttgtaaatattaaaaaaagatgagtagttaaagtttaaaattgtacaacgctcacagttattttaaaacagaggaaatacgttgttagtttaattatcaatcaaaatttccagatactgattttcctgaatattgtatataacacatacttccttcgtcacagaatatagaaatctaaaactgaatatgatttaacttatggctataaatctatacatgatatgtgtcctgattcatagagtcctatccgttcatatatggtgtcttcctggctagctgcacatccgaacaaacgtacacactgtctcgccgtactacggccggtgcatgcatgcgatctctcgttctctcacgtacggtctctgagtctctctcgtgtgtactgtgcaatacgagtactccagtgtgtagtggtaggctagctaggattgcaatgttgcagccaaaggatggatgcagctagctagaaaagggacaaatgctgcgtgaaatggagacaaagcatatggttatgtagcaggcattaattacaaatgtatgcatgcaatgccagtaggccttttcaggtctcctttggaacgatatggaaaaatagaggaattttggagggttgttggttcctatgaaaaaagtttatatgtggtcttttggaacaaaggaatagtttctctcgatttcttctgaaattactatg

SEQ ID NO: 102733 - DNA, 1333 bp, Oryza sativa
tgccaatgccaatgctcactctgctagtactctggtagctgatcaattattgtgcttctgcagtgggattggtcataggatgggccagcaatgatcagctatggccttgctagtacttccatgatcatgttgttcttggtgtacatgagatgacagtttttacattcagatatggttcttgagtgggtaccaataggtataagaaaattatagtaccttctactacttctcaaggatcatataatcactcatataagaaaaaaatctttgattcaaagcttgacatgaacaagactgtaaagattatagagcaaagaacagagctggttttcttcacaaaaaaaaaaacccccaaagaacagagctggtgttgtgacaatcctgaagtacatttcatgaccaagcatacatgaatgaaatgttctcttgttggacagtagatttcaaccctattcatcaatcatcagggtattgtatcagaacattttactacaagctagtggtagaatttttctgttgtgttattccacagactagcttcagttgagagtgcatgagcctgggtagtgatgctgcattgagaaaagcactatggaagatggtccagatcagaaagagagctgagtgacaaaaatgcagagctgctggctggaccatggccactgcaagtccaaacagtgccagcacttaattgatggatgaatagcacaatgggtccttcttctcttgtgggtgaaaatctctgaaaactttgggtctagacctctttgaccatgacctagatagggatcaaagtaattggggtccctcattctagtagctatcatctgaagaatggatagacactatatattatatggccttattaactgccatgctacttcactgtggtgggggcactctagccatgcagaaacttttggcattgtctaagccattttcacctcaggtttattcctggcacattctctccggtgaaagaatttgtaactggatagtggctcaataattccttgctatcaagatgaagcggctaaattatatacaaggaatatattgtacattctccatcccaacatataatgcgcctacaatttttggaaaatcaatatttgcaaattttggctaataattaaaccaacaatgtatatagttagtgtcatcatgcatgtgacattattagatttgtatctgaaagtacttttgtatgttgtctattaataatatactccgtattatgaaaacacgaatggtcaagagactgtaaaaaaacgtatacttttttgcagttctgctaaagagtattaaggcatgttccttttttactttggct

SEQ ID NO: 102734 - DNA, 3030 bp, Oryza sativa
gaggctccagcatccatgcgtgcatgtccctgaacacactaaaaaaatctttcatctttttggtgttcagttcaagcttctaactctgaaattctctctgcaattgtagttgtaggtcactgtccctgtagtctgcatctttgtgtgcatgtctacttgatggtggacaggtggatatatatcgatcaatcgattgatgcaaccatatgcccctcccatctttggatttcagtgatcacatcatcaatggaatcgctaattgcttttctttcacaaaagtagggaggggtttatctgaaccaacagagtattggagctaagcatatgtactgattcatgcatggatggaaatcgttatgaagtgtcgaattaaatttaaaaatatattgtttgttcgtttttctcagaaatattcaggatgcaattttttttacagaaatataccgtcgatttcgcacaacagttatacgaaaatgacacagacatgacgtcgcgagcagtatcgtactgtgaaagtgcgaccacgcggtctcacagaatggtcttgccgatggaaacagcgacaccgtctcgctgatgaacgtctccactttaaaggtaattaaacactaattaaccatttgaatcactatagcagtccggtatcgttgtctggttcagcgaaaccgttcagtctcactcttccattccgcgagaccgtgcgcgacgttattttcatgcaatgattgtacgatatcgacggtatatttcaataaaatgatttgcatcccgaatattaaaaaaattgaatgaacagtatatttttaaatttaattcatgatatgtccacacaaggctttttgcgtgtttcatctaaggaaagaaatcgttacgaaacgtcactgacaaggccgggctcgcaaactgaaagagagcacccacctgtttgcatgtctgggcttcgctcacagtgtcttctttattactccctatgtgtctaaatatttaacgctgttgactttttaaacatgtttgaccgttcatcttattcaaaaaatttaagtaattattaattctttttctatcatttgattcattgttaaatatacttttatgtatacatatagttttacatatttcgtaaaagtttttgaataagacgaacggtcaaacatatttaaaaaagtcaacagcgtcaaacatttagggacggagggagtagaactaaatggaaaataaaaagaaactttgtttgtagatggatcactttcctcccatgagcactgcatcttaatttcgttatgatgaaattaggacacgatgaggcaatcatgtcccaagcctagctagcagtgtactgatcccctttgaaggctagatgcaaacctgtcaccttgatggaaaattacatctggcattagggcaaccacaattgtgggcgggccaggtgtcgcttagcgaggtcatgcttgttttcttttatcatgatatgaagagccaaacatgttgtgacttatgagagccatgcattagctataatggtgacaataggcaagtaggagtggtggtagtacaagtagttgttaacttaggcacatcttcacgacatgaaatgtagggccagatggttaactaagactgcacaacaatcaaagtgacactaattattggtgcttgggtatggaaattaaagtagagtggtagtatatgtgtggataaagatggagagtgggtctggatcagtaggaatttaggagaagccttgcattggaaggcacaaacccaagaaagaagccaggttttgagcccactgatcaaactttggagacaatttgacatgctctaacccaccagcttgcaagatttttatcattgctctcagatatgttgaaaaagctttaggccggaatctgattcttgctggcccccaagtggttgtaactgatgaatcatgtaagcaaacaaatatggttgtctccaaagtcatagtggaaaccaggaataaagttgtggcagtgattgaggttaatttctcattattagaaggaaaatgtccacttaacctcatgtagtttggttggtcgcgatcgacttaacacctcaagtatgaagacagatgtgaaagggcatatagcctagtggttgcagtgacctgagtagcaccctaagatactgagttcaaattttcgtagaaatgaattttagattaggctatttgagggctaagtttctatttttttttaaaaaaaaagatgcatatatcatcctctaaatatgagaaacagttcaaaagatgttctatcctctaaatatgaaaatcagttcaaataacatttatcctatcagaaagaaagcttgggggggtgggtaaaatggttaatgcgtttctgcataaacaataccatccacatagaaaaactactcacaaactcatccctaggggttgcttaaaccggttttcatatattttcgggtgaatagtcagcacggtctttaaagtttcactctatagtcagtttagtcctttcagttttaaatcgtccaaacaaattcttcaaatttatcatttgatttaagatagtccttggacccataaaaacgccgtgtgggtgtgccactcattcttgcatgcaagggtagacatcaaataaccattctaccatatataagtatataacatggtaaaaagagagaaaaaggaaaaaataaaacaaacaaaaaattgagggtagaatggttcggcctcttttggttcatttcttttatttccttttcttgttttatcatgatgtataagggtagaatggttatttaatttctgtgcttgcatgagatcaggaggatgtggcatgcccatgtggtattttcgataagtctaatgatcatattaaacaaaatgataaattttgagagctcgtttggacaatttaattaaaacattagggagtaaactgaccctagaataaaacttcaaggaccgtatggtctgtatcggttgatccaccctttttaagtagcatttgatgtaatacaagaacctaacgggactat

SEQ ID NO: 102735 - DNA, 5718 bp, Oryza sativa
ctcgtgcacttgcagactctaggtaccaattgaaccagaatcatatgaaaactcgaattttttaaaaaaaataaaaaaattcggtcagattggtactagaatagaatcacctgtcctgctcttcttgaccgtgcaggattccctcctggaaaagctgctgctcctccactcatcctctcctcctcctcctgctccagttcagattattctcatcatcagagaacaaaaaaaaacaatcaaaatgcccgaatgtctcagcaaatttggatcaccatgccatccatcacaaaccaacccaaaagaaagaaaaaagaactgaaaaagctgggtcctttgaccagcagcagcagcagtgcaagaaaacaaaacaaaagagtgatctgatctccaagaggcagacaggaggtaggagagttggagtagtagtagtagccatggcccatgggggtggcagtgtgggccccacagctagacacactctgtcagtgagagagagaggggcgtggctagctactgttcagagttcatcaggctcactcactcactcacctctcctcccaaatgcagcagctgcatcatcgccatggaagtcataggacttccccctgatgttgaaccacttcagcacaaggctcttggaccatgacagctgcatcagcatcatcatcatcatcaacaacaacaacaagaagttggagaagatttggtaccaaaaaaaaacaagaaaatctgcctctttgcaatgtctgaagatcagatcatcagagaaagcaagaataacacgcaaagaaactcaccttgctcttcttggcgccatctctcattgttcctcaggggagaggcaggcaagcactcatgcaggcaggcaggcaggccaggacaagccaaagagagacggatgcttctctgctcagccacgacgctgctgttgcaagagatggcgccacaggtgaaggtgaggcagagacaagcaggggcactgtttgtctttctgtgcacagaggttgtgatttgatggaaaagtgcagagcagatagagagagagagagagagagagagagagagagagagagagagagagagagagagagagagagagagtgactgcagcaagagctgtttgggctggccaaagaaagattttgttattggggaggaagatgaagaagaagacgaagacgaagacgaagacgaagaagaagaagaagggaatggcttgtgtaggagtaggaggagaaggtgagcaaagtgcatgcgatgctgctgctgctactgctgctgtctgctacttctaggaggtaaagggcctaaagcgaggtagccgtctcactgtctccatttctagagagagaatgagagacagagtaaagttagagtgagagtgagagaggggataatattattattattatatatacagtaaattaccagcgcgaaacatttcaattctctttcgagtcaggcaaaaacagaaggtattctaattctaatggctgaatttttgcattcatttttgcagattgctcattgtttagtgtggccagaatagacgaaacggcagtgcaattggccggacacgcaagattaggggaggccgttttgttttgctaagtagctggattattggacgtacggctagtgttgcttcagctgctggtgcttcagttacaggggcgacctaaacaaaaaaaaccagccgactggagatcagttcatcagttgggcagaaacggccaccaccctgaattttcactggtttgtaagtgtattgccgtgttggatttagaacttgagtttctaaatggcatctactgagctgaaagtagtaggaaagtaggaaaactgccatggttttttcggacgtgaatgtgcgccggacggttttttcccctaattctagcctactaccttagtaccttctctgcaacccacataatctctctcttgcacattcgtctactcatgagtcatgacaaacagctccactactatttaaaccaccaccttcataactagtggcggagtcagaaattataaaagactagggataaaataggacttaactaatgaagtgttggttttcttcaggatttatatggtatttaacaataatttaagcacggttttaaaggtggcctagggctcaatccctagctacactaggcatgtctccaccctattaatcgtagtgttacccctaatttctttcttatttgacaaaccttcacaataggtttttttcttcatacactttcccgtttctagtcactatcgctattgcctcaaccaccaccctggcaccattctcaatcttacaagcatgttattggatcatttcatagttggttgtattgtggttgccaacattgagacacggattttgtttacaaactctataaaggaacctattctcgaacaaaaatgtgcaaatcaatcccctgggcaaaaaataaaaaaaatgcaaaaaaaaaaaactataaacttcgttaggccttctaaacacaattttgcattctataaaacttacatattcaaattacattccttttgtttttgcatcctagttgtcatagaacatgtcaagatgcaccccaaaatattaccagtattattaagacgtttttatggttcatgagaattttttagtgtaaaatttaacaccttctcaatgtaaaaaaccagaaggtagtgcaaattaacactaaaattatggtatcttctttaagagacataaaacaaatatttttaacagattgaccgtattctttttttggcaaatgtggccgatcgagctcaagacaatataaattaccttgaattcatgaggtcctacagccctaccttgtgaccaaattaagcatgcaacggggtcgactgcacgagcggtcgataaagatggctaatttctctaaagcacacaatctagctaggattagacccccaaagtaccctagttagttattaatcaaactatatataaagtacattcctggctagagctagcttagccctgctgctccctttgcaaggacaaagccagaggccttcctgtcttgtggggaagattttgaccaaggtcaatggattattaaaggattgatgagcctaattaggggatcaagtagggcattaaagtaattaagaatgattcagtgcataaaatgtgtcagcctaatggcaggccagagctagtctgatcagggcctagattacatgaaaaggccatcctgtggtcacgcatgtccctccccaattgacatatgttgggaaattaaaccggacccatgccatatatgattgtattacattcatttccgagcatttgctaactagattttgtaatagtcttaaaaaaacatgtctttttaattctaggtgaagctgttatataggagtatgttttttcccgcgcaatttcatattttttgataacactcaaaagttcaatatatttcacatggatattgaaggataaaagaaatcaccatttttttcactctaaaggtctagaaattattgtgttaattggaggaaaaataggaacgaaacatattaattactagatgaatacccgccgcgttgctgcggaaaattaagttagataatgtatataaataagatgcaatataattattaaaactaaaacaaattgatacttataaattttgagcttaaaaataattaagattgtatggtgttatgagagaggaaagaagagacaatttgaaccatagatctatcatctaaaggctagaaataattgggtggtgtggcttaataagataagagagaaatagcattaactacacttagtggggatgaactatataagtatataggatttggttgtggtggatctagattaatttataattgtgtagattgattgatagagttgtgtaataaatgataattgcatctaggaaaacagaagtaacctaaaagcttttgatgaaatctaaatttacttctaaaatatagttttatgcaaaattacatggaaagatctacttcaattaatccaagctatagaaataaaatcagcaacggtctcagtcgaacaaggagttgctaaaatatatatccttagccaaacatgcataatcctctctatgctttatagattacaaaattgtaaaagttcatgcatgctgatgtatatatattgattaacttaagcatgcacggtgctagctactctagagggggtaattagggcccagtgggatgtttaattgagctgttgagcgtgcagcacccttgcttaatcgatcggagagtctatttggagcttatttaggacaggcatgatggcattgttcaagtttccattgagcatgttttttttgtgggggcagtcaaaacaggatctaggtttgcatgcatgcttttggcaaaggggtccctctatgtctttcagcttttctctgctttgcagccactctccctcccttatcaaatgggtgtaggatttgcactcaacctctccttgcaaccaccatgggttgtatatgtatataacacatgtcccatatcagttttgaaaataaaatatgaacaaaccaaaacgtgatcttctccgaaaaactgatatggttaccacaatgatgtgtctgaagctagatataaacaggtcaagtgacagttattttgtttgttgtaaggatactggtcaaaatttcaaattataaacaaactgtatcccaaaccacttattatatatatattatgacacaggaaactgagcatattgttgctagctactcccttcgtcccaaaaaaaagccaacctagatggtgattttacaccatctaagataatgaatctggacatatagttgtccagattcatagttctaggtcattcatagttttaggtggtgtcaaatccccacctagattgtcttttttttttatggagggaatagctaccaggtactacctatagcttcgtataacagttgtgcagccacaataagctcatccaaacacgctaattaacagtctcgtacacattcccctctagatctcccccctctctctcccttacctcattggtgtcgctgtctagaagcctagcttaggtgacagtgatgtgttgatagatggactaactcccaagagcctaactaagttaaccaagatagagagattgatatcaccattgatcatgaggccccatgcatatctctgccattctctgatcacctcgatcatcctccttccttgcactgcatgcattctttgagctttcttccaccctaatccccaccctttgctgtctttccttccttttgtcccacatgcatgaattccaatgcaatgcaagccctagctaggggcatcacaaccccactcccctactagctacatcctccgtcccaaaataagttcatttctgggcttctgtgtctaacatttgatcgtctgtcttatttaaaaaaaattatgaaaaaaatttaaaaataagtcacgcataaattattattcatgttttatatctaataacaataaaagtactaatcataaaaaaatttaaataaaacggatatcaaatgttagacacagaaacccgtagataaatttattttagaatggagcgtgtactacacaactacacacgtctcctctctctcctctttgtgcatgcattgcatgggacattaattccttccttgcatgcagcaatggagtggggccctttctgcatgccgtgtc

SEQ ID NO: 102736 - DNA, 699 bp, Oryza sativa
gaaaaaggctactggtcacatttcagccttccttcactctgcaggaaaatgtgttgctaccccctttccctccttttgctgttctgagtttctctgaaggaatagtgaacaaaagacacaaaaggctctgtgttgctggaatctgcagggaggttttaaattcttgtttcctgtgtttgagcatctttcaaacttcctcagcccattatagcttagcacaattggaggtagcttctgcattctggaactgttcattgatcaattgcatcttcagtctctgagaatgtgtgcttctatcagttatgcactcatttatgatttatcatgagatcttgctgcaatgagacccaaacatcatgcaatctctcttcctcacttaggggggtcctctttttgacacattctttagaaagaaaaaaatatatgaggcaaaattaagtgtctgaattttcaccatgaaaggtagagaattcagagaaaaggcaacagcattcctaaaaactatcacatctcagacgtgtatgtaccaatattattccagcaaagcctcagtaggccactttaaccatgcacgttggcagccttacaaattatacttcttttcacgaaaacagtgcttagtagtagctctaacataaagatgcgagtactctgctgtcttaaaaggtgcatacaacgttcttgtcactgacagatgga

SEQ ID NO: 102737 - DNA, 1707 bp, Oryza sativa
ccgccgcggcggcggcggcggccgcggcgaggagctggccgatgctgcggcggctctggaggaaggcggtggtggcgcccgtgctctggctctaccacctcggggaggacatcatcttctacggcttcctggcggcgatgatggcggcgaacctcggcggcatcgtgcccgagatcctcggccgctgggcctgcggcgagggctccgccgtgtcggccgctggcgaggaggtcctcgcgagctccaagttcatcatagtgcgcttcctcccggctttcgtcgtccagctcttcgtgcgcatcctcgcccgcgcccggttcgaagccagggaggcgaagaaggagaaggagaagagggagaacaacgagaaggtagttgattcttatcactcctaaaattttcttcacttgttgtattgagtggctagctagatctgtgaataccattgtacaattggtggaatttttgctcggtcatgtttgggaattgggacgacgccataatctagtcgtcaattttcgctttttatttcactcgttgaacctgatatgacaatattttctcagttgtgtgcaatttgtattttgtatttatatggctacatagcagttcattgttcatgacttcatgtgcagtaatagcccctttttcctgttcgtaatagaaatctagtctctcataccaatctgtgccccacttaacgatttgtttgttcttgtgattgcgaatcctgatagcagacaagctcgaccgccatcagggttgaatcatctaaggaacaacgtccagaaagtcgaggagcacggcgctgggggcccaaaggcttcatgccatatgcaatctacctagcccctcctttgattcaactttcttgtcttggcattaagatgaaagcccatcatgaggaaggatctcttgaatggagggtgggctatgtgcttgatgactttgcgaggttcacttctgctattttgatttcgtttgttggtgtcccaagcatgctgctcacagcgatgattcccaaggtgaaggatgatgacacttcgtcgcagtgaactgttgaaggtacccactctttcattttttaccataatgtatgctttccttgtgatcaaagtgtatctatgcttgaatgttcacagtggtaattataattaagaattcaaaattgttgttcacacattcaattagtctttgttgtttgtccggtggttctatgtctaccatagtttagttaatcaatgtgaaattgaatttgaccccccctcccccccccccccaaaaaaaaaaccaaaaaaaaaaaggtttcctcttgtgaagcaccattttggacttattttgctttatgtcacttattttgaattgatgccggagctctttgttgtaactcaattacttgaaaacatgtggtcttagaaaatgtacttgatttgttcacaatattaataagtttgctaatgtttgaccttgcaatattattctcaaaaggcagattaaattcattaaaattcggtgggcaattaagtagaagatccatataaagtgttgttgaactagtcattatatagaagcatgggtctgaccaatatatcataatttattcacttctactcgtgtatggaatattcaaaattttcaaattgtgcaagtgcaacaatgaaaaaggagttaaggttccagtcttaagtatcaggggggtgcaggaat

SEQ ID NO: 102738 - DNA, 3437 bp, Oryza sativa
agggtgtggagggtgaagctacctggccatggccaccgtgttgttccggtgtagccaagctgacaagccgtcaaggtatagtaattaatctccctttttattgtgtaattctgcgagcaattccctttttaaccgtgtttattagggagaaaataaagtgttctgtgtgttcttagtccactgtgcccactgacattgatcgcattgaattgattcatatattttcgcgaaccacgggcattctttagtttttaactgcagagtgactggatgagactaatagcattgttaacatgaacaaattttgaattaggcagtcccttatcttaatcctacttgcttaattaggcagctttcttaattaggcaacaccttatggccttaatcatcaaatgctctagtttcactctagaggcacagctgtagtcctgtatttgtgacttgtgaatttgaagaattacggtgttctctcaaatatgtatgtctagctgcctggtatgctccatcaggtctgaggttgcaggaaataccttctcctgtcagtccagttaggtgaaaactacacagtaggatagttactgttgtccaaatgtttctttgataagctgcacattcaagtgtgtaattggtctacttacggaaaacttactgaaattcctacaagtctaacattgtctgctcttttggtttacaaacatttacacaccgatcttatttaatttgggttattctgttaacagacaaagacttgaagagaagtacggctgtgaagatggtcagacagggacctacaggatgactcttgctgatggttaattatgggcttatggctgatgccatcagatcaaagttttgaaaactatatttggcttttacgtatactggtttctagtactttttttgacatgatggtttctagtactttgcatctacgaacttctattttgtaacttagttcaatgctagtagtacagtaggacatgttccatgagctgatctgcgcatttggcaatttggaattaaggtgtttattctgttggaatgacttatgagcatacttgtcatggtaagaccttatttggcagaaaacacagtcaatgcttctctggacataatatcgtaattgaaatgttctgtgattgaactagttgatatgctgtttcgttgatgttttatggacctttcagtaacaagtgattttgtgtctggagctgctactgcaataatttctgtgataactgcagtttgtaggatttctgggttttgatagctacaaggtgaatagttaaatctttctcactacaaccgcgagatttaaaagttgacagacagatcaatgcggcgcgtgtgtgttttattaaccttttggaccgcaatggtcaataacttaacaggtgatttgctcttgacattttgttcagctcatcgatcgttgatgctgttgcctgttggtctgctcttaactagagcttgaaacttgttgggggttacatgcttaggcgttataatttctgataaatcattcgctaaatttcacgtgcattcgtggaaaagggatggagcatatatatgttagggtgttggacgtttattgtcgtacctaagggatgcgacatctttttagcagcacggcttgacgattttttagcagcacggttcatatgtttgtaaagttaattatttgtcttgactttgctatagttaaaagtacaaaacatgtggtaagcaatacttcgcatatttgtttcagattagctggtctatttgtttcagatttagcttataagctgcaatcatttttgaattataacttaattttaagattaaattaggagtattgtgctaaaattgttttaactccggattattcttttctttaacttcgaactacaactttctgtttccgttagtatgtttttcaaagtattaaacgatacgttcttttatttatatatatatatatataagttcttcgataaataaataaattcatttttaagtttatatttaatatttaattaattaatcatgtgttaatgagtttttttttttttgcttggggctgaaaatctcctccaaactgaacaaagaatgcaatagtcttgtgacttcaatcatagaacaattaactatcctttggttcttcccgttggttcatttaaataacaggattgaaaaaaccatttgaattgtcgcattgaaaaaaacgaaggaatatgaaaaacacaagattctggcatgaatgtaagtgcaaaataaaaaattacaaaacacacgaaaaatataggaataatcatttgattagatcatagaaatcaaatgagagagataaacttaagggaaatttcccaaaaggttaagatcgacccctttggttcgcaggaatgaaaaacgaaggaataggaaaacacatgattctaacataaatgaaagtgtaaaacagaggattgcaaaatataggaatgacagtaggaaaaacacagagatcggataagagagatagactcaaaggaaattttccaagagctttgagctcttgctaagtttcctccaaaatctctataggattgtccattccataggaatttcaaaggattggatatgatacaatcctttgatttaaaggtattcataggaatttttcctatagggttgaaatcctccaaaatttgtattgttttcctccaaatcaaaggagccctaaagctctagccaagtttccttcaaaatatctgtggtattactttccataggaatcttaaatgattagataagattgaattctttgtttcaaaggtcttcacatgaaatttttttgtaggattaaaatcctccaaaattactactccctctgtcccaaaatgtaagtatttttggaccctgacacgatctccgagatgctattttgaccaataatatctataaaagtgaggtatttcaaataaaaagtgttgcatattatgatagtttgtttaatgataaatctaggaacaccaattttacatgattgatcttttttttattttttttattaatagtcaaagttaaaaatatttaacttatcactatgctaaaaagcttatatttgggacggagggagtatattcttcctacaggtcaaagggcctaacaaccccatcttttcgcttatgcttatacttatcagccaaaatttaaatttttaatttaaatttggagttgattttgaggtttttcatcgaattttatttttcagtctttgcttttagatcgctaagaatacgtatataaaagttttattcacaaattattttttgtttataaatatgccgtttaataagccaaacgactctagtcatcatagctgcttccggggtatagggcctgttcactttgacgcaaaaaacaaaagccaaaattttggcaggatttcttatatagctacaaaatttttttat

SEQ ID NO: 102739 - DNA, 1579 bp, Oryza sativa
catcaatacgaatgtgggaaatgctagaatgtatctatctagattcattaacatcaatacgaatgtgggaaatgctagaatgacttacattgtgaaatggaggaagtatatggtattttctcaatcttaaactgggactcactgaggaaaaaaaaaactctatcaagtaggattgtaagagcaagtacagtagcaagctataggttagttaaaagcacatctggaggagagaagaaaagaaaagtgggctcagatttatcgctgcagcacgagctccatgtgtgtatgagatggacaaaatattaatgatataatatatatttatataaaatgtatacataggctattagagtggttgtagatgatttatcaatttttagagttaacaattaactatattattaaacttgctccaagagcaacatgcatgttgcatagctattatttatttcttatggcatcaccaatgtatatagtaaaaatgacccatatagataagacgtacatacacatactttaaatatagcaattcacacaatatatatagatcaagatgatattaggagaagagagaaaagtagagatagatgatattatttattccatatgggtagtcactatgcatatggatatttttttgttactccctccgtttaatgttataagacgttttgactttgatcaaagtcaaactgctttaagtttgaccaagtttatagaaaaaaataataacattttcaacccaagacaaatttattatgaaaatatattcaattattgatttgatgaaactaatttagtattataaatattactatatttgtctataaacttagtcaaacttgaaacagtttgactttgtccaaagtcaaaacgtcttataactgaaacggatggagtattttctttatatggaccagttgcataatggtactagatggttgaatgaaatattatattatctatgaaatacttgtgtactacattgtaaatgccctaagtttaaggatgcccataataatattatgttctttgcttctttcccaataaaatctggttgaataaaatacatacttttttattccctgaggttatttttcatgcaatattgtggatgaccttatccatggaaaaccggaggaaatatttttcaattctccacttcgcacgtactctacattcgtactacctcttcttttttccttgtttgtttcattgaaatgttcccatcccagcagttcaatagtacatgtttgatcagacaaacattcacacgcacaacagttttgagctatccagaccatcttgggaggaagagaaaaatacaccatttctgtcatagcattagccaccatacttaaattaatatgcctaacgataaattagtgataccttcaaacaactactcccccgtttctaaatatttgacaccgttaacttttttaaatatgtttgaccgttcgtcttatttaaaaatttaagtaattattaattcttttcctatcatttggttcactgttaaatatgcttatatgtataaatatagttttacatatttcacaaaagtttttgaataaga

SEQ ID NO: 102740 - DNA, 614 bp, Oryza sativa
tacaaggcaatcgtaacatttgggaggaactgtggcactgttacatatattttttggagctcgcgagtaactagcttttgcatgacagccatcactaccctttggatttaccttattttcgagctactattatcgcgagattataattaactcatgttacttggtgatcgactaatggctgacaatcaaatactccataatatatagtgcggaaactcaaaaaatgtgaacgatagtgatataaacaataaccgcaaagttattactttcaatgatagagcaccacaaggtggacatgctatatataatggagagccatccaaccatgcatatccgacacattcacgcataagagaattctgacataccgtgctacaacattacccgcggtggtatgggaagcatagccactcacattgccattctcaccatcagtggtgctgtagccattgctaatagatgccacaagccatggtgatgaagacgactcataagatggaggaatttatatcatacatcatatacttccgtatatgatgtaattatattttatattatacaaaatcctattttagaccgtcgttctttccaccgggactaactacacatttttt

SEQ ID NO: 102741 - DNA, 1528 bp, Oryza sativa
tttataaggacttgtactcttagaaccggtaataaagcatttttaggctgtgttcgttacttatgtaggggagcaaatccctctcgcacggaaaacagagcggtttattagcacgtgatttattaagtattagctattttttttaaaaaatggataatatgattttcttaagcaacttcgtatagaaactttttttttaaaaaaacataccgtttattagtttgaaaaacgtgcgcgcggaatacgagagagaggggttgggaacatggagcaaagtactggtttttaatctagctgaaatatttttgtttttggtaccacaaagaaagatcagttctccagtagtgattacacacactgtaacagggaaaaatatataaatatgataaactaaaattagaattatttgggggaaaaattattttcactctggatccactcgtctcagttctttacctcgttaagagaaagaaaactcaaatgattgagaaaatataatagctcgtaatagttaattttgaagaaatcgtgacatagagcggtgtaggctcggtatgaacaccagcgactacttgttgacattgctgtcaagtgtcaacttatttattatttcttatttttgaaaccgagcctgcaattgctggtgcatggcctcgtcgagaacctatgggagcattttctccttcacgcgcacgacgttatctgctcaaggatgacatgcggcgattttgatggttttgcccaagactaacagacacataaacacatctagtaaagataaacataaacacaaaacacacttgtatagaaggaactctgctaactcagctcaactcaaattctcattcatatttacaaagcctgacatatatataggttagttgcagctagtgcatcatgtaattaattaggaccagtactataatatcccatatattgcctctaaaaatgtcacattagattgagtgacgaggtggagaaaagaagtgaggagagagatgatgagccacccctaaatcaagattcaagaggcaacctagctccacacaaattttaagaaatgtgtgaaaatattagagatatttgtatttgtatactaggggtgatacattgtatgggttgtctcttagttcatgagtaaataaaatagataaatttggagatggtagttacatctaacatagcacttgcccttagagcaagtttaatagtatagcccattattgcctccaattcatctatagccaatctaatagccaattcatacaatagttgcttactatactattaatatatggtcccacttgtcatacacacattgcgccttgaagtccgtgctacagctggctaagatctgtagcacgctgctattctctctcatctcttatctcatgaaaatatgtttgcagctaggtaataatctgctattgtacctgctatagcaggctataagccagctataaccacgtattgagaagaaaagagaagagagagaagaaagcagctataaccacgtatcgagaagaaa

SEQ ID NO: 102742 - DNA, 712 bp, Oryza sativa
ggagacggtcggcgaggagaagcgattccctccctgcttgcccgtggctggttcttctacgtgtagaacaccgcgctcgcggctgagcgccgccgcagccgcctcccccgccactcatctcgccgcggccactgccggtggcgcttccctcctacgcgactcgccggcggggccgagcgggaggcggcgctggcggtgccggtggggaggggcatcaggagggtggggcgcgttgggagggaggggcgccgtgtggggaggggcgtcgggaggtggggcgctgacggggaggggcgttgggagggtgggtggccgcccggtggcggtttggagcaagagggaaggggcagcgcaggatttgacgacgtgggcggggaagagacgtgggagcgttaatctaatgctaatccgagtgctaatccctgtgttaatccaactcgcgatgtggatcgttggatgagaggatctgacgattagaaataggtgggtgtactgaagaggaaactggtgctttttatatcccatcttctagaaagtcaagacgatagttctgcttagaagaagccacatcatcgatttcttttctcaccataggattgattattgatggcacagattgccatctcatcaccttgcccctatccatttcctctcctttccgtttctgcttgagaaattagagcgaaaactaacacaattaattagaccacga

SEQ ID NO: 102743 - DNA, 561 bp, Oryza sativa
gtatactttaaaaattttacacccaaagaactaaacacaccttatatgaaatttattgtcaaaacttttttcttggagggaaaggggatttaaaaatgtttgaaaaggaaacttgttcactaacactactaacatgtataaatagaaacttgtagattatgatttgtttttacagtattattgagcaattcaccttgaaaggagatgatcaaaagtctctcgcagcaatagtctaatgacacggtggatatgttgcatttgcgtgcaatttttctaacattatgaatattttcattaaattttagcatacaaactttatcgaatgcatgcttaatatggtagggaactgaaataaaacctaaagaaaactaacacaaggtcatcatggacaaacaactttcacaaaaagtggtagccttccacatagctaccatcaatcaaacgccaagacttgaccaaagatatctgagagccgatcattccaacaaacccaaaccgaagtgaccaattcatcgaaggaaccaaccaaccaacaagccctgttcctcccaagcattattt

SEQ ID NO: 102744 - DNA, 2130 bp, Oryza sativa
attcgggtaataagggagaaatgtgtaatacagacaaattctaagaggattcttttggaagatgcggatatgtgatcatgtgtacaattgtttactgacaaaggagacctagggtctcgtgtcagaggaactatattctaacctcgagttaataaccaacctgttgatggaaagaaaaccaattaaactgtgttgggttaaaaagccaatgagatagtagttggggataggagtttggatacgcctttttacagatcaagataaggattgttggatgaaacccataagggtacccgccatgcctctacattgttaagttcggatatacctgcaaacagttaagaaaatccaggagacatcaatatttgagaacatagtagtcgatggttggtaattagtttatctggtatcagaaaagggtcaaaggtgatatggcagaagaacaatttggatgctccccatctcgaggaagcactaaagatgaccatcggcaattaaaccctagtggtatagatacagatagcaggcaatgtatttccctgaaggtagtcagtgcagctttttgacgaaccacatcaaggtttcactgaaaggcagcaagccaaaggacctcatcgtccccagaagcgtccgcaatccacattaaagaataccacctgttcgagataagccaaaagatgattgataaaagagattggcaaagatgttctccagcatgaaagaagtaggccgaaaggtgattgataaacagaaacatgctctgcaccgctcaaggaagacccctgattgtaattgccccgcaacagtcaccttgtcattaagtaagcaagatgacctaggtaaaagtgtttctatgaaggcaaagagtgaaaccttcaactcggtatcagatgctacacggagtgaaaagtgcaagcaccggttaccaggtaatgccatgtcttgggagatgatccaatgggaaagagcacatcaaggttaaaggtgtaaaggaatacgttgaatgctaactgaggacaacctgaagataataatgggaagtaaactgaatgtaaagaaagtgaatccgagttgcttgttcatgggagctattcccagttatgaaccaagtgatatgttcgaagatagtttacagaggtcagattaaaatcacatgtaacagcgaagcttcagatttggcagggtaacgatcaaacaataacaagtccagcagtaaagtcatctggaaaggcgtcaaagcatgtcaagtgggataagttggctctgttgagaaacataactgaaaggcgaaaattatcgacccttgcatcgaatagcagaagtacctagcaccggagaccaggaaagctaatatgagacagttaatggcaagttgtcaatcatggtatccttagtaagcgggatatcatagtctaaagcctatggtggtaagctggaaggaaacgccaagcctggtattctcatgatgacaagcatggtatcctagtaatgacaagcaggttacggcacatgacatgaagttgataacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttagtggaattttcagagcacaaataataattattaagaaataaacaaagttaaaatggttttataaaaagaaaaaccctaaaaagtcttcttttccccccttccccctcttgggccggctc

SEQ ID NO: 102745 - DNA, 788 bp, Oryza sativa
ttaagacagtaaactgaaacatcaatgaacaatgaatgaactgaatagtgaggttttctgaaagttaaattttacactgatgtcataaggaatacatacatggaagaacagcaaaattacagccaataaaatttcacttcagtttaatcaatatcagcaaattagacctatttttttgcatgagattatggtatgttagtgtataccaaaagataacagagcacctggtgctcaaaacttttaacaagcaggagaatttatttagtacacaatgaaaaagcttttcctagaactggaggtcagtcaagtcctgaatacaggtcccacttctgtttgctgaatggcgttcaaggaaagataattgcaaaagaattttatgacaagaccactctcaccactgctctttgttctggaaggtgattctacaggatttattgaataaaaatatgcatcaggattgatttcccttaaatatggacatgaagggacacttcattctctcatcttctgaaatgatgatggctatagagttataagagaatctacaaataaattattgtttctcaaaggaagcttgcaaatattttttgatttcaaggtttaacgtgaataattccaaatattccagtccctcttaacttatgcccagataatatgactctacttgctggactgagtagatgaaaaatgagtctttttcatttacattggattgtcactcacagttgagacccaaacttaaggccttgttcggtttggaggggattgatggggaataattccacacc

SEQ ID NO: 102746 - DNA, 822 bp, Oryza sativa
acattttcattccggtcaaaaacatcgcacccatgtgggccaatatatgccaatattgacattatttgacaaaagttagccacgcgaatcacgaaatgtgtttttgccacgaacacacccgatacactccaatatgtccaaaaatcatgttttggtgttttttgaactttttgattccagtacaaaacatcgcaccctggtgtgccaatattggcattaattgacaaaagatcgccgcgcgaatcacgaagtgagtttttgccacgaacgcacccaatacactccaatatgtccaaaaatcatgctttggtgctttttgaacattttcattccggtcaaaaacatcgcacccatgtgggccaatatatgccaatattgacattatttgacaaaagttagccacgcgaatcacgaaatgtgtttttgccacgaacacacccaatacactccaatatgtccaaaaatcatgttttggctctttttgaactttttgattccagtagaaaacatcgcaccctggtgtgccaatattggcattaattaacaatagatcgccgcgcgaatcacgaagtgagtttttgccacgaacgcacccaatacactccaatatgtccaaaaatcatgctttggagctttttgaacattttcattccggtgaaaaacatcgcaaccgagtgggccaatatatgccaatattgacattatttgacaaaagttagccacgcgaataacaaaatgtgtttttgccacaaacacaccccatacacaccaatatgtccaaaaatcatgttttggctttttttgaactttttgattccagta

SEQ ID NO: 102747 - DNA, 1365 bp, Oryza sativa
tttgggaccccggcccaggtggggcccatgtggggtgcgccccaagctggtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttgttcttgcttgtttcttcgatttgcttgcaggaatagggttgatctgcaccggcaaaatcagcaacccacggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgcgaacttttgtcaattaatgccaatgttggcacacgagggtgcgatgtttttgaccggaatgaaaaagttcaaaaaacgtgaaaatatgatttttggacatattggattgtattgggtgcgttcgtggcgaaaactcacttcgtgattcgtgcggcgaacttttatcaattaatgccaatattggcacacgagggtgcgatgttttcttcaggaatcaaaaagttcaaaaaagtccaaaacatgatttttggacatattggagtgtattgggtgcattaatgccaatattggcttatttcggcccacacgggtgcgatgtttttgaccggaatgaaaaagttcaaaaacgcgaaaacatgatttttggacatattggagtgtattgggtgcgttcgtggcaaaaactcacttcgtgattcgtgcggcgaacttttatcaattaatgccaatattggcacacgagggtgcgatgttttcttcaggaatcaaaaagttcaaaaagcaccaaaacatgatttttggacatattggactgaatcgggtgtgtacgtggcaaaaactcattacgtgattcgcgtgggtaacttttgtcaaataatgccaatattggcatatattgtcacacatgggtgcgatgtgaacgaccggattgagaatgttcaaaaagcaccctcgcatgctgttatgacatattgtagagaattgggtgcgtacgtagcaaagactctgttagtgatacgcgcgcgcaacttttgtcaattaatgccggcattgcacatgagggtgccatgtgatgactggaatcaaaaggatcacaaagagccaaagcttgattttaggacctaatggagtgcatggcgtgcattagtcgcaaaaactcactacgagattcgc

SEQ ID NO: 102748 - DNA, 2469 bp, Oryza sativa
acatattggagttattcgggtgtgttcgtggcaaaaacacatttcgtgattctcgtggcgaacttttatcaaataatgtcaatattggcatatattggcccatacgggtgcgatgtttttgaccggaatgaaaatgttcaaaaagcaccaaaacatgatttttggacatattggagtgtattgggtgcgttcgcggcaaaaactcacttcgtgattcgcgcggcgattttttgttaattaatgccaatattggcacacgagggtgcgatgttttctgctggaatcaaaaagttgaaaaagagccaaaacatgatttttggacatattggagtgtatcgggtgtgttcgtggcaaaaacacatttcgtgattcacgtggcgaacttttatcaaataatgtcaatattggcatatattggcccatacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgagggtgcgatgttttctgctggaatcaaaaagttcaaaaagagccaaaacatgatttttggacatattggtgtgtatcgggtgtgttcgtggcaaaaacacatttcgtgattcgcgtggctaacttttgtcaaataatgtcaatattggcatatattaacccacgcgggtgcgatgtttttgaccagaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgagggtgcgattgatatatactggcccacgcaggtgcgatgttttttaccggaatgaaaaagttcaaaaagcaccaaaacatgatttttgcacatattggagtgtattgggtgtgttcgtggcaaaaattcacttcgtgattcgcgcgacgaacttttgtcaattaatgccaatattggcacacgagggtgcgatgttttctgctggaatcaaaaagttcaaagaagccaaaacatgatttttggacatattggagtgtattgggtgcgttcgtggaaaaaactcacttcgtgattcgcgcggcgaacttttgtcaattaatgccaatattggcacacgagggtgcgatgttttctactagaataaaaaagttcaaaagtgccaaaacatgatttttggacatattggagcgtatcgggtgtgttcgtcgcaaaaatacattttgtgattcgcgcggcgaacttttgtcaaataatgtcaatatcggcatattttggcccacacgggtccgttgtttttgatcggaatgaaaatgttcaaaaagcaccaaagcatgatttttggacatattggagtgtattgggtgcgttcgtggcaaaaactcacttcgtgattcgcgtggcgaacttttgtcaattaatggcaatattggcacacgagggtgcgattggtacatattggcccacacaggtgcgatgttttttaccggaatgaaaaagttcaaaaagcaccaaaacatgatttttgcacatattggagtgtattgggtgtgttcgtggcaaaaacacacttcgtgattcgcgcgacgaacttttgtcaattaatgccaatattggcacacgagggtgcgattggtatatattggcccacacaggtgcgatgttttttaccggaatgaaaaagttcaaaaagcaccaaaacatgatttttgcacatattggagtgtattgggtgtgttcgtggcaaaaactcacttcgtgattcgcgcagcgaacttttgtcaattaataccaatattggcacacgagggtgcgatgttttctactggaatcaaaaagttcaaaaagagccaaaacatgatttttggacatattggagtgtattaggtgcgttcgtcgcaaaaactcacttcgtgattcgcgcggcgaacttttgtcaattattgccaatattggtatatattggccccacacaggtgcaatgtttttgaccggaatgaaaaagttcaaaaagcaccaagacatgatttttgcacatattgcagtgtattgggggcgttcttggcaaaaactcacttcgtgagtcgcgcggcgaacttttggcacacgagggtgcgatgttttctactggaatcaaaaagttcaaaaaacgccaaaacatgatttttggacatattggagtgtattgggtgcattcatggcaaaaactcacttcgtgattcacgcggcgaacttttgtcaattaatgccaatattggcacacgagggtgcgatgttttctactggaatcaaaaagttcaaaaagcacaaaaacatgatttttggacatattggagtgtattgggtgcgttc

SEQ ID NO: 102749 - DNA, 1525 bp, Oryza sativa
cctatcgtgcatagctaccttaagttcttcccaagtagtaggtagtaccccctcatcagataacccagcccactacatgatagcaaaatccttgaactcactactagcttgtttaactctatgttgctcaggtacaaggtgggcattaaacttttgttctattgccatctcccaatcaaggtatttctcagcatcataatatcctgaaaaagatggtattttaaacttaatcttagcataaggatcatctggcacacgattattattaccttgttggtggcgagtgccacccatacctgtgcggtttatgcgtaggcgacgtcatagccgtgcttgccttgtagctggtgtgtcaatatagccactggaatcatacaccgtgtcttccgaatgagcatcgtcgtcaccactcaccacttcctcattggaaggtgtctccaacgcggcaacccgatcagttagcgtggatatctgcttgtccaacctctccatgtggttcaggaagccaattttagtgaaggcatcttggacagactttgcaacggcctctgataccacttgatgtgcactagggttcccgatcttccgaaaggttctgataaaaaacgatttgggcggagtcgcgacacaaatcgatccggcttcttgaacgcgcacgctcttgagccccgcaatcacaacaccacgtctcctctggttatcacctgtgtcgaaacgcggatgacctcgccaagaaggctaatccctatttgccaatcgaagaacacaaacaagaacgagatagaaaacaaccaaaattgcagatgaatgataagctcacgagatggggtcttacaaaccgatctagcggcgaaactgttctcgacagaataatctaagcaaaactctaaaacctaaagatggtagcggtactgatatatagagtttaggctcgtgcaaccccctctcgacgcaaccctaatgggttccaacacgatacacggcccaaaggcccaaatacggtgacacagcaccgggacggattctggatgtcaacttgttcagtcgatacccattgactcggaaagtatttggacgtgggaccaaaaccattggaaagaacgccccaatccgagcacgtatgcgacctgggcgcccgttttagtgcagactggtcctggactccgaattgcaccgaggtcgaattggtttgggcctccacctttacttggacgtcctcgatgatcctccatggctctaagtccttctccaagtgtctccttgtcccctctattatttctaatcacaatatattcattaggtagcaatcttttctcgaattcatacaaagaagaacataggaacgagctcacctctaaatttaattgtcgcgcacgagctcttgttatcagtccttgaatgaccattggaggattgttgtgtgtatccgaggtagtgatgtccgtatcatgtcgcggagcttcggcgtcttccatcaagatattagctgatgaacgagtgctagacccgtcatgatgacttgatg

SEQ ID NO: 102750 - DNA, 1001 bp, Oryza sativa
tttgccacgaacgcacccaatacactccaatatgtccaaaaaatcatgatttggtgcatttttaacattttcattccggtcaaaaacatcgcacccgtatgggccaatatatgccaatattgacattatttgataaaagttcgccacgtgaatcacgaaatgtgtttttgccacgaacacacccgatacagtccaatatgtccaaaaatcatgttttggctctttttcaactttttgattccagtagaaaacttcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagttcgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgaaaaaaagttcgccacgcgaatcgcgaaatgtgtttttgccacgaacccacccgatacactccaatatgtccaaaaatcatgttttggctctttttgaactttttgattccggtcaaaaacatcgcaagctcgtgtgccaatatttgcattaactgacaaaagttcgccgcgtgaatcaagaaatgtgtttttgccacgaacacacccgatacactccaatatgtccaatatcatgttttgttgcttttcaaaatttttcattacggtaaaaaacatcgcacctgtttgggcgaatatataccaatattggcattaattgacaaaagttctccgcgtgaatcacgaagttagtttttgccacgaacgcaccaaataagctgggctgcaggaatt

SEQ ID NO: 102751 - DNA, 617 bp, Oryza sativa
gcccccgtgtgggccaaaataagccaatattgacattatttgacaaaagttcgccgagcgaatcacgaagtgagtttttgccacgaacacacgcgatacaatgcaacatgtccaaaaataatgctttggtgctgtttgaatattttcattccggtcaaaaacatcgcacccgtgtgggccaaaataagccaatattgacattatttgacaaaagttcgccgagcgaatcacgaagtgagtttttgccacgaacacacccgatacactccaacatgtccaaaactcatgctttggtgctttttgaacattttcattccggtcaaaaacatcgcacccgtgtgggccaaaataagccaatattggcattaattgacaaaagttcgccgcgcgaatcacgaagtgagtttttgccatgaatgcacccaatacactccaatatgtccaaaaatcatgttttggacttttttgaactttttgattcctgaagaaaacatcgcaccctcgtgtgccaatattggcattaattgataaaagttcgccgcacgaatcacgaagtgagtttttgccacgaacgcacccaatacactccaatatgtccaaaaatcatgttttcgcgt

SEQ ID NO: 102752 - DNA, 674 bp, Oryza sativa
attgaagcaacaatgtgttgcatcacctgtcatgggcctttgggcttgtaacttcgtttgggaccccggcccaagtggggcccatgtggggtgcgccccaatccggtggagcacgaccctaggatcctcatggtcattctcccacccctataagtagctagataccccttcagggttgctggggttttgataaattgtaagtttagccattgctacttcgcttgcagcgcgcgtgtcggctagaccgtccgtctgcttgtttggaaccccactttatcgtgtatcaattcatatttgtgcgtcttgtctatctagcaattcagttgctttctatcttgttcttgcttgttctcgattgtgtgcaggaatagggttgatctgcatcgacaagatcaacaacccatggagaggtgtattgatcactaaggcacaacagaacgtcttgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttttctacctataatcagaaaatagctatacaaaaaaatttacatcatgtccctagccatctttgtgccattgctttgttctat

SEQ ID NO: 102753 - DNA, 926 bp, Oryza sativa
caaaatatgccaatattgacattatttgacaaaagtgtgttttgccacgaacacacccgatacactccaatatgtccaaaaatcatgttttggctctttttcaactttttgattccagtagaaaacatcgcaccctcgtgtgccaatattggcattaattaacaaaaaatcgccgcgcgaatcacgaagtgagtttttgccgcgaacgcacccaatacactccaatatgtccaaaaatcatgttttggctctttttgaactttttgattgcagcagaaaacatcgcaccctcgtgtgccaatattggcattaattgacaaaagtttgccgcgcgaatcacgaagtgagtttttgccacgaacgcacccaatacactccaatatgtccaaaaatcttgctttggtgctttttgaacattttcattccggtcaaaaacatcgcacccgtgtgggccaatatatgccaatattgacattatttgacaaaagttcgctacgcgaatcgcgaaatgtgtttttgccacgaacccacccgatacactccaatatgtccaaaaatcatgttttggctctttttgaactttttgatttcagtagaaagaatcacatcgtcgtgtgcaaaaattggcattaattaacaaaagtttgccgcgcaaatcacgaagtgactttttgccatgaatgcacccagtacactccaatatttccaaaaatcatgttttggcgtttttgaactttttgattcctgtcaaaaatatcacacccgcgtatgccaacattggcattaattgacaaaagttcgccgcgcgaatcacgaagtgagtttttgccacgaacgcacccaatacactcaaatatgtccaataatcatgttttggcgttttctgaactttttgattccggtcaaaaacatcgcaccctcgtgtg

SEQ ID NO: 102754 - DNA, 679 bp, Oryza sativa
actccttggatttattttttaatttagcgagtgagtctgatccatgacatgtgtataaaaatatttaatcacaaaattgctacaatgtagctgaggtatttgcacggaatctttttgtcttacatcatgaacttagaaaaaaaatggaagaataatcatttcggcaatatgaaagaataatcatttcagtaatatggtaaaaaacaagatgctagagagatcacataacccagacatgattacaggactaatcaatatagcaatagaaaaggaaaagctcacacgaacaaatttaaaataatctatacagatagactacattgggaattattattgactactgaagactggcctaaactcatgtttgcttggactagaactgccatatgttgcttagtgacagctgcttgttcactttcgcttgccgaaagaaacagtaacaccccgatgccacctggccatgtaggaaaagaaaccaagttcatcagcaaagacatgacatttcttttgttgttaaagaagacatggagatagcgagctgatcaatagaatctagaaagacagataccttgccaatgtaactgcgtctgcatcaaaataatggacctgaaactaaacaatatagagcaaagaatggacatgaacatgcatgaacatgttttaatcaatcagaaataaa

SEQ ID NO: 102755 - DNA, 1229 bp, Oryza sativa
tttttggttgttgctggagttgggggattttgcgtgtccgggtggttggcgttgggggggaggcggctggttggagacgggctggaaggggggagcagagctttggtcgtggccacgctctacttggggcccacttgtcagtgactgtttatggactcgctagccaggctatgctcaagattattgaaaggcctctgctcgaattctatgtttagaatggattatatttccattttagtattgagttaaatccttagcggatagttttaaatgcctgtttttttttaaaaaaattataggattgagaaaatattaataaccgagaaagagcacaggaaagcgtggagagaattaggttgtgttcttttgagtgttgaaaattcttcctctcgacatgcaaaacggagtggcagattagcacatgattaattaagtattagcttaaaatattttaaattgaattaatatgatttttaaaataaacttttatagaacattttaaagaaaagttcagaaagagagtaaggtatactagtaagcaactagcaaaatactagacttctcaatttctcattgccttgctgtctccgttgcacttgcacttgatgtcatcaaatgtttggcacaaaccttaatatcatgtttattgatgttatctttacgcttatattttcgtgcaaccagatttggtaatttaaggttgaaacatggtgtgctggcctaggttcatcctcctcctcctctcattgaggatggtgtcaccatagctgaggcttcccaatacggagaacagtgcagtgatgagtagggtaaggccctgttcagggtaaaaagttttggcgtgtcatattgaatatacggacataaatttgaagtattaaacgtagatttaataacaaaacaaattacatattctgcttgtaaactgcgagatgaatttattaagcctaattaatccgtcattagcaaatatttactgtagcgccacattgtcaaatcatggagtaattaggcttaaaagattctgttgatgtgaaaaacacacactggcctggagatctgcttaactcatatgtaggtccaaaatcttgcttttaggttcgtgagcgtgccagttgatttgatcctgcaatcaacaagaaagaaagacaaaaaaaaccacgattaaatccataaatgatagccgatcggctagttgccgatgacatatcatttatcttcgagccgat

SEQ ID NO: 102756 - DNA, 1321 bp, Oryza sativa
acgggcgcgcggcgcggtgacgggacggttgcacggcggtaggcgggcgtgcggcgcggcgacagcgtggcagcggcggcgcggggcgcaaggcggcggcacggggctcgaggcggcggcacggggcgcgaggccgacggtgacgatggcgacggcgatggcgcgcggcgcgtgatgacggcgacgcgacggcgacgcggcgcggcagcggctacgcgatggacgggctcggggcggctaggggcagaggtgggagaggagggggaaggttagggaccacatcgaacaccttaggcgcaatgacagtgacttttcctatttatcccgattttagtgtattttccatctaaatttgattccacaattcctaattttacatatatgcattttactcaatattcgtgttatcttaactaatgaattcaccctagattaatattactcatattttatttttatataatttatttgagttttaattagggttaattcttattccatcgcaatgaaatttaattgatccaaatatggtcgcgataatattttatttattactatccacacctaatctttatttttaatttatatttattttaccaatttgtttttaaggtttatttctaattaactattctttactcacgattaataatcttcgagatcaactccagataaaatagaccaataagatcggcatgatgcaattagtttaaaaaagtttttgaaaatccgtatttttagagttttggttttgtcggtcgaattttcagggtgttacacggcgtcagaccagtcacagaccggtcattcttgtccaccacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgtggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccctcccgaggggtcaggc

SEQ ID NO: 102757 - DNA, 582 bp, Oryza sativa
gcaactgtggtctttccttcctgtccaaacagttgtatcatacaccatgtctatacttgtgtgcgtttgagtgttacacacattgttctcttaaatataattgtaaatataaataaagtgcacatatgacgcctttttttaaaaaaaaaaatagttaccttatgttgtgctagtgctatgcataggataccgttgcttcattacagtgttaatgtgcttcatgaaataacatcaccaatttgttgttcaggaagttggaactttgctggttccacaaatggttcttctaggtttcttgagtttacaaaattgaagggcgatgcggttttggaactattaagtacaccgacaaagataagcggggtgcactatgttcaggtaatgcagttccccaccccaccaggtacatgaggccattctagtttactttcatttataagtccagttgagctgatgtcacatcctggcctcccacacccttcaaatagtccctgttgagccattcctacattggtgtaactcctttatccctgtagcctaaacttaattctttcccccgcccccttcatctcaatcaacttg

SEQ ID NO: 102758 - DNA, 726 bp, Oryza sativa
tccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattatgtcacttgcctgggcgaattcctttgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgcttcattcacctacgtttgttcgttcacgttcattcacctgcctataattgcatttcacgttcacgtttgttcacgttcgttcgctcgttcatgttatcgttcatgttcgttcgctcgttctcattcacgttcgttggctcgttcacgttcattcaccttgttctcgttcaagttcgttcgctcgttcacgttctcggtgtggcggcagcagagcggcggcggggcggcgcggcggcggcgtggcaccgcgcgcggcatcgggccggcgcgtggcgcggcggcgtggcgccgcgcgcggcatcggcttggcgcggtggcggcgtgcggcgcgcggcgcggtgccgtcgtggcgctacacccggtggcggcgcgttgcgcg

SEQ ID NO: 102759 - DNA, 545 bp, Oryza sativa
atacgacagttacacttagcatacatgacaattttagtcttagcatataagattatttgagttttaatataagattattatatttgtaattagacttagtatataattattgactgctagggtcctataatatacgtcacctagacttagcatatatcactatttgagttttagtataagattattagattgtaattagacttagcatgtaagattatgtagggttctaatatacgacagttacacttagcatacatggctattttagtcttagcatataatattatttgagttttaatataagattattatatttgtaattagacagtatataattattgactagctagggtcctataatatacgtcacctagatttagcatatatcatcactatttgagttttagtataagattattagatttgtaattagacttagcatgtaagattgtgtagagttctaatatatgacagttacacttagcatacatgactattttagtcttagcatataagattatttgagttttaatataagattatta

SEQ ID NO: 102760 - DNA, 801 bp, Oryza sativa
gccctcaagacgggcagcagaaaagatagtctcctacaaggaggtgcccttgaatattaagatgcgacgaccatgatccccacttgcatgcaaagagcacaaacaccattggcatttattttatggtgtagaatcaagtttgttgtgtatctatctgttttggtcgctgtcaataggtaggttagctcctctatctaccccaacatggatactcaccctgcatcccagtttcaaactgaccatggaatttatctgatttagcctcagtctggactgatgatgccgataacaaccagcaaaccattgttcctgttctgatgaagtagagaccagacaacaataatgtggttagtactgttttattttcttgatggttctcatatgttgagagatcagctgtatctgttcagtttattgcgtgttcaagcgttggctgcttatattatgacttgcttacctgacaatcctaaagcaaacatgtaatgacctgggagctactgctggacccgatagatagatagatgggtactccagatcgctggagaagaagcatcaacgaaggataggtttgagtcggcgcacatacagacggcgaatcgatctcacgcgatcaaaatcacagtgggacatcacgatcgtgagcatgcagagatccagcctagtactgtacatctgatctgaccagccaatctcatgaaatcatgacctttttaactgactgatttggatggtttgttatactgtactcctgcatggtgacatttcaaatcaatcaacatcatgtttagtttcctcaatcag

SEQ ID NO: 102761 - DNA, 578 bp, Oryza sativa
acaggaggaggcagtgacctgctactggtaccactacattaagactgtgtttagttcatgctaaaattgaaagattggttgaaattgaaacgatgtgacggaaaagttgatagtttatgtgtgtaggaaagttttgatgtgatggaaaaattggaagtttgaaaaaatattttaaaactaaacacggcgtcactagagaatttggcagtgcatttgcctttataaagtcggcatatatagctgtctaggatatgaatatgatgcacttttcctagtgccttcaggtcagcgaaggctggtagtacgagtagaataaaagtttcttcagcaacaagttaaggtaatttgcatatgcgtgtctttgaaattgaaacgtgtgtatgtacactgcaaacagttgtcggacaaccggtgcttttgtgtgtacaggtatagctacttggcaatcacgtggtcactcaaataactaatgctaatttgtcttataaaaatactaactaatgctaataattaatggtagtaatggttaattagttccgctagcctatatgcagtacagtgctttactgactcaactt

SEQ ID NO: 102762 - DNA, 4112 bp, Oryza sativa
ccatttctagagagggcgttagtaaacaaaacacccaagaatgcacaaaagtgcagtacagcttagtatttttcaggcaaaacagacacaggagcatatgacttgacaaaaaaaaggcacaacagttgtgacaatatgataggactacagccactccaactgttaatccctgttaaactaattagtactagagccatgaaaatccaccaggtgttcattcttccgcaacactccataatccatttcctgcttgcaaccatcattacaagataaagcgacaaagatatcccatcaaggtctaacgacggggttcacagttcatcagaagatatattatgtagtacttctagagctacaaatcacaagggtcactaagcattgtccaaacaacagtcttaaccaggaggccagcattttaagaaaagaacatttttcttggcctcaactgagagagaagtaccactgaactttaccagtactgatttattgattgacagttctgcatgtaaataacatttgacttctaaaggcataacatcacaaaggacattctttctaatatccatttggtgctctacttcttgatttgaagagaaacaaagtacactactttcttgaattctgcagtacagtattaagagagttcatttctgcttggtacgaagagttttcaggtagtactcactgtcactcacatgcataaaaatcttatcacagcatatcagaatcagagcagatacgcatgcgcacaagatgcagtagtacgaacacatcaactgaaaatcccacacgacttctcgccacagaatcaaaagtacaggagaacaacgcaatgcgcaagcagacaagtcacccacaagctacgacaaggcaccccaaaaaataaaaagattgtgtttttcacgcaatctgaatccctctctcctagaaacttcctcttgccgctgaacaattcaaagcgcatcttcccattcacaccttccgttcaagaacaaacaatttcctaaattatttgctgctagttgttactatactaaaaaaacgttgaaatattatattatattaattgataagggagttcatttatttcagtggtactaataaactaactaatctctcctactttctccagatttccagacaagaaaagaaaataagaaaatagaagcattcgggcacgcgaagagtatacccaacgcaaccacctcagttggatttcccctcaaccgatcatcccaacacccaaagaaaagcatccggttgcgaaatcaaatcacaaacgaatgcatcaagaacacgagaaagaaagaaagcaagaaagaacagggagcttccgaaatccgggagtttactctactcacctcgaagtctgccggtgttgtctcgagctccgcaaccccaccaaaatcgagcctctctgcgccttcgagttcctccacgcacatgccgctgcctgccgccaccgagcctgaaaaaccaaccgcagcagctgccgctgccgctgcagaatcctggtcggagcagaggaggaggagaccgaatcggagacggagaagaagaagaagagcggaatccgagcggagcaacaatggaaaggagaggagagattcttgggaatatctaaaaaaaccgagtttaatacggaggaggagattattaagcgaaggcgattttgatgaggaaactcgcgaggagaggagagagtatttatggaggatggaagagcacgtggtgattgagaccacggcaccagattttttttttcttttttcttttctcttttttttttggttgagacttttgggaattggagccttgaggggtcacgggcctaccactttacaagaatttcaacccttttttgaccagtttaggtgaaatgcttccaaaaaaatgggtagggtgaaagaaaaggaaaatctaggatgcacgggagggttattaatctgtgtactgtgaggtattattttcattaaaaataatatttgccacgtaaaaagtggttcttttgacgtaaggataatatacgacattatacatcgagtcatactcgtgctcgatggatggttgtatgggtttgtctcataatttgttgctaaacaccataaggcaaaataagagataaggcaaacgtgcacggtagagttgtgagtttgggtactgttgggtttttttttcgtaaagaaaaatatagggattgccacataaaaagttggttctttagcaataaaaaattgtttcttcaatataggataatataggacatcaaataatcgagttgtaaagtattcatggtagtgctaacccttatgctaggtggatggttgcgtgggctttatattggtgcacataagggtgcacggtagagttattagttcatatatggtacgtgggttctttttctttgaaaaagctaggattttgctctaaaaggcggtttcttgatgtagcacattatacgatagtatacgtggagtgatagaatactcatgacaatgctagtcctcgtgctaggtggatgaccgctgggttctatattaatcatcacgacgtgttgctaaaagttagtagggtgaaagaaaagaaaaattaagggtgcacgatagcgttacgaatatagctatcgtgtactccttttatcttatccaaaataaggaggatttattatgcaaaaactggtttttttgatgtaggataatataggacagcatacgttaagtgttaaaaatacttgtagtcatgttagtccttgtgctaggtagatgtttggtaattaaaaacaagttggtgaaataaaagaaaaaaaatgaagggtgcgcgacatagttatgattacagatattacattacttatttttcatgaaaaagtaaaatttatcacgtaaaaaattgtttcttcggcgtaggataacacagtacatcttacgttgagtgctagaatactcgtgacgatggcaattcttgtgcatggtcgatcgctgtgtgggctcagtgttggtgcccatttgatctattgccaaaaaaatattgagttaacgatgtagtaggagctctctcgttactcaggattactttatgtaccataggtagggataattgggaacattaatatacgagtggtggcctgcgaaatatatgtacttaaacaaacttttgagcaatctgccaatagaccacttcaacatttccaatgattgctaattgttgctaaattttatgattagaagaaccaaggagggggttaattaaggtaaatatatatacgtcgcctacctatggcatgacctccctccatttggtatagttgatgtgccaggaaagttgcaaccatatgccatttctccaacattttacactggcatggctatttctatctccccagtgaaaaaggcagcatgaattctactccaaaaacgaaaagaactactcctccagtaaagaaacatgttttttttaatagaactataaacacatcaatgtacttttttgggggtggactttcctgcaaaagtttggaaaaggtagaggggaccacatgcatgaggttgctgtatgggagtaataccttttcttttagagcaagtttaatagttagccaactactagctccaattcatctatagctaatctaatagctcattcatacaatagttatatactacactattaatatctggtcccacctgtcatacacactgtgtcttggagtccgtgctacagctgactacaaatctatagcccggtgcccttctctcttctcatttatctgcttaaaatatgtttgcagctggcttatagcctgctattttacctgctcttagcattttaattctccattaatctcagagccaatgctggggccttgggagaacgagaccaggagatgtgatggtgatatgaggtcatccattatccttatgatattcttttcctcccctaagaaaatatctccaccttttcttaattaatctcaacaggccatatatgcatcaagaacaattcttccattctgtgtaaaataaatatatatcctggttgttcttttctctaggaatgcattatatatataatcaattatatcatagtatagtatataacataagactatccat

SEQ ID NO: 102763 - DNA, 1044 bp, Oryza sativa
caatattttctacgtttttatgttttgcaaaatagtgatactagcagactaagctcgataaattgaaagaagtaggacttctaccaatgctagcgacactgctaccaaaatagaccgaacgttcagataatgaggttccttgccgccctctgtaagggttgcaatggggcaaatgtaattttcgccatgccaaaaatgcatttttctagtttttttccatcgtatctgtccctcacgtcaccctgccgtccttctcgagaacggcagggtctacttctgtaaatattattaccggtacaatattttctgtaaatattaaaaaataaaaatgaaaaaaaatttccgttctctagctgtctagcacaaggggtatttccctctccaattgccctgatgggccggaatcccagcccatccaaataggccgagaagctcaatatgggctctacttacacttgatggtagctttttttttttcaaatttacttttggagaaacaattacttcctctttctcattctgagagaagaagaaaataaaataaaaataaaaagtattgcaacttggcactgagaagtgagaacagatagaaaaacatcaggaagcacaaagggtggctaggtggagcagaagtgcagaacacttcgtttttccagtgaaaaggatgtagtgtcctttcttctgctcatgataagaggattcctccaatcataatctgaagaaaaaaaaagtttcatcttatctagaatgaagctataggactgtactacaggcagtagcagtacaaaagacattagtaaaaattcccagcttaattaatcagtttgtgtagctttagttatattatgtcattatatgcagagcacagtattttggttgatcattgttcaggcataaaatctgttgatgcagcactgcagtgacaaaaagaaacaagagaaatcgaattatatatttatatatctggtaccctaccagaactatataagaagcgatcaaaagaggcagagtgatgatatgcatgctcatggttggagcataata

SEQ ID NO: 102764 - DNA, 1560 bp, Oryza sativa
agcagagaatatgtccccatatttagtgggacactaggtgagaattggtgaaaagacattacatgatgacatgatgagcattttttcaaacgatggtccagcgcgtgttagagattcaagcagcaatgaaatgaggaggagccatagaagggttttgtgggacacattttccagacgtagttcaagaggatatttagattctgataccgatgatctgggattttacagcagatggctagaccttggtgatgaactttttgcggatgagattgaggaggccggttctttcatcggagacgccatggttcaatcagagtaagccagtattcaagatctcgggtaattgtcatgcctattgtgtttgtgccacaattacacatttggaataatgttgttggtgctatcataaccaaaaggtggtcatgaaatgtaaacgtagggttacactggtttgaattgtcacctaatataatattagtagtacacaaatctgcaacaataataacttcctctcttatctgatcagtatatttataattatgtgaagtaaaatactttttctctgtctgcatatcccgtctcatgcaatttcacactgtccgatgtggtcttactcctggttcattgatgtgctgaaattgctgttacggtctagtgtcagcattatctgccgcttgatctctcatgcaaacatatcattaacttggtaatgttttctgttacagattagggagcatcggcgtgctgtttttgatagcggtactgaccaaagtaccgttgcttgtcctttggggatccaccaaattggcagatgcacctgtgattccttcttgattgctgaagaatctagtgcccgtgcaagtatatcaagaattgtcatgttaaccgaggcattatttgaggtttgttcgttccctatctttctaaaatgtagctccttttgtatcagtattctgatgatactgtttcttctgcatggcttacctattgtttgcgtgtgtgttcttttttatgtttctttctttttttttgtgtgtgtataggcttggccagcccaaatcattgaagtattgagaagttttttttgttctgtatattcaggtcttattcgttaaataataattcccagcattcgaactatgcacacttaataagatagtgatacaactgaaactatctatgtgacgaagtcccttagctgccattatacttttgcggatgattgacctccagttccatccttcaagttcaacctagcaatgctgtagtcacttatactcaaatttgaaagcattaagttaggctgcatgaactccaagtatgttcatgatttaaatttgatgttgaatacattggtcatatcaacatgtttaaatttgtatcacctggcaacaacacaatacagtttgtcatagatgtagtatcaggacaacaatattttgaaggcagtgtttcatggctatattgtgaagccaagactgagcgagaaaagcaagaatcaaactctggatttccaggcttgttatggaacatatggggaaattagttaaactaggaaag

SEQ ID NO: 102765 - DNA, 741 bp, Oryza sativa
cttgcccggttgtggttgtcatgctggctgccactgacagcgcgggcccacgtgtcagggaagcagggataaggcgcgcacgtatggggcgggaagggacacgcgtgcgacgcagggccaaccgatcgtgtcgagtccgcgtggtggacacgtcacttagtacgtactagtactatactgtatacttacatcggctgtcgatcgatcggccgcgtactccctccgtccaaaaaaaattaacaacctaggtttccatatctaatgtttgaccgtccgtattatttaaaaaaaaatataaaaaatttaaaaggacaagtcacgtataaaatattaatcatgttttatcatctaacaataataaaaatattaattgtaaaaaatttttatataagatgaaaaatcaaacgttgaacgtagaaattcaaggtttgtctttcttttttttacagaggaaggaagtacgtattcgcgtgagtagaaaataataaaatttactaataaaatagtcgcgcttgacacgacacggcaaccgaaaatccgaaatatcccgacacgttttgctcgctagattctgcatgcaggcatgcgtacgctcacgtactcctatcctagtacctactgtgctgcaaatatactgtatacgtacacagatcactccatatgtcccttttaaaaaaaaaacttggaatgaatctgcagtctaaacacacgtgtgttcagatttatccctataaattaatt

SEQ ID NO: 102766 - DNA, 691 bp, Oryza sativa
tcccgcttctgtactagtctagctagtgataaacttgggaaatgcgtttagcaagcaccggctggctgctaccctggaccctgaacaatgtcctcaattggaaagttggcatgagttaattggtagcccgaacttatggacatgtatataaatatcaacgtgtacaccgtttctcacgatggtaccgcagaacaaaagggggtggagttcacataaacaaaccattcacaaaacttggtccagtgtgttttaaaaattttggctacaggtgaaacacaaccatctttttgtcaaaaattaaaattaatttgattattttataaaaaaaacttctgctaaaccgagtagtttgtgtcctcgagctggaccaagaaatctagttctcatgaaaaccaacaggttctcgttagttttgtaaatccttgtagggagatatgtgatcggagatcttaggactcatttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagcccca

SEQ ID NO: 102767 - DNA, 922 bp, Oryza sativa
aaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaagatctattatattattaaaacaactttgaaaggaggcaccacgttcgctgtggtgactaaaaattcccacattaatcggagaaaaagaaaaggagagtccaagcagaaatacaatttaaaaatagctgaaattcggaattaaaaataagcaatattgaaataagagtccatataagaacccaataggagattaatcaaaattcagaataaaaataaaataaaatatgaaattagaaaagaaaaaggagagtccaagtagaaatacaattttaaaataattaaaattcggaattaaaaataaggaatactgagagaagagtccatataagaatctaatacgagattaattaatattcaaaaataaaagtaaaatccaaaattagcaaaaagaaaagaagaattcaattaggaatacaatttaaaattaactgaaattcggaattaaaaaataagaaatattgaaagaagaattcacataagaaccctatacgagattaattaaaatttagaataaaaaataaaataatatccaaaattagacaaaattaaaagagagttcaagtagaaatacaattttaaaacaattgattttttttaaaaaaataaaaatattaaaagaacactatgcgatattaattaaaatttgaaaaaaataaattctgaaataagaaaatgaaaaaaagattttaattaggaatacaatttataaagaaaagaccat

SEQ ID NO: 102768 - DNA, 684 bp, Oryza sativa
gtgtgggagcgaaggagtaagggcggggcgaggggaggagaaggagtcggagtgcgggaagaaggtgggggaggaggcgtgcgacggaggaaacaaagagaatcgaggaggagaaaggggtgtcgagaccgagcgctggagggcaggtttggaattatttccttcacctgcccgtgccctcattttggcagggtacatgcactgtggactcggttacctctcccactacatttatccaattaaactactgtggactcggttacctcccccactgtatacaactaggggtacttgcactgtagaataggccgtctttaggccaattttttgggttaggggtacgggccccatagcttgtattgtgaatggaccaagctgtcgcgttggcattctgccacgtcatcaccgggccacgtgcatgcgtccgttatcctccagcatggacgtacacgtacgttggatactccctaaaataaaccaatcttcaggggtgaaataatagtttattttaaaacggacgaagtacgtgtatttgtacacgatatgtatatatagctaaaataataggttgttcgttactttgcgttggaaagttctccacatcaacacgaaaaatggaatagctcattagagcataattattaaatactagcttcaaaaacttaaaaaatataatacttcatc

SEQ ID NO: 102769 - DNA, 680 bp, Oryza sativa
caaaattttatatacccgtttcaaatttgaattcgaattatatccgattcaaatttgaatttgaattcaaatattttctatgcataatatttctatacatctaaagtttatacacctaaagtttatagatccaaagtttatgagtcaaaagtttacatactcaattcaaatttgaatttgaatttattcaaatttgaatttgaatttattcaaattttatagacctaaagtttataaacttttatatatatatatagtatttctatacatctaaagtttatacacctaaagtttatagacctaaagtttataagtcaaaagtttatatacccgtttcaaatttgaatttgaattatatctgattcaattttgaatttgaattcaaatattttctatatatagtatttctatacatcttaagtttatacacctaaagtttataaatccaaagtttttaagtcaaaagtttacatacccgattcaaatttgaatttgaattcaaatttgaatttgaattcaaatttgaatttgaattcaaattttttatatatagtatttctatacataattttttctaacttttgtttttttaaaaaaaattgtggtgtactgtagtaggaagagaataaggggagaaggaagggaagaagtcggaggaggggggcggatctgatcgttgg

SEQ ID NO: 102770 - DNA, 517 bp, Oryza sativa
tcaggaatcttaatccgattattacgaaagattactcagttcattaattgtacattttttttgtacttactgttgctgccgtggagcgcgccttcttcctcgcgacgttgtccgtgcagctctcatccttgtgatcctcaaccttcctcttgcacgccggtgtcatcttggtggcggcggcggcggcggcggcgctgctcccagcgccgccagcatcgccgccgtgctggtcctcgaactcgaggttcaggtccaccatgaagctcgggtcggccaccagctgctcctccggcacgaagaagtcgccgccggccaccatcgcgccgccgtcgtagcacccgtaatgctgctgctgctgcatgtagcagtatggcgccgagccgtagtactggtcggccgcgtcgtgcgccggccagtacatcgccggcggcgccgccgccgccggctgctgctgctcctggtcattgccgaagtactgcacgccgagcagctgcgccatcgcctccgagtccccatt

SEQ ID NO: 102771 - DNA, 741 bp, Oryza sativa
ggatctatgatagagcactttcttcttcaattatataagacggtctctcttttagttaacacatctttgctaatctaagatcgggtgatgttataattagctgactttgtgctagttaattagttgacttcgatgctagtagtgtcaattaacattgttttatgtatgttagtctgagtctctcagcctctcaggtgaggaatgattccttccaatagccaagggaagttctttcacggtgaaatttctatttggggatgtaccttttctatgaaacagtagctgttgcactatagagtatagtctagtgtttaatctgtatgagctaggttgagatgttgcatttctacattgtatttttcttgacactaatttacttcccacaggaacattttgttcaagtatggctgtgtatgtaaacttagtcttaacaatgtgtatctaaaattatattgtataggattattagccgaaatgtaaaaccaattggggccctgacaataagataagtatactggtccaaactccggtgtagggctgtcaacgagccgagctcgagcgagcttagatcctcaggctcgagctcggtatgaactcgagtcgagctcgagccgagcctggactaaccttcgagcttgcagtcaagctagcctcgagcctaatcgagctcgcatcaacgcaacacaagcatgtgtacatatttcaaaaagtagagaagctgacagaaagctgtagctgggc

SEQ ID NO: 102772 - DNA, 1004 bp, Oryza sativa
aaaaacaatttgcaggtaagctgtaccaccctggttagcaattccagttatttcaaactctaaactctatttagagcacatgtgtttcaaacgcacacttttttcatatgaaagttttcatataaaagttcttcgttgaatgtttttttatgaaaattttgagataaagtttttttggatgaaagttttgcagatgaaagtctttagaaaaaaactataagctaagaatgcaagtgcgctaaatagctgtaccccttgtattgtgttcttcccccagatttcctaactcacttctctcgttttccgcacgcacacttttcaaactgctttgcaaaaagtttctatataaatgttgttttaaaaaaacatattaattatttttttaaaaaaatagttaatacttaattaatcatgtaataatatgtattttgttttgcatgccgagaaagaggtttcccaacccctcatctcgaacgcaacctaaatagagtttagagtttgaaactcctgcaatgcattgcttggctgcacaaaatacctcaggctgtgtttagttcagcgtaaagtttggattttgattaaaattagagatggtgtgactgaaaaattgtatgtgtatgacaggttgatgagatgaaaaagggctgaagtttggacacaacctcagtcttcttactcaacagagtagctgtagacagtacaatggtctaaacagatttgatacggaaatcaaatttacgtgtcctccgcatgcaagttgatcaaaaaaaaggaagtcatggccggaacaattcactgaatattcgcactgggaagtagtatttttttttcgagaacgattgctgttgaagaagaagaatatcatgcgtggacacactgattggcctgacaaaacatagttagcaatttgcattaggccagtcacaatggctagtgtcattgcacggctacccaaaatattataccatcttctctcaaatgaaatcttttatgaaacaatcccc

SEQ ID NO: 102773 - DNA, 683 bp, Oryza sativa
ggtcatctgcattactctagcttaaattcatccttctaatcatacaaaaaatatccataatatatatgtcgaatcatctataaagaacatagccatagtaccactagtgaacaaagagtccacaatcctaggcaaccacttagggtttattcgattcacaggattttcaaatcataggaaaaacgtagaaataatgtaggaatgcacgtgcaaaataaaggattggaacataggaatttttcctacactgagctaaacaaaagaggatagagtagatattttcattcctatggaattagtacattttggaggatttttggaggattggcatagtattcctatggaaaattttcctttaaatcctacaaaccgaaggcatgaatagtgcttattccaaaggaattgagatttcctttagaaatccttccaaactaataaggcctaggttcccccacttcacctgtgtggttgtgcgtaataaaaagagtgagaggttgtttgggtagtggccgcagtttgctacaccaaaccttagacgcgccacaatttcttaggctagtggctggttgagtgccatagttgagttaagctacactttattagcacaatggtccacgcgtcatatttttattttctagccaaaatttaccatggttgtggccaacaaacactttgtatggctt

SEQ ID NO: 102774 - DNA, 711 bp, Oryza sativa
gggagtggatcaatctggtgcagaaatggagcatgaaacacgtgatgcctgtgagggtattgacgaggtttctgaaagtcaaagcggtaaaagcatgagctattcggcgactggagagggcacagagaatgcaaatacagaggcccgaggggcgtcttcatcgcagggacgcaatgcaagccgtggttcaggtgccgtgccgaagcttacaaagcgtaggagaaaatcatgactcatttgcagcagatcatgcctcgcacatcatgccgttttgttcaactgggcaaggtcacgtttcgatttgttcggcagccaatgagttgcgggcttgcggcgttgtcgtctgtaggccaagtctgaagactgaacaaaatgcaggtcggcattctgcacaccgttttcaggctttttcaggtttctgtccattgtttttctaggacagttatcgtatatcggtgtaaactgattgaagtgaacatttaaacctgacgtgattccttgcatcaggatgtatgtgtaacgcaggcttaccaacaaaagcaatgcacccgatgaaaatactgataaaattgaaatacacccaaaaaaactgacaattgttctctatctgaatatgtttattttttcatcaataagttcgattatacagtaatactatttgtttgtttttttaataaatgatgttgttgacttttaaaagggctgcaggaa

SEQ ID NO: 102775 - DNA, 1171 bp, Oryza sativa
tttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatataaaagcccaaatcctttgtttcaaagagctaaatagagaaaaaaaccattaaaatttgaatcctataaaatttatatgtaaatccattgtttagagggggtcttaatcgatatatactaaggctgtattcggcacccctttttcccaacaactctccctcgttttctacgcgcacgcttttcaaattgctaaacggtgtgtttttttgcaaaaaatttctatacgaaagttactttaaaaaaatcaaattaaccctttctaaaaatagctaatacttaattaatcacgtgctaatggaccgtgccgttttctatgattactgttccggatgggagcaagaatgcccgaacacagcctaattgctctagtctagtgagatacagtatatatataactagataagcttggaacagatcttgtttgcaatttggagcaagtgagatatgcaactattcactaactgaattgtggtcctagcgagctcgggggtaaaccacaaagaaatca

SEQ ID NO: 102776 - DNA, 703 bp, Oryza sativa
ccaatcttcaccacgctatccccccccccaatctccactacgccatccccacctctgatctccagtgtgccatcctcgtccccaacctttgcctcgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaggtaatttgatcgaccgctatagtttaggaggataattcatattttttttcttttttttccattacacaaaagacgtgtatgcaccagcaccattataactatacatggtagtaaatgtttccactaacaaacgtttaaaaaaaaaggtgaaggccaaactac

SEQ ID NO: 102777 - DNA, 645 bp, Oryza sativa
cagaagtagtagctgttatgaaaaaagtttagaactttgttagaacttggaagcataattcatctgctgctagcctgtttatactggtatagtggtatgatctcagttcagatcgtgcaaagtcttgtgtaatttgtaattagacaatgctgtcctgagccaagaataacagagctgcggaccaaatagggatatcttgttgaaaggtagccagtgatgttcagtgttgtcgcaactgggctcaataggcattttgcagccattgttacctgagcgacttgggcctttttagtatttggattatacctctaaaaaagaagtatttggattgtagtatagtacgtcatactagtatcagctatgtcaagcgcatatcgttgtagagagttaaaattagtgctccttcgttaaaaaaaaaagaaacagtactctgaatatgtacacacttttgtaagaagcataatgtataatcctgtgaacgcatatgcaggaaaggaactatttttaaagtgtgtcttattgaacatagacaattacatcaagatgatagtataactatacagagaatatttttagcctatgtattgcaggaaaatcagctaatgttttttatacttatcaaggaatctcacgcacgacaaactg

SEQ ID NO: 102778 - DNA, 552 bp, Oryza sativa
tgtttcttgatctaagagcaggtacagtagcatgttataagtcagctataaacatattttaaagtgataaagaaagagagagaatagcagcggtttacagatttgtagtcagctgtagtacggactccacgacgtaatgtgtgtatgataggtaggaccagatattaatagtatagtaagtaactattgtatgaattggctattatattagctatacataatatgaagctagtagttggccgtactattaaacttgctctgatgttttgatgttccttatcaaactcacaagtgccaaaatttgatgacatgtccaaagaagagccaggatcttgtcaaacacgcatgattgacaccacggagatccagcacgtccgggctaacgtcggtctccagcacgtactagtagtagtcctccactagcttcgcagcagcagcgacgacgtcatgggcacgccctggacggcaaccaacaggagaggagcctccgcgcggtggaccgccacgaaaacacaccgtaattcctcctcacctcctctgcatgcgtgcgag

SEQ ID NO: 102779 - DNA, 565 bp, Oryza sativa
atgtttaaattcgtagtcggttgctacattatgggacgaagggagtagcgtgttagacagagcgtgacatgatccaatgtaatactctctccgtcccataaaaatccaacttattatcagatgcgacatataaccaagatatgtcacatctggttctaatttgttttttacaggacaaagagagtaatgtattacagcgctcttctgttccataaaaaagttaacagtaggtattgaatgtgacacatatgcagattcattattatattagcatgtgtcacatttaattttagggttttttttttacttgagggagtatacccacagcttcaccgcgatgtacgccccgccagctcacggcatcgtttcgcgcccaaaggccaaagcgcgcggccgtccaagccgcgggtggcgcacggcacgggtcgtcgtcttctcgtcgctggcgacgcgcgtgcggaggcgagacggcggccgctaggcggctcggcgacggcggataaagaataggggaagagagggcgagggcggcggggcgcatgggtagcaaaactcgaaaaggcgg

SEQ ID NO: 102780 - DNA, 696 bp, Oryza sativa
cagctggaaagacggacaggtaggcccaccccatcaccccccatactgtgccataaacattacgctgcgcgcgtacctaaaaaagcagcagagaggaagaagaaaaaaagagtttgggctgaaaaaggcatcgagagccacgcaccggcagcacgtcgccggccatccgtcctactaccaccagcagcaacagcagcagcagaggcaggctggaccgcggcgagagagctttctattcccctctcgaaatcggcagcgaaagacgacgtcgtcctcgtcccacccgcgcccgcataaacgctacagtggtggtggcaccctgcaccgcccaacgaacgccaaaagcaggctgctcatttcaaaggcggaggaggaggaggagaggagacaggaaagccttccatccaaccatcgctgcccccttgccccttcttggcctcttgcggtgagcctctagcttactcctcctcccaatctctctctctctctctctctctctctctctctctatctctctctctatatctctttcttgttctagcctggtcgactcgtcctacctcactgcagcaacactactggcattgcgagggtggcgtggtgagctttgtgtgggcactcgaggaggcacgctggcccggcttcctgactcctgggtgctgcggccattggaggaggacggagtacaccaccctg

SEQ ID NO: 102781 - DNA, 635 bp, Oryza sativa
gccccaccagaacaactctttagtagaaaagttcagtgtaaatggctcgacgtataaaaattgacatgagcagtttctccgaaaaggattacttaaacaatactagcaagaaacgtatagtttaatttttttctcttttgataaatagaaagagtgatggatagcacacaaaaggtaaacaggggaaagttgtttcctttcgctaaaagaaaggtaccatctccaatttcttgttggactttctgtactaaatctccaatttcctaaatggttgtaccaagaagtaagaacacaccttaaataacaagtcttttgaaatatgattgcttatgtgacccattagaaagatcaatcaagaaagtctgaatattaccactaaactagttagttggtttctttgtgataccaaaactgtaaagtgatataatcattcgtgtctataatgatgagaactttactacatgtatgagtaaagaaaataaaatcaaataatttgacctcaaaacttaattgtttatatttgtggagaataattgtctagttttccgatgaagggaaaattgcaggatctggccaaacacataaagttggatgaccgtgtatacttatacttcttagtctaaaaatgctaagaa

SEQ ID NO: 102782 - DNA, 1004 bp, Oryza sativa
ggagtcataaacatttacatattcccccagattttggactagaacggatttacaaatccaccccaatcatcagcactgtttggttatctttgagttcaatttgactagagatggtgtgtgatgatgtcaataagaggcacgagatcagacaagggaagcatcagtaatcagacgcccatgatgattgtacatgtttctgtctactactcagggttccaatcccgtcatgcacatgtgtaacatgtggaattgctaaaattactcctatttgtaaagtactcctacatctacatgcagcgtaagataatgtcgctagtgtacaaaagatactcgatccactgtggcttttgtttgtgctctgcatggaaattagtagagcttgtgtcaaattttagagccaaatttgcccctcaacagattaccttgcgtccttgccaatggcacgcaggactctgaatcagtaacgagtggtttagcatggcaaatcatcaaatccccgacctaagtacatggccaatatttctcctaaattcctcccaaacctaaaagtagagggttttaggtgaaaaaaaattgttccaattgatccttagtagcatgaccaacaccctccttaatctaataactagcatgatggcccgcgcagattgcgccgctagtatcattacattttctctcatataatagcatatatgttttctcattatattattaaaatatattaaatgacaacataattttaaattttgtaataactttacgaaactactaatgtataatatttatattgtattttatatatgtattagttattaattatttttaatatcaaattttagttatttgtaaattatatatatattcctatatggacactagactcgtcttttaatatttctttttttaattctaaatttttattatttctaattgtatttctatgtggactctaaactcatctttcaatattctttaatttttaatttcaaatttcaattacttct

SEQ ID NO: 102783 - DNA, 683 bp, Oryza sativa
catatatgatctatcacctgctacccttcgacagaattcttgaataatctgcttatcagatctgaaaaagaccctcctttcattttttaaaattaattagaggaaggttttcttggttattgacttgctgtaaacatcagggtagcaccctctgaacattctgatacgggcttttgattaacgccgttctgtaactgaagtcaaaatcggcttctgtcaaagcagcccgttatgttttcactttctcatttctgtatcatattagtactgtagatttggatgacatccacacttccaatgtcgcgttcaaattaatttagtgaaaatttatggggctgttcagattgatgtcattttcataatatcattttttggcaaagttgcaaaaaaaatgtttacgtttagtttgttgtcaaatttgataaatacataagaagtcttgccaaaattttagcaatattgccatcttgttaaaattttggtaatgccaaaatttggtaaggtttattttggctacaatctgaacatgcccgtacgataagtgtacgataaaaaatactactgcgtattagtctttttgtgctcaaccaacaagaactgcatcttcaaggctgctaaagtttcataattccgttgtttcaggatagctttataaaggaaagtagtgttccactttgacaaat

SEQ ID NO: 102784 - DNA, 685 bp, Oryza sativa
ggcgctataagaaaaataaaaacccatgtgagatttgtatgtcagtgaaacaatatagtattcttcttatttctctccccatccttcgggtctcgagtctcggcggcgacaaatgtgccggcggcgtgcggggtgaggacatggcggccggtgtgcggcgtgcctaacgacggcggcgaaggaggctcaacagtcggcggagccacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataaagcattttcaacccaagacaaatttattaagaaaatgggagcg

SEQ ID NO: 102785 - DNA, 637 bp, Oryza sativa
tttatcatagtatttctactatcttttagctgtcatattttttgtttttcttcaactttgttgcggttgttttttgtatgctggaaaatataaacaaaatagccttctaaagtccaattcatatatcattttactgattttttttgagagatgaaataacatagggggagcaccttcaaaagtgtgacctttggtatctatatcactgcattttatatagcctaccatgcatatgttggactcccttggattttttttttaatttttacacattagctttgtgattacatacagttatatgtcaatacatgtcaggttgtaacaggagtaatatttcacaatattatacttgatatataatacatttttaccatattgttctcaagcccaccttgcgctacaattgtttagtacttcagtgcagtaggatatcttaagccacgcaagcatttttttcccctctttgatgctatcacaactcatgtacagtaaagcattgtgctgtttcattagcttacactctagtcatgcttctctggcattctttttcctaccctgttgatgaggttcctgtatattgttaaaaatccaagctttgacagaggaccttctaattttccagcttgcgaatagaacc

SEQ ID NO: 102786 - DNA, 1123 bp, Oryza sativa
aagaggagagaagaggggggggggggggggggattgcggtcgtctctctgtaactgagcatacattaacatcatcagtaatgtgtcattgtttgactgtattatcactattgatcataattcttgtgaaatgcaaagtacgaagtagataagtacttttattgagtgtactagctagatttcagtttgctatggtggcaagcttagttgtgatacaaatttgcggacgttacccctcagaagtttggaactttggattgtgcatagcttgaaagcatggcatattgacatgaaaccaggggcggatccaacgtggtcccccctgcacccataaaatctatggatacccccggaacactcccccctcgattttttcaccgtgaatgataaagtaaaggttcttaaatggctagagattgaagatactatgtaactgagcccctccaatttttttgttcctggatccgccctgcatgaaactatgaccgcatgaatcttgtagtgacaaaggtagtcttagctgaaattttgccacaatgatccttataaaaagttatttttaataatgaaccgtgccattcagtgcctatatttgtagcgctaaaacgttatagttaagcaccatcaagacaacgattcatttcttcaattagtttttggcacgattcatttttttaaaatacaattcttttaaaagggttagtttgtcaaaattttgggtaatcatagtcctggaaaatattgtgccatggcttaaacaaggtgcctcgacgtcgattttgggaatataatgcatggacatatctgtgcagagtctcaagacacgagttttttggcatatgtagtatcacaaaaaatctgtacagaacctcaagataagctctctctcaagccaaatttaaactgtaaacgaagtgcaagtttataaggtaaatcaaggcaacatgtgccctgtttgattcagattatcaagcagattattgcggtggatgcaggtagaccagctaatgggctatgagagaaacaagagtcatgtttgattcagatcatcgatcagattattgctgtggattcaggaagaccggctaatgggctaccggggaaataagttcagacacaagtca

SEQ ID NO: 102787 - DNA, 682 bp, Oryza sativa
  unsure (1)..(682): unsure at all n locations
tttctccatctttggttccaatttggcaatgcctttgaatcaatgtattgttttagattccagatatggatttatgtgaaggtgcactgttttgttatttttctttgatagctgtgtacattggaataaaccatttgttttcaaatgtatttgttctgacacttaatacattgagctgtatgctccatagaatgaaaatctaaaaagggttgagctactattctaactaatgttgcttatttcactatttttcagaaaactctgcacagtgcatggaaggaaatatcaaaattacgagacaatgtcagttctaaaaggagcaaactccagcttctaaaacaaaagctcaaactgttcgctattcttagaagacaggtaaaagagattatatctattattgttttagctatttatgcagtttgcactaggatttggtagcatttctggcaaagttgattgtatctaagtgcttctatttgacatgttcagatatactatctagacgagtggtctcatattgaaaaacatcattcaagtgctttgtcagcagcaatcgaagcactgaaggctagtactctccgtcttccagttgttggtggtgcgaaggttaggatttttttcataatacaatatagttatctgatatgatttgatatacccctttggatagttntaatgtttc

SEQ ID NO: 102788 - DNA, 566 bp, Oryza sativa
gtgcgatgaattaacttgcgtcggctggagtggagcgtatgattggagtggtggggagaaattaactgcgtgcatgcatgcaccacagcaccactggatcttttcttttgctgtggattgaggcttaaaaatcctgccacgatgaagctcttttgcttagcttttaattaccctgttaacatgattgggtttgtgaatccacctgtgaaaaagatcgataattgtatgcggtgatcagacaaaaggtcggccactggtggcgttacaaagatttgcaacactaaccgtggtcggttttaccatgacgtttccgttgcagagggaatggatttccgagtcagtcaaaaatcaaaagcggcagtgcgatctctctcctaggggagatagggcccacccaggcgcccaactctccaatagttaagcttatccggcaaagttagaatacagtaacagcattttagcaaactgttcgagctagcgttcttctcaacttgtggatcgatccatccattttgcatgggattaatctatccttttctgcgtcaatttgtgccgatacaaacacg

SEQ ID NO: 102789 - DNA, 596 bp, Oryza sativa
atagagcgcgcaatcaagctaattaatcgatcggaaggcactaaattagaattaactactattatactaattttattttttaatatatagcgtcgttgattttttttacaaacatttgatcattcgttttgttcatttcctttacaaatataaaaatatttaaggctctgtcctcggcacacaaaacgaagcagcgttttagtgcgtgattaattaagttttagctattttttaaaaaaatggattaatatgatttttttaagcaactttcgtataaaaactttttgcaaaaaacgcaccgtttagcagtttgaaaagcgtgtgcgtggaaaacaaggagtaggagttggaaacttgtagtaccgaacggagcctaagtcataattaaagaatattcgatgataaatcaagtcacaataaaataaaataaaataataattgcatatttttaaataacacgaattgtcaaacgtatcttaaaaaatcaacaacgtcatatattagaaagtatcaagttcgtactatactatacacaagatcaatcattttcataacaaaacccttgtacatgggtagtcttttccataagggcaact

SEQ ID NO: 102790 - DNA, 729 bp, Oryza sativa
ttgcagtgtttgcatggacatctaatttcatttgtcttcttagctacaacatttttcttcgcagctttcataaatatgtcgactccttcaatatatgacgcacgatatctctctctacgcatccatgatctatctgccatcgtctatgcattgagaaaaaaaaactaacaattagtttaaatagttttaataatatgtcacattaaaataattacgctaatatgtaaaaaaataaattaaacattgtgaaaaatattacaattagtataaacacggaaaatttaaaactatattatgacttcattttttttaaaaaacctaccacccatattcccaatacatgacagctagacatacaactagaaaaaactagacaaaattaccaaactaccctctttctttctctcaattctcttccataaccagatatagatctaaagtgcacaaaacaaccgtgccatatagatcttctacaaataaacctatcaaaacattgcgaaatctatatacattgatcatgtacaatatatcataaaaattttgaccgttttgagcaccacaaaacaaatcaaaacgaatatgccttggaaacttgaccttgcaaaatctcaacgtagaacggataaaaatgaaaaaaaacttgagaaatggagtactataaagtataactaacctttggtacaaaagatctatcaaaccattcgagttcaaaaacttctcccctatgtt

SEQ ID NO: 102791 - DNA, 669 bp, Oryza sativa
tctccttgttaacttgggagaatcaaatcaagggcatatatagggatgagtcttcagtcatggcaattgcatttgtctataagttaaacttagtgccccgctattatcaaatttaatagcactagatatatttaatcttatacttcggtcgatgcaatgtattagtacacttacaaattataggcatttaagttcactggaatgtctgtcgagcttcttcactgttcacagaattcctcttagaatggaaaaccttattcagctgttctgtttgtacgtatctcttccatgtggagattctgagcgcttagcaggttcagataaatcttgtctttgaatgctggatttggaagttgtgttttatccattggcgtagaatgttttatttacaagctgtggaaagccttgatggtgtctatgggtttcttgtttttgaatttagtagactaatgtaacaaatggtccttgattggttgcccatgccaccagccaaggctctgaggccttgttaacaaatggtattgtatttattttttttcatggaatacttgcttcagtagtgatggttaaatttttgggtagaaaatgcctctgtgtagtgatgtactatttacaatttttttgttgcgtaaagatgaaatttgcgctgtatgttatgcaagtatatat

SEQ ID NO: 102792 - DNA, 690 bp, Oryza sativa
aggactaacccatgagcaccattaccaaagaatggctactgaagactatcgcggagcttgaagaagagcgagatgctacgccaggcgcagtgaacgaagacgcggcgatggcgctcgctgcgatgaagctagcgctggcatcgctcgaagcggagcctgtggcgtggctactgtcaggcggcggcgcaaaaaacaacgtcagcttcgatagtggcaatgcttatgccgcccagctgcgagaagtaacgccgctttacaccgccccgccagcgccggtatctgtgcccgctgcgatggaaattgatgatgactttgacagcgcgtttgaacacggaaaagctgtcggctggaacgcctatcgcgccgccatgcttcaggccgaacctgtaagtaatagtgatgagttaccgctggactatctgcaaggacacaaagacggcctggagtgggctgcacaattggcagaagccaatcatccgcaaacaggtgactggttgtacgacgaccaaatcgaacttgccagggcgattcgcaaaggtccggatatgcctactgttcagggtggcaactctccggtgattccagatggttgggtgatggtgccggttgagcttactccggatatgcgtgcagcatgggattcggctccgtacacagacgatgatgacaacgacatgcaggctgcctacc

SEQ ID NO: 102793 - DNA, 656 bp, Oryza sativa
atggcactcgagatgaggcaattttctggttttcttcattccaaacacaaaagccatgccttcccgagggaggttggatacatatatatagctatagttggctggatggctgctagctaattgctgcccacactagtctaaaatttgaacgcgatgctgtcctagagagcatccaaactgaataaagcataaaggagatgctagatgctgtcctagggatgctaaaagcaaaaccgaaagatgctaaaagcaaaactgaaaggatgctgtcctaaaaggggaaaaacaacctaaaagcaaaagaaggaccacaaggaccaaagaccacaaggcttattccatcactgctcacatttacagcccaattttggcgctgacagatataactttgacggttaatttttaaacatcacaaaagaaaatatctctaaatatacaaaatttaaattaactaactttgattacaaatctagccatacaaactttatgctatgttattagacatcctaaaaatattgctggttaaagcttgattggtgagagtcaaaattaataagacaaatgaagagtcataaatggatactggtctaccatgtgaggcatattaggctactacgatcttctttacattttttatttacttagattaattgtat

SEQ ID NO: 102794 - DNA, 536 bp, Oryza sativa
atatagattcttttgccacgagtttgacagtctggctcatctaatgcaaacagtattggcccatgaaagccaattgtaggaagcaaaggaagatcggttttggatttatcaagacaagaagtaagataattttgaagcatgagttctcatactccaaaactgggagacatgtgttaacaccaaaatttagtaagcccgaagtcatcattggcctagagttagtatcggcttcagagtcttggaatcggctgatgggagtcgtcaagtcactagcagttgtgttttttgtggaatcggatcaattaaaggaaatttatccaaaagagtctgagttcaaggaggatgcggcatggcaagtgtatctattaattaggaatagtttgttagttcattttatctttaggaaagtgtgtttagtgtccataaggactttatgttttccttttatctttaggaaattttctttcttgtcctagaaggactagtatctccctatgggtataaatatatacacccggggtcattgtaaaatatct

SEQ ID NO: 102795 - DNA, 1455 bp, Oryza sativa
atgcattttcaaccttaccaaattttaataaagttgctaaaaaaatggctacatttagtttgctgtcaaatttggtaattatataagaaatcataccaaaattttagcaatagttgtcaaaattttggcaataccaaaatttggtaaggttttttttttatcaaagtgaacaggccctgggtttctcgccgaggagcaataataataaataaatatcgattttgctatatatttggcgacaaattcttccccaaaaatttgacagatgtaattacagtacaatcgtagtgtaattacactgtaactatagtgtaacttgtatgtaactttcaaaatctctccgtaacatgttatttcggtaaaatggaggtcgtgggaacaaattcgtttacatatgtgtgtgctatgatttgttttcttcctcaccaaaacaaatcttgtaatagatctaacgattcaaaattatgtgaaacttacatataagttacagtgtaattacatacaagttacagtgtaattagatataagttacagtgtaattacactacgattgtactataattatatctgtcaaatttttagaagaaaatttgtcgataaatgtataggtagtcccataaataaaataataaatcgtatagcttcatcacatagggagaagtcgggaaaggccgggtacgaataggagtaggccgtaagcccgtataggcccatctatgggcttatttgtgtataatgggctgccgttgaatggctaaagttctactagtattgggggaaaagataatttcagagaaacagtctcatcggtttatgaatttttgaaacagttaggccctgtttgatttgtaaagaaaaataaaaggaaatttgtacgtatgattcaaactgtgtaggagaatttctatttggtcgtttgaaacaaaagattgagacaccaagaatcatatgagatccctatggaatgactcgagagcacgaaacattttacacccccacataacagaagagcacaaaaccatgtaggagtaaccagtacagaatgatctactgagaacaacatatcatgacaaaaccacccaatccacgtcatggtgcaggtacgaaaaatcgaagacaggctccagacggatgtcaattaatggcctcatctttttgcttacatttatacttatcaacaaaaaattaaattttcaaccctttaaagttgattttgatatttttatcgcagtttatttttcagcctttacttttagatcattaagaacacgtatataaaagttttattcacaaattatttttcgtttgtaaatatgtcgtttggcttattccatccaatggactctgtcaacaacaaaaggttcttgcccaacttcctggtgtttgctacaaggataatagaccaccaggatctacttgtgtttgagacctatgtctctgtcggattgggattcg

SEQ ID NO: 102796 - DNA, 610 bp, Oryza sativa
agcatatcaaacaactattgataaatgcaagttatatctagatatttgaatgtgcaattctcagtttttcaagtatgcaacgacataatgcattcagcaataacaaagcaaattgctcgagacttacaagttgtagatgcacagaaaattcaataatatactttctgcaaatggagtagcataagagatatcgaacttgggtttaacttagagatgtaatggaatagcatccaaatctggtttaggatgtatccagtaaattgaggaggaatgcaaaaggcaactgtagccacaacaattgtatcttaaatatgtcaaactagactcagtgtgacccatcaagctagactcggtgtgatccatcaaactagacctactagaaacatttaacttctgaacattacattgctcagattatgtcatctctacaaggcgctggcccaatgtcatctctacattatttcattttttccacagtcaggaaagaccaattgaaatagcagcccatatgaaaattgaattgagaataacttgaaacagcagcctgtagcagtagtttggacaaccacgtaacaattattatagctatgcaggtcaatgctttcatcaa

SEQ ID NO: 102797 - DNA, 646 bp, Oryza sativa
actgatgccatgcgactgctgctgctagggttgttgctgctgctgctgttgttgcttgttgcggtggccctgctgctgttgctgctgcatgatcagaggagaagggtagagagaggttgtacaggagggagaaggaaaggaaaagacagagcagcgttgaggaatttcagcaatttcgcaaattagggaaatttgtcgcaaggtagtgttccttccctgcaaaggcaacttctctttagtccctagaagtataagattcaaatagaaattgattggatagctgctcgtgcaattttttaggtgctttattataggatgaaaccacgttttcaaatctggtatgaaaccatcaggattcaggttagttgtcctaaataaagtttgtagtcatcgttgatatctttctaacgccgctggtttcgctcgattccgataaacggtttaggagaaacaacaaaaacagtactgttgaccaggtccgaaaatcaggacaccaattcgttttttcttaatatgggatttacagagccataatctgattttcctcccaacataaaagttgtagagaattttatctagatgtcaaagttatattattttctagattccgttagacggtttgcgagttacacatagaacagtaagg

SEQ ID NO: 102798 - DNA, 724 bp, Oryza sativa
cccgacgccgccgcggcgcgccgtcgtggttgcgggagaggctgtcgacgatgaggaagagctgggcagcgacggtggggaggtgggcgtgggcggttgccggcggaggaagagatgggcggcggcgacagtgggcgaggagctgggccgtagaggcgatgtgtccggcctgtactttgatcgtctcaggggcagtactatcacaatttcaagttcacctgtctcttttgttcttgagagaagttcagttgtttccaacgaaagtcaacgctttgctcctctctcaaggcctcgatacaggattttttgtttgaaaaggaggattttcggtattgattccaagtcaatggtactagttttgctcaagtaaacaaaagcacaaaacacacatacatgtcgagttctaacatgttgctagtggatgaaaaacgcctcagcttttacagttagtgtcatgaagatctgctagatttttttcttatgtcctgatgcacttgtttcctgtcaaatttctatgaaaatcacgcagaattcatacgattttagacagccccaacattacacacacaaacacaaatgcatataccatgctcaatgtcctgcttgaatctcttgtattcctacaaaacaatacacatccaatttctctttacaatttacaaatcactttactgatcattctgaaagatgatcagttgagaaatttgaggtagtccttgaggtc

SEQ ID NO: 102799 - DNA, 723 bp, Oryza sativa
tctgcgaaagtgtataactaggaattttagataatgtttggatctatcttctgaccaaagggcgcgattttatctcaagtggtttaggagatataattttttttagtatgactgttgtttttgtgtcataatctggatagtagtagattgaactgtttttggaggggttaaacagtggaatcagccaggccgcctatagacaaagttgtagaagttttttcttagctttccatattggtaaagtacaccctgattgggcgagtagaactccagttatggttgttttagtgtggacagtctgaaattctggacagattcggaagcctgctttcaagtgcaaattagaccatttaaatggcagaataaaaatatgctttctacatcaaagttgtaggtattgttctgtagattttcaaaatgtatacattttcagtcatagccttttcatatttcaagatataaaggtttgaagcagcagtcttgtgtatagtccaagcggcgttccttgttattgagttttgataggatggcgcagtaggttcacctttttcattgttttatacacatgtttgaatgtgtttgctgaggttttgtttgtgattaggtggtggtccaccagatcgtgcatgatactaatccttcgttggaggcaagtgcatgacgaactaattgtgtgattcatggattgtctactctatctatttattgctgatatatttctat

SEQ ID NO: 102800 - DNA, 712 bp, Oryza sativa
tgtggtcaccgaggcagttcgggatgtcttccaaccctcatctagggttgatgttgacccagccatagccgcctccgtcatcgacacggcgtccaccactgctgcgtgcgccaccaggaaagcccttgcctctttcatcgagaagctggtactggcacctctttcatcgccggcaacacccacacggcgacaactcttcttcctcagccgcgaccaccaccatgacggctgcgacgatgtctgccgggctcttcaccactgcccccttaggcacgacactaccgccgatctctctcccactaccgccagagctcacggccatccttgccaccggtggcctctatggcacctccgacgcctctgcatccgctctgcctgctcaggacgtctccgccttcttcatcacgcctggcgctgcatcggcaacactccctctagtgggtcttcctcctcaagcagctggtgcaccaccaccacctcctcccggctacggtggcttcatccctctgatgaccggtgctgctcctgcccctactgcccagaacttctacaacgtcgacctcaacaatgacgccaccgccaatctccacgctcaggcggtctcgatgctgaacatcaagtctctcatgcccgtcaccctcgatctcaacttcggcaactacacacaatggtgtggtctcatcctcgtcaccctcgacaagtacgctgatga

SEQ ID NO: 102801 - DNA, 1060 bp, Oryza sativa
caggagaccctgtaattgaattaagtagagaacagaagctcacaagaccttcagcatgcagagttaattttatcagacagtgacattagtaactcaattattagcttttagttttttttccactggtccaaagccaaaatcgactacgtagcagttttagctgatcaatgacgctactatgtaatttcttttattgaacatgcaaaaatattacacgtgattaaaagaatagttatacaacataaatgaataaaaggctattaatggagcataggaaaaaaaagaaaaaactgaaaaaaaaagaccaacgaaagttaaggaactactccactacttaaaagagagaaaaaaaactcctatatcgagggagggtggaggaggcggaaccccactaaactcccagcaaacccctaaaagcagcagcgccaggccgccagcaaatgactagagatggtcttcttgaagaatagactctagcaccactgaaaccgacgagagacgctagaatgtaatactcattttatttttaaatatacggtattattcatttttgaacgtttatttgattatttattttattaaaaaattaaggactatgggaatgtagtaaaaaggaacaaatcacggtttggtcacaaaccaccagcgcgctgcgcgccaaggtgactttgtactgcaacttgccgaagttcgaaacagcagcggcaggagataacacaaaatatcttatatttttgttgctgtcaaatgttgaaaacaagttgtagaaatgtacttgttaaatgttgaaaaaactacttaactccgaaagttgaaatacccatatctagtcgagttaactagattcataccaatataaatttatccgttttgaaaacaaagtattacaactcgtgaaattcaaaccgtaccattacaatttaataaatattaaagatatgactgcaattcattttagaaatttttaacaaaattatcattgtattcttccttcatttacttttcacttcccctctctctctaagttatcttctctcttccccttgatccaatgccctcg

SEQ ID NO: 102802 - DNA, 614 bp, Oryza sativa
ctaatgttggcattggtaatggtgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgcttgttagctagcctatataccaaacatgccttggcgaggctttctatttgtatatagctttttttcttttttctattgtaaggttcgaactctattgagttgattgaataaacattatgcaatttatgtaacatattgtctataaagttctattggcatgcatattcatatatagttacagtcctttagttttaaattgaaatttcattttaaaagttcattatttgtcattgacaataatgacaaaatgctctagtatgttgtttccatttacaaatggaaagtccgtttggtttggctgttactgtaacaccccaggtaaccacgtacatagaatgccacaccaaaatacactcaaaaac

SEQ ID NO: 102803 - DNA, 691 bp, Oryza sativa
ttagtattaaattttgatagtgttagatatgtttggttttaagccttaccaaactagaggatgccccgcgtgttgctgcgggatttggttaacattaatttattagataggaggtataatctcaaggagaaacagaaaaacaaatagtttcttggagaaattctttttagtagccctatccaaaattttgtagataatttaggtagcacatgtcaactgaaggggtgttcagccataaagctcttttatacggattgatgggctggatacatatagatgtgtgtggagatgggccattgtgtttatatgggctacatttggcactaaggaggcgaagagactcacccggtgactaatggattgggctctatgctgcattctatccaacgtttgaaaagcgatctaatgcattcatccaacggttcacaatttgatgatgacgtggaagcacgaggtttgagcttttggccttaactttattgaaagaagggatttcatcataattgctaagagttgaaacttctagaattaccaatattaagtaggacagcattgataatatatgcttggttcgtagatctaccattttttttttgacaccgttgatctaccaaaatttggtaggtttgaaagctacaaaaaagaaaaaaataaacaagccctgaataaccaccttacatgcttagatttt

SEQ ID NO: 102804 - DNA, 1531 bp, Oryza sativa
aactttagagcaattctacggtccttgaggagataccatgaggtaccaaaaatttagtgtaaaatttagtaccacatggtacctcgtagtacctaggtatcaagaggtaccaaatttataatagaaaaaatggtactttatggtacctcctcaaggacagtaaaattgctcataaccttattattggtgcaattcataaaaaaggaccaataatccctccaagtcatatgtgccagtttttataataaagtggcacctatgaacattacatagttgctagtttttataataaaccggtacttgtgagtgcgcccaacaggtgctgatttttattgtgaaccgacacatattggagatcacatgtgtactgattttcaataaaaccggcacctatgattctagatgttggttgtcaattaaaatcgacactcatgatgacatcactcatatatgtgttgtttacctaactttttatgaatttgtagaacttgacaagatctacaatctgtagtttatcaccttttttatttgagtacatttggatgtgcgaaaatgtgttattgtcatatctatttgtatatttaatatttctaaatgatctcggatggagacaaaatgtatatgaaagtcgtatacatatctaaactatgtctacaggttcgtagttgacaaaattttcatttaagctcattcaaagcgttaaatatagaatataaattgcgagtgagtagaatcaaaataatagtatttgcttataaaataacgagtgtttaataaaaaaaatgtttttttctttttttttaaaataatacaacgagtgtttttaaataatttagaactagtagtagcacagcagacgaaaaggctatggggcgatcgatcgcccctagcgatcggattagccgatacccctctcctccacgtggtttccttttttggcaccgtattattttcctattttaataaatttatacacctaaagtttgtacaccttttacacatttaaagtttagagacacaaagtttataagttaaaagtttatatattcgattcaaatttaaatttgaattcaaatattatttatatatagtatttctatacacctaaagtttatagaccaaaagtttataagtcaaacgtttacatacccgtttcaaatttgaatttaaattcaaatattttttttatatatagtatttctatacataattttttccaactttgtttttttattttttaaaaatttatggtgtagtaagaagagaagaatgggaggaggaaggggggagagagcgtaatagaggggatagggatgatcgatcgcccattaggcacacgcccacacccacagcagaggtcctagaggatataagtgaagactaatcagcgccacttgtacatgtgaatcacctgctagctgttgtcaaatcctgtgtgcatgcacgtccataatgcgtacatacctaccgaccggcggccggccaagttcaccgcatcgatcgagagctctactttacctagctttaatta

SEQ ID NO: 102805 - DNA, 812 bp, Oryza sativa
tggtatattctatatttgtaaagtgacttttattcaaaatttattatcacttattattattattagtattattattattattagtgctactattattattattattattattattatctcaattatataccggaaaaaaagagaaagaatagtaacgtaccttggaaaaaaaaggttatgtacgtgcatgcaccccctttaggaatggaacagaggagttattttgagataaatctaatctaacggtttataatattggacccaccgatttaagtgaaaatcgagagatagatatttttcttttttctcagattttttagaattttctctaatttattagagcgccacgtggcggtttgagagcgttttgaggaagcttcatggacttttagtatataatagataatagatagatagatttgaaaaatctcaatcaggttgagcaatcttcatcttggcatgcagaaaaaggggacacaatatatgttggaataatgggctaggcccaatttattctcaattaattctattggtccacaattaatactatggggattaatatcagcttgaaaatttaagtgggaagatctcaacttaaataaggagctattagagagcccctgttaaccggttgaggtggtggtgggacagccacgcgcgcgcgcgccgggctgggccgaggccttggcaaggtaggcaggcggctggtctctctctctcgttttcattttgtaacagacggagattgattcagtaatcaattcggttttaacgagagcgaattcattcgatggtaatcatgtgattaatta

SEQ ID NO: 102806 - DNA, 547 bp, Oryza sativa
gccgagttcaagtacagacttgacatggattctcgtatttacgataaattattcttacgtcaatggcgaggtgccctctccgattcatgtattttaaaggaacccttagagcaagtactataaggccatctccaaccctccatatcatcaacccatgtgaccccgaaaacttgttatccgacttccccaccatatgacccatagaaatcgttccgggttccaaacctaggctcttataccacttgttagagtgcgtagcctagcccaccaaccataggccacccaggtcacattgggcctgctccacgacaggcccaaccgtagccacgcaactttaggtcatgggcccccacaacccaaaattggttatatagcatcgaaagttcacgtttttttttattttgtagcacagaaagatactagttcactttaatagtacccaaagttcaccccgttcccttttttaacactcctgtcaattctggatcgttttccgttcgccttgatctatgtcaattcttgatcgttttccgtccaccttgatcgc

SEQ ID NO: 102807 - DNA, 560 bp, Oryza sativa
agaacgccagcagcaaggcccaggagcaagataaattggtggccgagcaagctacaaagactgcagccactacattggatgaggaacgaatcaaacaaatgatcaacgaagcaaaacaagatgtcttaagggagctgcggggacgcgaaactgataagaatcaagcaacaggtgaacctgatgttccacctgataagaatcaagcaacaggtcaacatgcagttgttctggatcaaaacgaagaggcttattttgaagaagtagagcagaagattgaagaaatcaagcaggaacttaaagagcagctgaagatcaaatggatcgtggacaagattaaacatcacttacaggatcagtgccccctcattatcctaaaatttgatcagatgatggatggatcccgatgggaggagatcagaaaggctctgagcctgttagaattgagtgcagatgcattgatcttcaccacagggagcacagaacaggctaaaggatattgctatccaccacgagaacctatagatcactgttctcttgttggtctctactattatacggtg

SEQ ID NO: 102808 - DNA, 669 bp, Oryza sativa
tcgtcaggcagagtcgcgaggagacatggtggtcctggagcctggaggagcgtcctcctctctcctccacagcaatgttctgcaactagcgcggtatgaacctctgaaggtagcgacgacctcctcatccctgaccgtcggatccatgctcccccacgtcaagcctaaaatgtactaccaccaccggcgagggagcagcctccaccaccggtatccatggaaccattgcagcaggcaatgaggccacgtggcccgcgggggcaccgtcgatgtcatggaggatgggtcagggaagcacgaggtagggggctggccggcatggcaccaaggctgatgctcttcttcctcctgctcatggaagttccatggcacgctcctagggagcgacatccagtgatggcaggggctgtgcagttctattgtcgactgcaccgttcgctagtcgcttcgtaaaaaaaagccatatccggccgtagagcccggcctactcacagacaacgccagcgctcgccgccacgcccctcagcaccgggatccatatgcatggcaccctcagcatgcccgaccatgcatgtacgcgcaactgctgcacagatccaagatgaaggatgaggcacatctattctcccgagtcctgatgccggtgctcgtttctgggattgtcctcct

SEQ ID NO: 102809 - DNA, 853 bp, Oryza sativa
tgcaacgccagacttggttagggacggaggtggccgcgccggctgtggttgggccccgaggcggtggtggacgcggcggcaccggatgtggccggtggtggacacggcggtgctggatgtggacacggacgaaggcggcagcgacgggctgtgcgggagtcgagagcgaaggaagagccgaagaggggagcgagacgtgtgggagagggatagtgcgtggggcccgcagttggctagcgggtgtggctggctagatttggccagttccgtgggatgtttagccagccagatggcttggccaatcagttagttagagagtctgttgcagagctttttttttttctcctatattagctataatttggctcagagagctatttggccattctgtgttggatatgctctaagagaaaaataaatatctttctatggtatgtgacgtacctatcgacaacaatacatctatgtgttgtcttcaatttcaaaatatgtcggtctaatatctcagatatgcttacagaggtatggtgtgtttatttttatatggtaaatatatacgtgtgtatatgagagtccgtgtttgcagttgtactgtgttttggggaaaaatatacgtaaattattagaattttttagagtataccttacactttctctatttttattattagaattttttagagtataccttactgtttctctatttttttagtgtgtttacactagtactgaatcttccatccgtgacggcctccaatatgcatgaaattagtgggccgtcacaaggaagtcatctcaatcgagccgaaaaagcacccgattgagatatagtcgcacaaacatgttagatggg

SEQ ID NO: 102810 - DNA, 524 bp, Oryza sativa
aattcaaactgttcaaaaaaaagttatataaaaaataaccaaaataaaagttgtaaatcttgataagttatacaactttgttgttgataatttttccatttgaaatcatttagtatttgaaaatattatttgaagttgtcatattttcaaattcaaattcaaactgttcaaaaaagttatatagaaaaatgaccaaaataaaagttgtaaatattgataagttatacaactttgttgttgacgatttttccatttgaaatcatttactacccaaaaaattattttgactaataaattgaattgttatactgcagttaattattttgctattggtcaactcacaaatataaatatttcatatgaaaaatgaaaaaaaaaatactaagttatctcaatcgggcatcaatatagagcccatcacgaatgagtcatctgtgacgggcctagttgttaccgattgatatatggtcgcacagacatattagatgggcataaaactcaggcccgtcacgaatgacacctat

SEQ ID NO: 102811 - DNA, 541 bp, Oryza sativa
tattattgaaaggtaagattattgtttgttcagaaattttgtctcatagatttatggcaaactaaagtttcgataatgtattttataataatttaagggttctatttttcttaaggtttcttaaaaaccattcacaaacaaacttttgagtaggagatggattaagtacttacgaatcatgttttttttctcgagtaaattagaaactattgatagttaattatcatacagtccatgtatatacataccgtgtagtatggccacaaattaaaaatgcgagtgcaaaatactcaaaattcttttgattaaatcgtctcgtgaagacgcatgatatagtaataaagagagggaagcatatgcatgggaaaaaaagaagaaagagaaaaatgaaaaaaagggaggggaggcgtacttacccgcgcatgtaggtacgtgcctatgtcgagatgggacctcatagtatttagtttgttttaaaatcaatttaatctaacggtttataatattgacctaccgatttaagtgaaaatcaaataataga

SEQ ID NO: 102812 - DNA, 1115 bp, Oryza sativa
tctgcaacttttctagatatgctgtctatctgatcatttatctgccctcctccaaataactgttcctgagaagactgtatcttgtccacctgaccaagcacctccccttcttcacttgaggatttctttgattcacaaacattcagctgtatcatagttgaatcttcatactgtaacttaaaagccaattctttgtctcttaatatttgtgaacactttatcttgtcttccaccaccatcatgtcaggcatcaatagacccccccttaggaacctctgtgcttggttcaccactgtacttgagatcaacatttccaatctgtcccccctcaatgactatctgctttccctccctctgattactcttttctggaaaatctgattgcatctatgttttcccctgtagatcatccaaaacctgatcactaaaccaaccttgttcagtgtaacgccctgattttcgttcgggaataaaaatcaattaataatacattttctagaaattaaataaaagttaaatcaacttaatcaagtgaattatagaggaaattaaaatttcctttaaaaattattggccgggaatattttgtaatattctttgtgccctaatgtactctccggaattttccgtgaattttcggagcttgagaaatagttttaatagcacaaagatcattgcatcaattaaaataaaaagaaaacaaataaaatcctccttcctctctttgggcccttttcggcccaagtcttccttccctcccacggcctgcgcgccccttttctctccctctcgggccagcctcctccctcggcccgctcggctctctctctccctcaagtctgctttacctccctcgcccgttttcccttctctctctccccgacaggtgggacccgaggccccacctgtcatcttcttccccaacctcccgtcgccccaaccgccgccatggccaccccgtgctccccacgtcgccgccttcctcgcgtggttccctctcccgcgcatgcgtggacgcggtcgccgcccacgtccgcgccgtttcccccacgccctgcgaaaaccgttgccatcccgagctccacttcgccaccccacgtcgccagccgatcccg

SEQ ID NO: 102813 - DNA, 525 bp, Oryza sativa
ttagcctatagtaaactaatgggtaaccaaatataagctgaatacacaatacagcaagaatcagaatagattgggtttagatccattggcgtctttatgccagaatattttgttttcaaatgctaactagtaagcaactcctcactcatgcgtcatatcatatgatattgaccacaatattgccacaacaaatagagaatgctgttacaaaaatctataacaagtatttatggtgttgaccacaaaattactactccctccgtttcatattataagactttctagcattgcccacattcatatggatgttaatgaatctagatatatggatattaatgtgtctagattcattaacatccatatgatatgaaacggaggaagtactacctccgtcacataatatagtaacctaatattagataggacacatcctaggactacgaatctggacaagcttgtccagattcatgtcctaggatgtgtcccatccagtactagcttgttatattatgggacagagggagt

SEQ ID NO: 102814 - DNA, 690 bp, Oryza sativa
aagcacttaattacttaatttaatgttagctacacactaaagcaatcactatattttactggattatagtgaacgatgatcctgcacgctgattaggaactaagagataattctcaccaagcaaaactaaattactcaaaagatatttctattataatcagagtaattaacagataaaaagaaatagaagaggattaccgacaactccggaactcctccgacttcttctactctattctctccctattctagtatacagtaaagtacaatagagcatcttataattcagctcaagcttggagtgtctgttgaagtgagtgaagtgaagtctttatatagggcatgtatgacggttataaaacgcgaaaagtccattctgcccttcaaccgccattcaggagctcatccagaccgtccctaccaaaccttgaatcggacggtgatcaccagggttcggccaaacttgggctgggccaggcggccttcaggcttggtctggttcccctccttagcctgccttatccattccttcgagcagatggcccatttgatgatgtttcaatgtagttcttggcccactcatgatatggacaggaattcacctttacttaagtctatatttcatccaatcttcgacggtttatcacctacattcaaatatacaccaacacttgtggaatatgttagaat

SEQ ID NO: 102815 - DNA, 1258 bp, Oryza sativa
cgtaagtgtgaaaaaatatcaaaaaaataaaataaaaaaattgcaactctatacagagaaacaagaatggaggcgagggatggagggaggtgccagccatgctggcgccctcctccctggggcggcgccagccatgctggcaccctcctcctgccacatcggttcgcgtatgccacggtggcaggaagacggcgccagccaccctagcgtcccaaaaaggaccatttctaggatatgtttttctaggggtctatttgcgaaataagtttttagaaaggaccaaaatgtgaaaaatccagggcaataagaccccatccaattcaaagctagatcttgccccgggagaggcgaggaggggaaaagggaacatttttagttcaatggctaagacgagaagaaaaaaataaaatagtattaaagaggtccacccaatctaaaactacactttatcatagacaagtttttagactaaaagtactcttgggatggagggagtaaaatattaagcatattattagttttaaatatactttatccattaatctatttctttcaattaatatcgtatgaaaatatttttaaatacatatctaatgataatacgtgcaagacatgaaacacacatttttttttacctcaattactagtcagaatttttaaacattaactttgcggagaactaattgaggtaaaaaaaattatcttctcctttggggaagaaaaacctcttcttggaactactatgtttagataaggggtaaaactttttaccgtgtcacattggatatacggacatacatatatatttgaagtattaaatatagtctaatgaccaaacaaaatacaaaatccgcttgtaaactacaaaacgaatttattaagcctgattaatccgtcattagcaaatgtttactgtagcatcacattgttaaatcatggagcaattaggtttaaaagattcgtctcgcaatttacacgtaatctgtgtaattagtttttatttttatctatatttaatatttcatacatgtgtccaaacattcgacgtgacatggtaaaaaaacttgactggggatctaaacagggctataatacatgtataattgtgtgtgtactccctccgtaacaaaatgaatctagaactggatgtgacgtattctagtacaacgattgtactaatacagacagatgtatgtccagattcgttataatataatgtgtcacattcatattaggttgtttttgatgagctacttgc

SEQ ID NO: 102816 - DNA, 561 bp, Oryza sativa
agtcgacctgcaggcatgcaagctttaaagcttatggaataataaatgtgtatccactacactggatgaagtgattgttaagccttatccgtggctaactggatgatgaagcgctcaccaactcctcgcagagctccttgagcggccaccgcagctcggcgtggtcggggaagtcggcgaacctgtagaaggagaccaccaccagctccgaatcaccagcatccagtgtagccccatccccaccggcggcggccgcggcgaagcccctgccgtgcggcggcgggggagcgcgcgggccctccagctgcggcatgaggcggacgcgacggcagagcacaggaggtggccccggtaccagcgaggcgacagcggggaggacgaggaggcggcggcggctgcgcgcggcgaccgtggcggcgcggcaggcggcggcggcggcggcggctttggagagcgcggcgagtggtggggagggcagcatttgggcttggggggatgtaaggggacaggtcaagtttgcgagagcctttgctttatctgtgattttgggccttgcgagct

SEQ ID NO: 102817 - DNA, 672 bp, Oryza sativa
cacagatggaaataatcaccgctgaggacgcagaaatcaagtggatgagtacctctcgtcaagtgcatcaagctgtacaatctgccatgctttcccttgatgaggaatacaatcaatcagcttcaatgtcgctggccacaagtaaaattaagaatattaggcctgaaaaagtatgttctgtcaaaacattccgataaaccgtagcatgttgaatgggaccatatgtagtccggtagttcagaaatacaatccaatccatctgcattgttgaaccacaaaatttcagagattgtccatccgattaagctccttgcaaatcataaaatgtatgtgcattgcaaaagactaaagacagtgaacaaaattgttcagttatacttgtttctaatagttgaacatgaataaaaactataataggcagctaagtaataccttggttatcaaatctattatgtgctcaatatgctttgttaaccggaggggaatagagagagagtgagaggaagataatagattgaggttttttatttttttttctatgtggctggcaggtggatccagtagttttttttattttttatgatagagttatcactgacacgtgcatctcattacatatttaattatattttttactggctaattacacataagcgccatgtctaatgaaga

SEQ ID NO: 102818 - DNA, 679 bp, Oryza sativa
  unsure (1)..(679): unsure at all n locations
ccggtgttgcctagaagtaagagttgaagnccgatatcaacaagaggtcagtgctgacacgttggtattgatcttttcaacatagtggtaaaagattctctaaaataggggacttgaccaggaatgagaggagcttcgacgtaaagttagagggacgtctcttccacttgtgaccagaaactctagagcttgatgaggccgcaacggcattggagttgatgaagattgacaaggacgacagtgatgtggaagaccaatgagttggtaggcgttaggaatccgacggcgctagcacttgaggcggcagtggcaccacatgatctggacaatgccagccctcgttgagctcctggtcgagtcccctacctcgctgccagatccatgggtgtttagattgggagatgattgttactgccttggataaggcatatctagggctagtttggtttgcagcctaaattggtcttaccaatatttggtaattttaatagtgtttagtgtctatttggtttgaagccaaattttgacaaaagcctagaaaaataggccatttcaatagttaatttaggctattttggcttcaatctaaatagaactttgtcttgccaagagtaaacatgcaaaaacttgtgaaaatttggcattgacaaaaattggtaaggtcaagttaagccacgaa

SEQ ID NO: 102819 - DNA, 688 bp, Oryza sativa
gcttgaacaagaataaccttgtcttttgtctgctgaatgtcgaacaatgtagggcctcgtttcaaacgtacctcaatactctactcatccggtccgcgagtatcactggtcgacaaatctaccagccaagtatatatcatgtcatcacaacacggttaatgcacaaattaggcaaccatgcaaattaggttcgaatttgagggagccagcctgctaggcttttttgttgggcttcttttgatcaaaaacgttgttttctttatttctctgcgtacatacgaagtatataccttatatatgtattcttttttaaaaatcttaggtattttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttgtctatatttaatactccatgcatgtgtccaaata

SEQ ID NO: 102820 - DNA, 690 bp, Oryza sativa
atctatcacattgtacgtcgttgatagtaattatgaataatttaatatatctcatttgtatatccattatcaaaatgggaaaaaaaatataaccttgaactttaattcgtgggtaattttattatcctttagaaaatcctaagtggtatcatagggcctgttcggcgtgcctagatggcagccagcagctacagtaacaacgtacaatttctacgtagttgctgctgctgcagcagcagcgctgcacagccgctgcagttgggcagccgaacacacccatatttactagtgtaatatttaatacctgaaggtatcagataccttatgataccgtaaaggttctcttgactctaagtctaaaaacaatcttggacttgtcaactatataatgttgaatcataactatcaaagccgatcaagcttaaaaagatatcagtttaaaagttctggaacacaagattctaatcgcacgaatagaaaaaagaagcaggattggaatatcgtgccatgttgaaccctgtggaaaataaaatcataggattgctcaaaacatgtgtttggatggctcaccggaaaaatataagaattttgagattatgtagtggtacttagattgagtaagagaagagagatgttgctttgaaattctcatagaaaatgtttaaaatcatttggaattgggccatatga

SEQ ID NO: 102821 - DNA, 549 bp, Oryza sativa
ccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttggctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcatatttcacgcaactttcaccgcctattttcttcttttacccccacaaccacgaccacgacgacgaccaaagtaaacaagttttat

SEQ ID NO: 102822 - DNA, 1542 bp, Oryza sativa
tttgacaccgttgactttttagcacatgtttgaccgttcgtattattcaaaaacttttgtaaaatatgaaaaattatatgcctacataaaaatatattttacaatgaatcaaaggatagaaaaagaattaataattacttaaatttttttaaaaaaagacgaatggtcaaacatgtgctaaaaagtcaacggcgtcaaatattttgaaacggagagagtactagtagtagtactattaaaaacctgttttcagtgccaaaacttttctcctgtttctttacaaaaagaaagggagaaagacattgaaatgtgctgagcacccgcaatggtaaagtaagttgctctctataaaacatgtacatctcagcaatagactagattaatagtaaaccacctcaatagtatgtctacttgggtatctatagctctctaatatattgcctgaggtttctgtatagactatcttcaggttgatagatagatgtgctatatatcttgatttaatctcttccaagtagaaaaatatgctaacatggatctcttgtaaagagtttatagataattattgtgggtgcccttacagtgccaaactgccaataaccttgatttgttttccggttctcaactaccaacaccacaaatagtgtagcttcaagttttgttgcagcaattgatagtgagcatctggagtactactcctacactattatacacaactcaagaggagtgaaggaccatgaaggaatcaatcagccactaacattatcattagagttcttttcttgggtcctgcatgacaggaatgtgcatgcagtgtcagtgagccaattatcctgctgcccatacacttgcacattcacacattcacacacacaaaaaaacacaaaagatgaatgaatgaaaggcgcatgtctggctttgttcagctgctgtttcctccccttcttttcccccatctctttaggcggattcggtgcgtgattgccccattgccattgcaatttttgccagccacctggtcagcaaaagatgggggagatgatggggctgaagcctgcatggatgtttcattttgattccttgattccttctcctttcattcatagaaaaacaatcatacatgcacatcctttggtgataatgaatttatattgctatactctacagtaattatttgtgggagtagtagtacaagtcttgctcaatctggtaattctatctacagtaatttactcccattttcacttcacttgccctgtttagtttcaaagtttttttctaaactttcaactttccatcacatcaaacctttcatacacacataacttttctatcacatcatatcaatttcaaccaaacttttaaacttactaatgaactagacacagccgtactggagtgaagtctaccagacgagtaccagagttgtgtatgtgtgtgagagaagaaatggtcatgatagcatcagttccatcagttcaatccaagtgaatcaaaacctgctttttgcatgcatgcaggatgcaggtgaggaggaggagg

SEQ ID NO: 102823 - DNA, 716 bp, Oryza sativa
atatataaaaaatatttgaattcaaattcaattttgaatgaatatattcaaaattcaaatttgaacggggtatgtaaacttttgacttataacctttgggtctataacctttaggtgtataacttttagatgcatagaaatcctatatataaaaaaaatatttgaattcaaattcaaatttgaatcggatatataaacttttgacttataaacttttggtctctaaactttagatgtgtaaacttgaggtgtataaactttaggtgcataaatttactaaaataggaaagtaatgcggtgccaaaaaaggaaaccaggtggagggaggaaggggaaagggggatcgatcgctacccttgtcgccgggcgatcgatcgcccattagcacttccggggagattgttgggtctagtctcacatcggtaattgagattgttgggtttagtcccacatgacttaaaaggtggggacggtcctcacccatcagactagtcttttgggttgtgtaggctcagaacctagtcttttgggtggtgtaggcccggtacatgaagttgtgacggcctgtggtggagtaggctcaatgtgacctaggtggctcacggttgattggctgggctgcacactctaacaccatccaaactaatcagatcatatgtccacaatttcaacactcatttggccagtgaaatttgcttaattgcataccaagacat

SEQ ID NO: 102824 - DNA, 747 bp, Oryza sativa
taagacatttcctaatacttactatgaatctggataaactgctctaacactatgaatctaaacaatatcccattcgatcctaggttcatattttggaatagagggagtatttgggatgattcctaagttgacatacctactcaaattaacttcatttttttatattagcatatatacctagcaactacgggatacactcatcccaggctaataacttatttccttcgttttatgttataagacgttttgactttagtccaagtcaaactactctaaatttgactaattttataaaaaaaaagtagaatatttttaacccaaaactaatatattatgaaaatttattcaattatagatttaatgaaactatgctggtgttgtaaatattaatatttttttatagagtcagccaaactttaagtagtttgactttgaacaaaatcaaaacgtggagggagcagtagttactgaagtattgaggaattaggctgcatagtttgaccgggtttaacagcacatggtatgatgctacaagggtccaaacaagctgataaaatcctagcagttttctgttgctgtcacagatctttaaagattacctgcatgttggaaatgattcaacacttgcattggtttgacgccaaacgatgtatggccaattgagctgccgtcatcacctgcactttgccacagcagctcgggcaaaaaataaattgacagcgtactgaatctgcaggactttgtaaa

SEQ ID NO: 102825 - DNA, 746 bp, Oryza sativa
aagacttttaacaatgagaatatgaaccccctttgtttagctgcgtgctcacaaattcggagagagatctctacccctttgctcttgtgatttccttgtgggattacagaagcggcattcgacgccctccaattggtgctcctggtccctttgaggatttttccttgattaattccaggttgtgttggttggtaacttagagtgtggttagacgaaccctcaattcaggttgtcgtaatagagacggtggttggcttcaagtatgattgttaggttgcactgttatcttggcttcttgtagctagttatcttgagttcttgatcctacgttgtgaagatcggaacaacacccctacttgggtcgtaccagcattgaaccatgacacctagaaaactaataaccattagacccctctcatatttgatacataagcatccaagcgtcatatagaattgcaatttcacatcaactgctgtagaataaatattgttcatttagatatttcgagtacacgatttatatattgtttccttcaagtttcctttgagtatttctaaatttcttgttgcaaggcgcaggtatccaagtttttaagatggctagactacaacgaacaaaaggatgtaacatactttgatgtatggtattttttgtatttataatttcttttataaagacaaacggttaaaatttaaacatggatagcgtgaattgacgagtgctggaaaacaaatggagtatatat

SEQ ID NO: 102826 - DNA, 538 bp, Oryza sativa
ccgttcatctctggtcgtccaaaatcagtgctttagcaccttagggcccatttgaattgcagggtagaaaaaccagaggaataggaaaaacataggattctgatagaaattgaagtgtaaaatagaggattgcaaaacacaggaatggtcgtttgattggagcgcaggaaaaacgtaggaatcggatgagagagagactcaaaggaaattttccaagaggttagagctcttgctaaatttcctctaaaatctacatgtaatgtgtcattccataggaatttcataggatttggaaagcttcaatcctttgaatcaaaggggcaaataggaaatcctataaaattcctacataaatcctttgattcaaaggggcccttaagattatagtaataagcagccgaggtggctggtctagattagtgagaatgtgaaaagttgagcttctactgctagtttattttctagattgtatgattaaagtttcttacaatccatataacaatatgaactatttacgaggctaaagattttgaaaaaa

SEQ ID NO: 102827 - DNA, 550 bp, Oryza sativa
aaaaaaaagttgagagacctagatgatgcacccgcataaatttcagaacagctagggcacttcattggaaagtctaaaatttaaaattaattacaccttaaacaaataagtaagccgtaaacacaaaaacatatccgagggagcttctaacaattattggttttttcaaaatctttagcctcgtaaatagttcatattgttatatggattgtaagaaactttaatcatacaatctaaaaaataaactagcagtagaagctcaacttttcacattctcactaatctagaccagccacctcggctgcttattactataatcttaagggcccctttgaatcaaaggatttatgtaggaattttataggatttcctatttgcccctttgattcaaaggattgaagctttccaaatcctatgaaattcctatggaatgacacattacatgtagattttagaggaaatttaacaagagctctaacctcttgggaaatttcctttgagtctctctctcatgcgattcctacgtttttcctgcgctccaatcaaacga

SEQ ID NO: 102828 - DNA, 535 bp, Oryza sativa
catataaaacaggatggtgtgtttgactatagaatacaaattagtgcatgctgagttgggtatccaaagcctaccatttttcctgaaacaggagctatgcccatattagagaacttttacggtacaatatactaacaatatatattaaaccctaaaccctaaaccctaaaccataccctaaactcttatattaaggagaagaggctagccacgagctaggggcctacaacttgtgggaggtttatgttaaggggctattatacacgaaaggtgttttctttgtaaacacagaaaagatctaaaatagtgaaagcaacaagctttcttgcaaattactgcgccacgtcatccaataaatgcgggcccgccgatttcgctttcggatgatacaaaccgtaagatcctttgattggcgaaatatcttattgatcctttaggaaacttctatctacttctaatcctttcacgttcctgggtacttacgctattttcaattttgcccctacattctaacgtggacgccggcctggcaaag

SEQ ID NO: 102829 - DNA, 838 bp, Oryza sativa
ctcgtatcgatcagttctatagttttactcagaaaaaaaacacaagtttgtcttccattaaaataaagcccaatctgcaatctcctaatcccataatgaattgcttagacttagtcctttacttacgtacgagatgcatggattgggaaatttgtgccataatattccatagcaggctatgtacattttcctaaactgagttctgtgatgactcattatgaacttatgcagcacattttgtagacattatgcacagccattcgcagtgtgtgaaagttcaaaacttacacacactcttgtaccttgaaagtaaatcccgtgtgcaatgcttagcctagaaaggacataaatacttctacttatttttttaaaaaaaaaaagaagaaaagagttgaaatagtagtccctagtgtaagatacatcaaaagtttataaccacctcaagatctgagcctgggtacaagaaatttcactccagaataaaaaactgtaaaatagggcatttgcaatgccaccggttttttcaatattgcaaggatgccactcgaatgacagttctagtggcatttttgcaattttctagtggcagttttgcaataacgatttaaagtagtggcaaatttgcatttgcccctaaaataaaacatttgaccgcttctacaacttgccaatctacagttaccattagactaaccttcatcagcagcgcagtagactcgcatcgttaggatccttctcttgttctggtagggaacaccgaaggaaactataaatgaaaaaccaagaaaaataaagaggggcgagaactccagtcagttgatgtaaggaatgcaggaaa

SEQ ID NO: 102830 - DNA, 653 bp, Oryza sativa
atatgtattgtaaataggtcttttttataaaaaataattatagataggttcttgatgccaatgacattgacgctaactccttcatatcagtcacttagctttcacgtgaaggctataggataatgtcaatgtgattagcactgtcacgttggaccaagatgcctatcttcgttggcaccctgaaaagagtctatttttaaaataagtttttctaaatatttatttgtaaaatgagtttcagagcaaggacaaaaagtaaaaaacaaaaaaaaaatctagatggactggtccagtgaagaagatggctccccaatccgagctgccatgtgtggatctgcaacgcaaagagtaggctggctgtagctgtaactagctgcacacagcagagtacaggacacatcatattacctctgcaggctggactactgccgctgcacaagctagtatagcggagaggggttacgtctaatcggggtcgctgaaaattgttggttgtcatgcatactccatggatacaccagtcgcaagtgtctactccagccagtgtaccgtgtgtatattgactggagactggaatcttgactgcttgtgtgtaccgtgtgtataacggaagatcgatcgtcattgtgtcaccgcaaattctgcctcaccaa

SEQ ID NO: 102831 - DNA, 721 bp, Oryza sativa
  unsure (1)..(721): unsure at all n locations
agatcctatctctacggcatggtttgtgatttggcggaagcaagtttggcgtctacttctcccatctagatttcctcaaaatcttattattaatttgctactccgtatcaatttttaggaaacttacaaaccaatgcatcntaattcattcacgctatttaataaaggaagaagaatgtgggtcccacactccttctcacacctagtaatattgatttgcagtgaaatttcggggaaaaaaaatacatatcatgtgtcagatttcgattttattccaattttaaccacgaatcaatagtactggagaggagggtgcgagccatgtcctcttcccatattaattttttatacataaaaataaactagcggaaataaattaggaatttacgatacattaatatatatcgtccttttttttcaaatttgacaacaagtctataaaatttgcagaaaaaaggagtagttcttaaatgggagaggacgacgttaaaatgttgctctgtgatatcctacctcagcgccaacatctctggtgccaagatagtgggtccatacctgcaataagttttatagagggtatatttgtaaaatattttttctagctaaaagaactaaaatgcagccaaatacattatactatattcaataaaaagtactgtcggcccattctggaataactatcgctgtcgacgacggacaataactttgaccataaattact

SEQ ID NO: 102832 - DNA, 674 bp, Oryza sativa
aaaaataaaaatgagtatatatatttatctcattgtttcgtccagaactaattataagctttaacacttgttaacaatcaaaacctaatttatgagtaatttttatatatgtatttttagtgacttagatctaatgctgaaaaataaactacgacaaaacaaagcatcaaaagaaactctaaaattaagttctataattaaaattttgcctgaaactcataagctaagaagtgaatgatagagctgtataattgatccatacaattatataataagataaaacaatagtactactaggaggcctcactagtgccgttgaccccttctgactagctggtgagccaagtggcgtgctggggcggcagtggcggaggcggtgcaaatcgggcactgttgagtggaggttgcaagatggggtgtcggggggaggaagatggaaggggttttagggtttgattatccttcatgaatctttaaacaatcggatggtctaaaatatacaagatgtctacaggggattttcttgtcaaatgatacctatatagtccctatttataatactacatacattcccatcctaagtagcaacattttgggacggattaagtacacacctttctcagtcgtaaccatgtatagtaagcacgggttccacactggcacactatacaatt

SEQ ID NO: 102833 - DNA, 599 bp, Oryza sativa
  unsure (1)..(599): unsure at all n locations
catttcaatggacaaatcgtgtgaaagagtaagttgcatttcaatctactttcttagtaaaaaactaattagcaaggcaaatgcagtcctttaattaacacacaatattttggcatgaactaatttgactcttcatgtcaataggaaaaagatgtacccccggttggaggacaggaaataccatcaggggaccacatggaaccgttacatgatgaagctttatcagagaactccaatgagctgcaacagtgcacaactagtgagagatcaagtacaatgatttctcctgctgccgctgacaacagtatgattactatggctgcaacatctgttgaaagtagtgtgtcagctgataaagtaagttgcttgtacttatttctttgatggtgaactttacccatacaacagtattgaatttgtaaaatatcaatgttgtatgccatgaatacaggtcagcccaattgaaggtcaggtgacagaagcttcagttgagcatgctcctgtggaaaaagatcagtgtgaagaaccaaacactacaatnggtgattcgggggactcatcagtatccttgaagaatgaagaactgcaggatcatgatc

SEQ ID NO: 102834 - DNA, 588 bp, Oryza sativa
tgaagattaaaattgaaagggatatttcctaataccacgaatccggatatgctgctcattagcaacttaattttcctcctctccgacccgactacgctgcactatagcccctacatttacggttcttcttggtggacgcgagctgaccgatcgaccaagccgtaaacgtttttgcatccgacgtacagtacggggtatgttagatgcccttccaagtgtgtgtttcgactaagccatatcatattttcttatgttgcgctgcacattatatagtgtactggacactgttgtattatataggcacgtgcatctatgtacgtatgttatcaacttgtaatacaaatatattcaatatatgttatcacattgtaaattgtgtcattgggttatgcgattcctataaaattcctgcattttaaataatgctttgggttgattttgggtttcgtcatatcccaattgacattgctctctctctctctccatctggtggggttagtctcacatcggtaattgagtcttcggggccacacggacatcaagggtgatgtgacgggggagaatggggtactcctaatgggcgggtga

SEQ ID NO: 102835 - DNA, 802 bp, Oryza sativa
ctatagggcgaattcgagctcggtacccatcatataaaaacactatcgtgtacctctaccatctcaaattttggttatgtttgacatcaaacaaaatatgccatagatattgatcatattacatgactcggctcaatttgaaagagattattgagtggattattgctacggattatctacataatagtagagatatattaaatattttgataaacaaaattaacaatacttaataccagtgttctaaacaatatacaattaatataataaattttatttttgaaaaaaatattttttaatgcatggaacaaataatacatttcaataatctggtgaataatatacaaaataaataaaccacgttttaattatgaggctgcttgtctttgttctgggtagaaataaacgctttataactgaacagctagatggcatgcatgttgcttaattataaagcttgtagaaggccagaaaactatatacactcaagcataattaacacatctataccgcgataatcttgtacgtgctgtcacaataattcgctgtctaatctgcataataaatatataaacctattggcagtattgagagtttgtgactggtcgacaatgacaacacttcagaatgcttattattggactaccttgtcaatctttatgctatgtgcgtgcttattttgttgatcgccatgtttaggcaataggtacagctgccttacaaggatacgtacattacagtttaccacatagttatgttcgtttttttagttaggaactctacgcacggaaaacagagcgac

SEQ ID NO: 102836 - DNA, 627 bp, Oryza sativa
atatagaggatgacctaatctagtcataaagctctcacatgtgatcgacgaccagcgtagtctgctttggagcagtattgtattgaattgtttagatatgtcttagcgtgtcttcgtatatcccctctcctcctagggtcttgtatttatactcttaagcgtcccttttcaagtagaactagggagccaagtatgaatacgatccgagtataccttgcagtgactaagtaagattttgtttctcttttcttatccggaacaccttccgtatatgaagctttttttttataggacttgtattaggtgggccccactgagtctaacacaaaagtattagagattggtttggttcgtggcttaacttgaccttaccaatttttgtcaatgccaaattttcacaagtttttgcatgtttactcttggcaagacaaagttctatttagattgaagccaaaatagcctaaattaactattgaaatggcctatttttctaggcttttgtcaaaatttggcttcaaaccaaatagacactaaacactattaaaattaccaaatattggtaagaccaatttaggctgcaaaccaaactagccctagatatgccttatccaaggcagtaacaatcat

SEQ ID NO: 102837 - DNA, 704 bp, Oryza sativa
ttaatataataaattttatttttgaaaaaaatattttttaatgcatggaacaaataatacatttcaataatctggtgaataatatacaaaataaataaaccacgttttaattatgaggctgcttgtctttgttctgggtagaaataaacgctttataactgaacagctagatggcatgcatgttgcttaattataaagcttgtagaaggccagaaaactatatacactcaagcataattaacacatctataccgcgataatcttgtacgtgctgtcacaataattcgctgtctaatctgcataataaatatataaacctattggcagtattgagagtttgtgactggtcgacaatgacaacacttcagaatgcttattattggactaccttgtcaatctttatgctatgtgcgtgcttattttgttgatcgccatgtttaggcaataggtacagctgccttacaaggatacgtacattacagtttaccacatagttatgttcgtttttttagttaggaactctacgcacggaaaacagagcgacatattttcttattattaattaattatttacttttttaaaaaatatatattaatatgattttttaaaataactttcatatataaactttttttaaaaaaagcatcgtttagcattaagaaaagtgtgcacgcggaacacgagagaagtgagttggaaaaac

SEQ ID NO: 102838 - DNA, 4588 bp, Oryza sativa
ctcgagggaaatgggcttgcttcccacctgaaggaggataacctgggaaacctgtccattttgaactgagatcgcgtgaatctggatggtgaaacaaaatcttgtgtgactgaaagaagagaccctggtaaagggctcattttcatgatgtgctacactgaaattgtaggaactccatacatgttccctcgaaaaagaaacaattcaaatatgtttgtagctaatctgaggtgaggttagacctaacaaccggatcgaatatcccgtgacccttttggaatcgttcgtgcatgagaattaaggtcaatcaagtaaatataaaaggtaggtatcttcatgttaattaagcgtcaacttaagacgaaagctagtcatccacggcactaattcattacgattatgtaaacatcgctgtgtcatcttcttcttcgatcgaaaagtgtaagctatatttatatttgtaaaatcatgtacaccaagcaaggactgaaaagaaaaagatgcgatttctcatagatgaatatagccgcgagcacaagacactatacttttgtgctttcttttattaaaaaatggatcgcaatgtcaaattgtcaatgatcttttacaagtgatactcggacattgaaggactgtagttgcatgcatttggaggtacattgtgatcattctcagctgatttatacagggaaattgagctattgcatctgttgtgtcccatcatcacaagagaaaaaaaaattctactcctcacataaaaaaaaagagtattcaagatatttgtgggatggaaatataagaaccaagcctatcagatgggatgaatgatataaacaccaaaaaacgaaaacttttagcggaattaaaagctaccctcaaattcaatgaagttctgacgaaattctgtgtgagagccagatatgcaccggttataccgcacctatgttgctagtctgacaggatgactctcgatccatcaccagcaacactctctcgaggcattaagacacacttacacataaatcaagcaagaaatcatattcgagcacaagtttttccacaacttaactcaacattaccacacaatagtattatatacgtatagtaattatctagaagttataaatatgaagtaatcatgagtatccaaacaaacaacttgaaaccaactttaatacagagctagtcgactagaccgtcgggttggctagtctaaccgcacactacccaccggtctaactggctctacacatagcaccactttgcaaataaatatcaaaaaagaaaaaccaattatctcacaaatcaattgttcatcatcaaataataattggaacactttaatttcacaattcacgcctataattaaatacctatttaatatatataattggtgcagagtttggaattctacttctaccttaagaaatgtgagtagtatgtaagttaattgggaagcgcatacgtgtgagaaccaagaggttactggatcgaaacatggttgctatcttttttttccccacctagtaagttaattgggaagcgtgtacgtgtgagaaccaagaggttactggatcgaacacatggttgctatctgtttttttcccccacctagtacgatcttgatgctcatccatcggttagcacgaatcgctcatccatcggttagtacgaatctttacgcataccagatagaaaaatattggatagaaaaatcacacggcaaatccctagcaaaattggcttttgtaatcatgaaaacatgttgattcagccggtactatcaagaaaacctcccaaaatggagtatcaaataggaaaaggctatacgtactaactttttcttactaaattcttactaacactgatatgtcatgctacgagtgcatctagattttttgtaacttccatctacttaaatcaaacggttgagatgattgttagtaaaagtttagtaagaaaaatttagtacgtgtagcattgctctatcaaatactagtactacctccatattttaatgtatgacaccgttgattttttttcaacatttgaccattcgtcttattcaaaaaatttatgtgattatcatttattttaatgtggcttgattcatcatcaaatgtttttttaagcatgacataaatattttcatatttacacaaaaattttgaataaaacgaatggtcaaacgttagtcgaaaagtcaacagcgtcatacattaaaatacggagggagttctatgctagtagttaattaattttacagcaccaaacaacaatgttacttcctcctctctgttctttatacctgtaacaataatagcaacaatagtacggagtaatatataaactcccctatgtatgtatatgtggatgtggcgctgcgattgggcgcaagtcggcgtcggtgacggcgacgcggcgggggatcccgcggagaaagatccttctttctggtattcttgtgtgggaggaccggaggaggagagcccaagggaatccgacccaaacgatgccacgtcaggcgtgggcccccaccccaccccaccgtaaaaccaatggcaccgagaaaacgaccccaccccgccggcgcgcggggaccacctggcagccactcccacgacccacacacggccggattgatttctggtgcgcgggtgcgcgtccgcgtcacgcgtgacggcgcggcgctggcgctccagcccggagggtggtggagatcacgtcactgacgtgcggggcagggtgttcgtgtgggacccacatgtcagggatgtgggtatattcggggcgatgggtgagggtagtattcttttggtgtggggattatgcgccgcgccgccgtgtgcgcgggtcgttgattcttccaagcggcttcctttgttttttcgtttttgtgcgatttttgctgttaggcccctgtacaagttgtagagcgtcggatttgctctttagtccctgaatttttgccagttgccctgttttcatttcttcttcttttttttttccctaacagacagaaacagaatgccatagctaataagtctgcgttcttttttcaactgaaaaaaatattttcctcgttatgttttttaaagtattaaatgatgatactctctcttcgccccaaagttttggtgcttatttttgtttttggacagtgtacgtacttattttcggacggagagagagtatgtttttctaaaaagctttttatataaaagtttctttcaaaaattgaataaactcatttctaaattttgtaatgacaaatactcaattatttatgtcaatgacttatcttattttacgtgcaactaaaatgttgaagattcaaacaaactaaaatatatactcgctcgtactcctcttatacaagaggcagtacaagcgtatattatactttctcttatacatgtatagctctatcaaactatcatactccatccatccataaaagttagacatattttacatttaagtttttctaaataaattattgctattcgtagtctttatgcatttaagacttaaatgaagagataaattaaatgtttgacgagaacccaaggagtcatctaaatattcattggttccatgcttgcattcactccttgattttgtaacatccaaaataatttaatttctcctaggtcttggtgacaaaaataatatgcgtaacttttgtggatggagggagtacagtataaaaatatatacatggttgaaaaaagtaaataaaatcaacacatcctagctatacgaatctagacaatattccaaataaatttctcagtactctatatatcccagtttgatcaccacataaggtttttaaggttttcccaacataatcatcctctaacaagcgcatcttatcctctaacaagcgcatctttgtttatctatgctaagagtaaatgaacatcattaaatgtactatatgcaaccaaccaaaattaatttctattggtccaactacatgcaatatttataactagatgcaatccacgaaacataaagcgacgttgctccttaaccgatgagaattaactacaggataatgaatgttttattgtccatagtctttgcgctttttgcttagagcaagtttaatagtagagccaactactagctccaaatcatctatagccaatttaatagctcattcatacaatagttacctataaatatatttatacaatagttacctataaatatatactccacctcttatgtactatagcattaatatgtagtctcacctcttatacacataatattttagagtttgtgctacactcctgtaactgactataaatctatagctcgttttttctctcttctttttatcttattcatatgtatttatagctgacttgcagcatgctattgtacttgctaatgtaagatgattaggcggaaagatcgtatcactcacttggaggagagccatcgagccaaaatggcatcttgtaataaagccctcacctaacacgataattacccacccgaggctcctgcgtcgtcctcctcttctcggctccatttttccccatcccgacatcgcatcaccgcctctctcttt

SEQ ID NO: 102839 - DNA, 541 bp, Oryza sativa
  unsure (1)..(541): unsure at all n locations
gaattcgagctcggtacccctattgtgctggcacgctcgatctcaaccgttcgttggttcatccatgatacatggcctcatcttttcgcttacacttatcagcaaaaatttgaaatttcaactgtaaattggagttggttttgagattttttttatcgtactccctccgtcccataatataagggattnntnggnnnnnctttnnggtttnaacctctnttgatgtttnattcctgtggactaaattctttttcctttattcatactaaaactaaaatacatgcccattcctcgccgataattgattgctactggtgtacactacagtagttatttaggggaatttctagtccagggttgcttcaatatgggaatttatctacagtaattttctcccattttcagttgcctagcccctctttagtttgcaaatttttttgtaaactttgcaatttcccttaccattaaccttttatacacacattacttttctatcacatcctattaattttaaccaaactttttaacttacttatgaact

SEQ ID NO: 102840 - DNA, 589 bp, Oryza sativa
tatagggcgaattcgagctcggtaccccccgtggagatccaaaaggttttttggtggtggttgttcgtctcggattatcttctggccgcaccgcacatcgggggcagctctgctctgtgagtcccctccgatcctttttgcttcgcgtcgcattattattattatttttttgcgtaattttggttgttgtgctttatcgcgtgagttggtaggtagtatcataaaaactatttaggagggttaatggttagagcctttgttgcctcaactcttgtaagggggcagtttctaaatgacatgtttgcataagagcccataccgggctctacctttgagcatgacctaagaagcacaaaacaagcattgagatcatgatcggcacagctaacaagcaactgaagtctgaagattaaacacaaaaactaacggtattttgcaaagcatattttcacgcgtcccttcattataaaaatgtattatttaccccccaacccccaccatacccctttcaaatataaccataaggagaaacagaaaactaacaatcactttgcaaagcagtacatagcccttaaacccatttttcatg

SEQ ID NO: 102841 - DNA, 617 bp, Oryza sativa
attctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccgccgccttcacgtgctccctctcctctgcgagtcggcggcgccgatctccatttgtcgaggcgagcagagcaggggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctctcctcttaattaacctgtgtaaaagtttgtttgttcccccaaaaagtttgctttctgggattactaccaggaggaggagaggggatagatagtctgtcagatgatgatgatgccgctgcgttgcctcttcgagctggcccgccgccggcctgatcgcgcggtgagaatctactcattttctttctttggatgaatcattcagctagaagcacgtcgctgtgtcttt

SEQ ID NO: 102842 - DNA, 827 bp, Oryza sativa
aaaccataatttaattcttagattcctgtgttgggtatagacaacggcgaccgatgacctagcttcttttaattcgttgttcattttgacagcgagattgtgaagtctaaaggcacggcattttccttcctagtgtttgtcgtctagtttttgcaagatcttgctttttaacaaaggtataatcgcaagaaaatgttttctaataaattaaggtagccattcaattcagcccccaaaaggaagtcatttgatttcttgtttacaccaccaacacattgatcttctatgatggccaaggtgccatgccatgaacatttgtttagagcatctcttaaagattagccaaatttcgctagccatatctctatttggctagcattaatcccaaaagatttatctcaacatttcttgcgaactcgaacaccctaggtcaaattctactctccatattagtggaacagatacatcagcctctcttagcatattctcccttttttttttctttggaaactaagtgacgactagtaagggaggatatatatagctacatttggaagctaagtgaagagatttagcatagcaaccaacataaaactccctccatcccattttaagtgtagttatagattgtcgtgtccaacgtttgaccgtccatcttatttaaaattttttatgattagttttttattgttattagatgataaaacatgaacaatgctttatacgtgacttatgtttttaatttattttttataaacttttcaaataagacggacagttaaacgttggacatggaaacccgcaaatgcatttaaaatgtgacatag

SEQ ID NO: 102843 - DNA, 1924 bp, Oryza sativa
atcttacttaaacaacaaagtgtaagaactttaatgcataaagtcaaatttcaaatctaatgtcgaactttaagtacacaatgtaaatgataaggataaataatattttctaaaatcataagttcaaaaaaaaatcatatttctgattttccaaactcctactaattagaattataatttttaatcttaaatgttagttctaaccaaaacttgatgattatattctggattttgatttcagctctttaaatattataatccttgttagttagtaaattttgttggcagtcccctcaaaaaattattttgcggctagtttgcttgtattattttaagtatcacatcttgttattttttccctccttgaaaacaatatagtcagcagaggggtgtaactagttcgacacttcgacacttcgatagagcttttacacttttgagagggagtatttgattttccattttaatttttatcttttctataaaatttttatagtacatctttttcatatatttttctaaatccgaacctctcggctataccattggaacaatactacgatgcctgcgaaaagctgtagcaaagcaaataattgttgtcacaccacagctatgctgttattcataaggtcgcaagatttgttcgcaacatatctccgatggcgcgtggccaaaagttttatcttttaaaataagtaactaaatgttttattaaaatctagacaacaatggtttgcaaaaaataaaagtttctaaattgagcaacgtaattagttctttttaatttactcgttgatagaagtacggcctactctctgtaccaaaatataggaatctggcactacattagacaccatctaatactacgaatctgaacagtacaaatctagataagagttatatccagatttatagtaatatgtaacatatgttacatgttacagtgtcaggttgctatatttagattgtatttaatctgggtactaggactgtatttagaagtagtagttgggaattttttattccacacggaaaacggtatctcaacaaactaaaaaacagtttagtatcatttttagcaactctactatagacaaaaaggtttacaacacataccgtttaataatttaggatgtgtgtacgtggaaaaggagagattaaaagttaagtaaaaagagaaaaaaacacagccaggataggacaaataaagtactccatccgtcccattttaagtacaaccataagtttctgtgtccaactttgatcgttcgtcttatttgaatttttttataattagtaatttttttgttataagatgataaacatgaatagtattttatgtgtgactcatgtttttaatttttttttaaattttttcaaataagatgaatgatgaaaattgggcatggaaaacaatggctgcatttcaaatgggagggagtccgttccataaaaaacgaatctagtgtatgtccagattcatagcactaggatgtatcacatccggtattatattgtttttatgggatggagggagtaatgtactaggctgaatttctaggctggcgaaattaaatcaggttttcacacatccgtcaatccgtcaggacaccgtgacagttggatcctgctcatctactacggacgtcacggactcacggtccattttgatcggtacatctagtgtgtatgcagtatgcacatgccaaacctttcaacgtgcaagaagccaaattaaggactcgaggatcgattgagtgcgagaaaaccaaatttttcacaggagaatcgatcgtgcacatgccaatgtcgtcgtttccctagccggggcttttcacaaagtcaatggcgcgtgtcagcaactcatcatatatactccctctatcccaaaataagtgcagttttgcactattcatgttcaacg

SEQ ID NO: 102844 - DNA, 806 bp, Oryza sativa
tgtatcatggagaagacttcccagtaagctccatactgaggctgcaaaaccattcataataacctatataagtgaaaatagttaataaaataaatattttggtcaaaaatctatttacctcttccttaattcacgtgcaactgcaacattaggatcaaactgcaccctactgaagcatgtagtgtgcaggctatggtctgaaataaaaggtacaacaattatattacataattttgttgatcataagatcgatgaacataaaattaacaaggacacatcagcttaccttcttcacgctttgctctaagcattgttgctacaatgataggttgctcattagagcatctcgcccatttagttaaatggtcggtaagcattttatccttaataactaacatcacaggtttgaaactacataaaaataaacatgtcaaatgcaaatagtgataagaaattaaggtagaaacaaaaagacatgtaccccaaaaaaaaaaagtatgtgcatacctgccatcaattataagaatattcctatatgggatcctcttcttgtagccttccacaaagcctatagagcttacaaagatgaccattccaataacatctgcacatgtgaaaattgtgttaatagaacttctatttgtcacaaattaatatttgtttgggtggttagttgaactacttaccaacataaatgtcattatggtaagtaaactcgaaaacttgatcaagtggcataagcggagggagtaatggtaatatcttctcatgcatgtttgctatctcagtaatagtagtatcacgtg

SEQ ID NO: 102845 - DNA, 538 bp, Oryza sativa
tgtggcgctacgtagcgccaccgtatatatatatatatatacatacatacatacatatatatatatatatatgtatgtatgtatgtatgtatgtatgtactccctccccctattggataatccacgagctacccagttaatcggtttgaaaaataaaagacagaaaatatctttctttggctgcatggaggcacaacggaaacctgagttccggttttggtgcaaccgcattattcgaagtattaaatgttaatcatatccctaatttcaatttatatgcttaatttagtagtatatactgtttgtttagttagtagtagtatatactgtttttaaagttggttgtagtatatatatatatatatactgtttttcagaaagtattagtatatgcagtatttttttagcatttgtacatacttttttttaaagtagaagtatatactgtttatcaattcgtagtagcatattcttttctttaagctagtgtcggtatatactgttttttatttactagcagtatatactgtttttaaaa

SEQ ID NO: 102846 - DNA, 1967 bp, Oryza sativa
cgaacagcacgcctgacaggagactatcaaggatgctgcctgatatatagatcagtgctgtctctgcacggcttgatgatggtgggccgccgccgtcgccacagaccatatggcatatgcaggctggttgattgatcgacgctcgggaagtgccgcgatatcgatggacgatggcaccagaagcaagatctacgcatcaaaaaccaaactgtttgcaagtcatttttgggaatgaatgttttgttgctatggagatttaaacaggaaaaccaaagggaactcttcatctgcaataaaagcatataaaattggaaggattaaaccgtcgcctagtagatccgatgatccactgtcacctggtaatcacggtagcagtgccctgctgatggatcgataccgtattagagttggagcttgccgatggattcactgagaaggagacaccgccagggccggggtacgccttcgcctaggtggcccatgggcagcgttgtgtgctgccatcgccacctcgttctcgacgaagaggcgccggcgccgtctgccgaggcggagaggaggcgaatcggggggccctaatgggcgatcgatcgccctgggcgatcggatccggcccccctccccgtatactcctccctcctctcccctattccttctccccttctcctttctactacattagactacacaaaatattttgaaaaataaaagttagaaaaatttatgtatagaaatactatatataaaaaatttgaattcaaattcaaatttgaatcgggtatgtaaacttttgacttataaactttgggtctataaactttaggtgtataaactttagatgtatagaaatactatatatagaaaatatttgaattcaaatttaaatttgaattagatataattcaaattcaaatttgaatcgggtatataaactttaggtctataaactttaggtgtataaactttagatgtatagaaatactatatataaaaatatttgaattcaaattcaaatttgaatcggatatttgaattcaaattcaaatttgaaacgggtatataaacttttgacttataaactttagatctataaactttagatgtatagaaatactatatataaaaaatatttgaattcaaaattcaaatttgaattggatatataaacttttggtctctaaactttagatgtgtaaactttaggtgtataagctttaggtgtataaatttactaaaataggaaagtaatgcggtgccaaaaaagaaaaccaggtggagggagggagggtggagggagggagagggaggagggggaaaaatccgattgctatgggcgagcgctcgcccagtagcatttccgggcgaatcggtatgctggaagggtacgagagcaagcagatgccgtggaatttatatggacagtttgccgatccgattattgtgggataattatgggttatcacggttttatttctctcataataaaattgaaacgggtttactcatacgatccgatagcagggctcaatcgggtgctagctgggatgaacggtggattggagcaggagtacgtacacctgagtgtatagaaccattttcctatatatatattagaaactactaccgggagtagctactccctccctatcctccctcaattcgatcactagcactagataatcctaatgactgttaacgggtctaatgaatcgaatactcccacccgtttttatttttctcggtggttaacttatcttctacagcagattcaaaaattgaacgtagcctccctagtttgtcgtagatgagatttgttcggagatgagctaacaaggagaaaattgcatatctaccatcgcataagtttggattcgctgaaataccatcccttaatcaggcttcgctagaataccatcctcaaccaggacatctttgctaaaataccatctcagacaaaaatacccctg

SEQ ID NO: 102847 - DNA, 1189 bp, Oryza sativa
agcgccatacaatagttctctctctctctatatatatatatagatatagtaaatttgtttggtgctccatagtgcccgggcaccattgttgaaattgagtatatacctatatcaaatgagtatgaaaccttttcaattatttaggtattaacattaactactttactaactagttcaaagcaagtttgaactgaatttgaacttgtttttgttagattttgattctcggtatatagcatccatacatataattagttaggtatgtaatcatgaattgtgaaataaaattaaatttgagttgttttattgataggtatatgtatgaatcaaattcttataactaggtatatactcataatttgaaaattttgaaaaatttgagtgattttgagcatttgaaaccatggtgcccgggcaccatggtatatatatatatatgtatatatatatatatgtatatatatatatgtatatatatatatatattgcccgggctccaaggtataaaacacacaaaatctctcaattttttaagaaaatttaaattgtgagtatatacctagatatatgaatttgattcataccaatacctaacaacaaaataactcaaactcaactttatttcacaattcattattacatacctagccaattatatgtttggatgttactagttggatgcccatgcgttgcaatgggaaaaaaattagggcaacttaaatcttagcgagatgataagaaataatcagttcatcgcaacagaaaatattattttagcataaacaacaattacatctgatctaatgatctttacatattcagcaacagatacagtgaaatattgtgatacaaatataataaaacaacacataataattccagggattccaggggtatcaagaggagcaaagtttgaaaatctactgaaatatcaaaaagtataaacatgaacagtaaaatacatgtataccaaaatagagaacaaagcatggcaatatattccttacttgaagtccacaaaagcatgggcaacgtacaataatagctagatgtcatgtaaaccggtacagcgaggcatacatgtgtcaccacgaaatggtcccataatacagttacaacaccaatgcaacagagcattgaccatcatctagcaaacatgctacttctagcaagattaccacctacttct

SEQ ID NO: 102848 - DNA, 3541 bp, Oryza sativa
cccatcctaaatggcaaaaaataaatgttctgaaaaccaacaaagatgtgttgctacagcaaacgataaggattatacagaggcatataacttaaccatttgtagcaaggaattggaaacttataggatcaagcagaatgccattgattaaataatgtaaactactgtacgttcatgaagttctcttaactgttttgcaataggctcatgatcatcaaatcaagtgcaattcaggctgaaattcaagaaatccctgcaaactaaaacttttgaaacggtgaagtgaacgaaatctaaaaagcattatactcatctaaattacagcactgccattacctaaactacagcattacacctactacaactactacatatgaacatgaaaagggggagcattacacctactacagccactacatctgaacatgaaaaggggtttttgagttgtacctcgaatgagctatagaacaagatgacagtgagcctaggaggcagctaatgcagtgtgccaagcaaataatatatatagttgtagccgaaaatatttgaatatttgaagttttgaactccacccgccaagaatccaagcccgccatcctcttctcccagattgtgaccaaataataggtcgattttgtgctttccccatgaagagagaggtctactgccctaacccgtgctcctgtcataccagccagcagtactccttggtagtatcatctatcaagtcttaagagagggagagacatgccgtgtagaccactcttctccaatcagacctgctacatttccaatcaaaggagtgtgtgtggttagagagggggattgaatgcagcgaatcagacacctgctagatttccaatcaacggagggtgtggggtaaattgttagagatgggggattgaatggagcgtgcactggaatggatgagactgatcttaccttggattcagagagtgatgtagtactccgtagaggacttgtacgctcatggatcctgttgcaggcaagtactaccaatgtgacttgtgaggtccttcacagtacgacgacatggcctctggattcgattggtgcacgagtgctccgctgcgacgtggtccccacaatccgccgccgctccgagccctgcgcctccacgtcgcccttgtccgccaccgctccgccccactggcagccgccgacagcaaaggaagcgacgggcggaggacgggaggaggggcggagggaacgacgtcggctcggtagggggagcgcgctgctggccccgctgtcgcccttgctcgaccgggccatcgcctccgagatctccctcatccaaatcctgcaagcccacggaagagggaggggcgtcggctgggaaacgcgtgctggccggggaaggaggaagggggcgccggccggaggaagtggaacggcggcgctggccgggggaggaggagaagaagcgctgaggcgtggcggccgggggataaggagaagatgcgctggggctggcgatttttttcggtggcccttgtttttcgttttcttttttttttagcgcgatttgtagtcgtagaggacggtggatgatagactctgggaagggataaggaggagattttaagtttctttttattaaatgggtgtggcaatcgatgataaatataagttttgtaatggagtgatatcactatatttgtacgtatacaattcagttcaattataggctctcaattttaaattttaaatttggaatttattatatttgcaattttgaattttaattaatgttgtagtgggttctatatggactcttcttccattattacttaattttaattcagaattttatttatttctaattgcatttttatttgaactcttctttttctaattttggaaatatattttattttttattttaaattttaattaatcttatatcgtacagagagttgtacagcaatgtgggggtaatcttcgggactgtacgcaatgacttctcactttagcactggccgatggttttggtgtccttagcacttctttgctggctatcacgagggtccactgtttggcgcttaaaatttttgaactcaggtgtagcttctgtttctgtggaagatcttaggtgtttatttggcgtcgatactggagttgataggtctagatattgttcaatgtggtccaataatggttgcattcggtggttataacagttatccatggcaataaacaaggttgagagcggttacttagccattgcactggtttatacacatacttactattgcctcgtgcgctcgggtacgcgtctcattgagcacgtatttataggggagaggaggggggtccgggtgtggttactttggcctgcttttgtcgagcacgtgggcaagagagaggagaggggaaaatggagaggagggctggcgggggcttacttcgccggcggtcggggccgaaggtggcggagatcgaggtgcagcggcgagctattccaccggtgcaagtgacgggtggcgctgccgttggcgagggcgctggagcggttgtgcctaagcgttcctgtcgaggggaaaccttcctggcaggggtggccattgttttgcgctgggtgtgctccagtatgcgatttgtcggggcaaccatcttcaccatcttagcttggatggttcgcccgctggtcttgctctggaaatggtggcgagatctgatcgatgatggccactctgattacttatgcgaggcagtttgtctcttcattgtgttggcaccgattgtttttgtttctactcttaaagcgctactggagtagataatttatgaaatggttgccaagtcttggcatgtatcccttatgtatcaacttgcataatctctactttaatctttctacacatgtgcctgatttgtgttgcctgtgaatgtgggatttctagttttttctcaacattcttaggcgcttttaggtttggcatcctctttattcggcgggataatccattcttactcgataaatgatttaatgttagaagggcacttcggcgtaagggtgattatggacaaccatttctgaaccactaagtcatgggggcaagagattgcattactccatattcaattttcttttacaacaaggtaccaggtaatacatctctagaaaggggaagggaactactaatactggattgggtagtgccaaacagggcctatgcacatcccttctcatggagatggtgggggcgagaggggatcaacttccaacggacgcttccgacggatcctgcccatcctcccgctctcgatgtagcgggctatcgtgaacaccttgcagagaagtaaggttgtgtgctcttgagctaggcgccgatagcgggattccagatcggcatatcgatcccgaagttcatcaagttcttcaagagcttgctcgtaggcattctcggtggtgtgggctagctcggagagaagggtgcatctgctcccttcaggctctccagtcaggcggaggcggcaccggctgtcgtcttcttcgcggtacgggtgcatgcca

SEQ ID NO: 102849 - DNA, 3412 bp, Oryza sativa
gttccccgaagttcgaatccttgagtggattctactctctattgaggagcccacaaagagccgggtcttagctaacactttcctcaagagattgcataaaggacttttccttcgactagtggtatctcttccttttcggatgcgagatccgaccttcacaaacttctcttagccaaccacaagtagattagtggctcaagagtgacacctagccgtctaggagtcctgagcctccaagagtaaaagatggaacaaagatacctttgagatgaaactagtgctcaatgaatcttcaggaagtcaacaccaagcactcacacgaactcaaaaccacatctctcacacacacagtctgagctcaaggatcgatggagaggggaaatgagaaagcaatgctcaaagtggtctcaaagcaaagcaagccaagggcgaaaatatttgagatagcaccagcaaccttgacttggagagggtgggggtatttatagccacacccgcaaatctgcccgttagtgggtaaagattcccttttttggaaatttccgaaagcaccttcggaaacttccgaaaaacaccagtaacaaaattgacttgaacaacatagtttggatatttccgaggaacattcagaaattgaaaagaccctttagaaaattctgaaaaacaccattaccgaaattggctttgcaacacagttcggaaatttccaaagcaccttcggaaaatccgaaaaagaccaatacccaaaatgaaagttcacatcacttcagaaatttccgaaacatccttcggaaatatccaaaaaacaccagtatcgtttttcgaaggcaaaaatacttcagaaacttccgaagttgatttcagagaactccgaaaaactccagaagcaattttaagaacaaaaaccacttcaataaagacttttgagcacttttctcatccctatagttcaaggaaccatccccttgatagtgcggctttcctattgacataaacgaataaaaaaatacattttaccatttgcatattgtgccgcatcacatcgctttctcatttcgtcctggttttgccttaatcatcacatcattgagagctaacattccttcacacatactcaaataaattgtaagtcctctctaatcgcattgttattaatcaccaaaataattaggggcctagatgcactttcaagaaatcaagcctcaccttacagttgtgagaagataaagataagttcatacaggtttgatgataaggtgaagaccgagaacggtttccaatcaagaaggggaggatgatgaaaacatcgccaccatcgatatgaccacatctaccttacatgtttaccaaccaaaggtgcatacattctatgtaatattcccatgttatatatatttgaacaaatgaaactacaccataagtttcgtgtgttctcattttacagaagtacttgcatggatgaagagagggagaccaagcagccagaatgcgtggatgatcatgattggcggccaaccaatattcttccccaagtctactcccacttcaccacgtcacttttggtccattaaagacgagagatgaagttctacatgttttggattcggattcggattcgggcttcctggcagcagtaacttcaaatagatctaaccgctgatccaaaaggactctcggggcacatgagtacttgttggaaaacatatgtaacctattttcagatggttttagtcccacatcaaaattcctcttgaattgtcgagaatcttcaaaacaagccacgtaccccatccaacccaagtctgatatgggacttggcccatgtaattatatcattgggtaagcccaaggggtggatgtcctagggctaaccctaagatgtccctaatcatatttattcagtaattgtcatagtttagagttgggtttgcttaaattattctgccatcatagtctcgccatttattggtttgtaaaaccccaactttaagttcttgattaatcattcatatgcaatcgagttattgcatttcttgttcttgtatgtgttcttcgattcacatgcaatgattagtatttttggtgaggttaatcgggttttggcagggttcataactagagaagacgtgatgctgcaattgcatggttcggattgtgttgataggaaatcaggtcgtgtgtgacaagttttcaccaaatcgatagttatattcacctgaccgaagattggacacccattgtcatcaaaagttacctgatttgtcaccagttaaaggagtaggaacgctcattgcttgcccatgtatcagctccgttctaacaaagtatgggccaaggcccaagccttttttttttttgccaaattttgcaactcaactatgagttttcaaagcaaaaatgtacagggtgtgttggttatttgccataacaaactattggtgttgccacaatgttaatattttgtttggttggtaaccaatttttggcactacattgccatcttttttcttgtttggctagtttttgcaagaacacgggacatagtcttgggtaacaaaccaaatgctagcgtagctactcttgccaattttttgtttaagaaatatattagaaatgcaagcaaccaaaacatatgcacactcacccatataaatacgtacacacacaacctacccttataagcaccatcgaaagaccagcatatattaagattgacgaaatcaccataagcgcctcactatcgacgggtacatcgcacaagaataattagccctaaatgcgaacactcttgccaagtctaaaactttaacctaaatgggcatgatccaccacaagaaacccaaccaaattgagctactcttacttcacactcttgccttttttttttttgcacctcgacagaaaatttagcaacagctaattcataccgataaaaaaggattagcaatgctactaatcaccacggacacctcatacatcacctaccactgatagaataactagacgtaaatgcgagtgctggtaagtctaaaacttaaaaccatattagcaggttacagcataaggaacccaaccaattaaactatgctcacttaacatacttgccaaattttttggtacaccttgaccaaaattttagcactagccaattcgtaccagtacaaaagaattggcaaggctacaaatggcaaagaaccaaattacaagcccatagtttggctaggcctgctcgctctgctaagtgcatgcgataaagtttatgcggcaaaagagaacacgctttgctagttactagtgtaaaaaccgtgacaacaatgaaatatcgatagctagggcagaaggtttttaaccaactcactattgaaaaagaaaagagaaatacgatccatccaaaaaatataagtaataataa

SEQ ID NO: 102850 - DNA, 611 bp, Oryza sativa
agggttgtaataatattagtgacattccaataagcctatatagagttgtaccatatggattaactgtgtcacgcgctttaagaacaccatagcaaagcaaacaactcatttagcggtagaagcctataagaatgtttgatgttaaaagagaaacaaacatatagagacaactggaatggcacggttgataaccttttctaatctattttttaatttataagtatacaatatttgaattcattatccctataaatgattatggtcgttttaacttcaagtaaaataagtggtttatctgtgtaatcatccgcctaaagcgcgaggtcgtccttcagcttattgaatatataattaaagatcctatttcactattatagaaacggttttaaagtggctaaaactgatcttcacataaggttggtcggcgacaattgaagattgaaatgcaaaaaagacttcaaattaaaatgttgtcaatcaacatcatagatctggtcaccacatacaatttttctatgaacttgtttaaatccgagttttatgacaaagttagtttcatatctgaaaccaacaactaatattgcgattatcattatatagttgccggctcg

SEQ ID NO: 102851 - DNA, 777 bp, Oryza sativa
cgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgttcgtcgcgtaggtttcggccatttattgtttaccttatgccattgataacttgggtatcaaaatgactagatgttggtttaggaaatgcttagccatgcttagttcaattagcacacacatggggatcacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttatccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacat

SEQ ID NO: 102852 - DNA, 584 bp, Oryza sativa
atattaggtcggtttgttgggcgcctggaataatgagcacctcaaaagtagtttcatggttgaatatagtatattgttgtttgtcaacaaccttatgtgtttctcatatcaagcgctcgtgtccgccggcgcggctacgcggcagggacatgcgagcagcaagcggcgagcaagcagccagcaggcatgaagcaacaggcggaaggcaagcagcacaagcagcaacaagcaagtggcattcctcccgattcaatcctccctagtccctaatcaatccttgctctccttttttcagattctatgtatatctatcctccctgattcatatatgtgatttattgccgaaacttcattacttgaggtatttttcaatgcctattcttctatttaggcttgtttgcaaatggataatggagctgtacattatagcgcagctatgctgctataactgtgaatctgtggtgtacaaatattatactccctccatccctaaatgtttgacgccgttgactttttttaacatgtttaaccgttcgtcttattcaaaaaattgaagtaattattaattcttttcctattatttg

SEQ ID NO: 102853 - DNA, 765 bp, Oryza sativa
ctaagcaagatagtgataacttcagaaagatggtagatatgcgatataatctagattaataacaagatctaactttatcggctactctttatcaggaaaaactagccgattgcgagttagataacgcaactaacaaagattatgaagcatatatgataactcgacaaattacataaacaagattagtgtatcttaatgatggaagcactaatcccgacaacgcaagctgccatgacaagtttacctcttgttgaagatcgaaatcgatgcagctcaacccgagagcaagaactcgtcgaaaacaaacgaaagtaaaaccgggtggtgatgcgtcgagagttttattgaactgttgttgtcaattacatgggttcgggttataattataccctagatacatgataggtccttgccggacacgactcttatctctaacaaactctaagatacacataagtctttacagtagacttttgcccaatcatatctctaagaaaaccacttgaaatatcctaattaatagatacaattgcctatctgagagcttatctccatcgtggcaatcctttcgtagcacgttgatcgattgcagaaacggttttataaccatctcaataaaatcggttgtatcggctgtcctctgtccaatccatctcagccgatgtagacttcagctaatgctttgccgaatccacttcgattccaatgctgaacctgggtcataattaacaaatttgtttgtaacaaaggggaatcatgatattt

SEQ ID NO: 102854 - DNA, 2022 bp, Oryza sativa
tgcgtggcgtgccttccgcgcaacgccggcggcgcaagcgttctgtcgctctgctcaaggacgagcacgtcaacgcgttcctcgcagaattgccaactctcggctgaatattgggaaagttttctaaactctatatttttcccgtctctaacaacgtgtgtattatattatatatctaaatagttattaaaaagttttaaaatattgagcaatatatatataatctgtcacgctcattgtcacgctcatttcataagttatcgatatctataagttataaccaatgttctaaaagatatttataattactactagctccatccgtccaaaaatataataacttagtatattagaacgaaaggactagaaaataatgtccgtgcactgcatcggccagtattaggtaattaaagattaacatctgttaggtccacctgccaggcaacttgtttagaatagcttatttcttatatgccactacaacttcaactaaagtttttttaaaaaatatatatataaaaactttcccgtgtactaaaatgggtccatccacataacgtatattgcctacatatattcactcgtccccattttaatttttttttttgcgcggatcgtccccattttaatgattgaatcatatactgtaatcttgacgcgtcgaatgcaatcaaaaaaggaagacaagattcgtggaataagccaaacggcatattcgtaaacgagaagtaatttgtgaatacaaacttttatatacgtgttcttagcgatctaaaagcaaatgctgaaaaataaattttaatgagaaaacctcaaaatttgctttaaatttaaagttgaaaatttaaattttagctaataagtataagtataagagaaaagataataccataggaagtcgatggtagagagagagagagcatgttcatcaggaaactgagtaagacggtagcgtaaaataagaggaggtggttgttcaatggtagaggaagacagtgacaatacgagaatctaagctagagaaggtgacagggaaaggacgagaggtttagggaagcaaaatcacgaccagattagattaaacaaaaagattgtagtagcgtgttcggtgttcatgcacgatggatcgaacagtggcagctactgtattaatccataaatcaataaatcactagtactgttacttattgtccatgatgatgtgtgcatccgaactgccgatttattctctgtacatatgtatatgcatggcgtcatctatacctagtagaaaaaatgactgtgcattataacaggaagaaaagatgagaaaattgagaaaaagttgagaaaaatttacagtatgtaattaattaaaatacaaattttctgaaatacttgggtatttaataaagtaaacatgggaaataaaatgatatggctagatttaaattttattaagttctccttaattaattacactctttgagtttttttttgaaattttcaaagcttaattgctaattttaataatacaaatatcatttcaacatttatttaaataaaatacttcctttcactctgggccatttttagcccatttcctcccttagcctgcagccgagctggcccgctttcctcccttctcctcccctccgtcttacctcgcaagcacacatccggcccagtaagtaacctaaagtctaatttaccccctactcctcttctcaccaccgtgtgggccccaaccgaaagtctaacctaattgctttgtgttggacccaccggcgcacgcgttgcatagcaaagcagtgcttcggcccgacacaagattgatctgagccattcgttttgatggacggctcagatcagttccgaatgcatcaaaaccaccactgacgtcaaaaaagaccctaaccctagattcactttttcccaccgcccgccaccactccccgtgggccgcttcccttttcttaaactctccccatcagcggtgccactccccctacacaacaccactgacggcgctactccctctcg

SEQ ID NO: 102855 - DNA, 653 bp, Oryza sativa
aaggttataccatgccaatgggtaaaaagttctggaaaagaagagaggtatgactttgactttaccaaggctgataagatttttgacttgttacttcgggagaagcagattcaacttcctgctggtcatattatactatcggctgaggaacttggcaaaaggaggtattgcaagtggcataattatggttctcattctactaacgactgcaaagtttttagacagcaaatacaggtagccattgaagggggaaagattaaatttgatgactcaaagaagccgatgaaggtcgatggtaactctttcccggtcaatatggtacatagagccggtagaacagccgatggaagcaggagtaaaagtttttagatgaattcggctagaattattaacaagtatcagaggaaatatgacaagcagcaataggagaggtattatgaagaagacaatggcggttttgatcctcgttgggactgtgagtttttcagattttgctggaacgagggtatgaggctgccatctatcgaagattgtcctagatgcagtgatattgcagaaagttcaagccgatctcacaatagaagcaatcggctgaggttgacaagagttcctgttcatcaaagattgggcccagtaaatcaagatcatgatca

SEQ ID NO: 102856 - DNA, 1175 bp, Oryza sativa
atgctcgggacatagcatgtactcgtcgcaaactcgtaccctataaatatcttattctaaagcaatcctgtcgatcatatgacatgtagggcacacgaacgtaggtacgtatatatagtacagggctgggacaagaaagcatccaataatctacatcttatgctgagaagctacggattcaacgagcgagtgctagcgtacgtaagcatgcatgttttcttctactactacttaattaaatcagcattatctaaaaatatatatctgtatcaaaggatgcaagttaaatagactctttcatgactccggttaattatcgcagtcctcactcaacaaaagagtcatatatcatccgatcaatcatggatgtgtcgtaaattaattagccacactttatttaatgaattaagtctttcatctatcaaactacgctatttaacggagaaacattgcgtcttaagactgatcacatgactacaaaatttcatcgtatgccgataagtactgataaactattttatctgcaagattaagttaatgctgacccatgtgattacgttcgtacgtgagctagaaattaaaaaagcagagagaccagcattcttacaaagagtgtttaaacgctctctatctgcatacggtagcccctatataaacaaaccagttgtcgtccagcaataacgaacatcaaccaacacacaagaaaaaccaccagagcctctcttcatgcagatggcgccttccaagagcatcctcgtcgtcgtcttcgccctcttcgccgtcgccgcctcgctgcctccgtcggcggccgccagggacgcccaggtgttcaagcccaccgtcgccgtcgatgtcgtgcatcaggaacaacaacaacaacaacaacctgcagtgaacgccattgccgacgtcagccagccatctacatctctggttggattgccagggcttccgccactggcacctctttcgacgatccaaatcccaggacttccgccattgccgcaacttccgacgatccaaaatccagggctcccgccattgcaaccactttcagcaatccaaaatccggggcttcccccattgccgaacttccgacgattcaaatcccgggctcccgacattgaaaccggtttcgacatccaaatccaagggctccggcattgccgaaactt

SEQ ID NO: 102857 - DNA, 651 bp, Oryza sativa
aagatctagccgatgggtacttacttctgtgtactcggccgatggcgcgatggacggactggcggaggacgacatctctgcgggcggaagtctggccggaggggagattgcttcgaagtcgccttgtgcaccgaggggatcgccggagaaagagaacatgagatttggcttaagcggtgaaaacggaagtaacagtgtgaagtttctcggggacaagtatttaaagcagagcgataatggtcggaaaaatggcaagtgcgatattctctcggagatacgatatggcaaaaacgaaacattaccaaatattccggacttggggggcatgtgttaacaaccaaatttggtaatttcagtatcaaagacaaagataaaatcgaagtggaatccaagatagagatcgtcccgcaagcagagcaagaataagctaaagtccgaatcggctgtgaccaggatcgacagagtccgagctagacaaggtagcccattgagtaaaacccgacaatatgacatggcatacgttgtcgggttggggtaatgtgcttcatgaggattgccatgcatggatagagtcctgagaaggcaattgtatctataaatacgatatttcatgtaaatttcctcgcgaaatgtttgggcaaaagtctgccg

SEQ ID NO: 102858 - DNA, 923 bp, Oryza sativa
gttttttaaactgctaaatagtgtaatttatataaaatatttgtatatgaaaattgttttaaaaaaatcatatcaatcgattttttttaaaaaaaatagttaatacttaactaatcatgcaataatacgagtttcgttttgcgtgctaggaaggaggggtcctgaacacagcctaaatcgtaatacaagagttcatctaatcttaaccaaaccgtctaaatcatggtccatgataatattaagggttgttttagctgatgtggtattctagtcaagaaaaaggcaaacacatgacatatgccccccttctctttctcatctctcttcagggcgacgccggcggtggagccttgcttcgatgcggcgggagagaggagacgaggcaatggcgggacgaggggtggatggggatgtggaggagcaccgcgcgatgcgaacgtgctgccatcgccactgtcgtgtcctgacgctggggccacctggttccctctcggtgctgatgcatagggtggccccgcgcgcgaggcgtcggttccgtggttcactgccgccattgccggcctcacatcccgcagccgtagcccctggctcctcaaccactcggtctccagttacgtttcatcggttagttcaggctgcgtttagtttttaatattgggaagaagtttgggataagttggtagtttaaaaaaaaatttaagagtttatgtgagtaggaaagttttagatgtgatgcgatgtgatggaaagttgaaagttttgaagaagtttggtgtaaaataaacatggcctgagaagtaagtttattagtcacaaacaaaaccgtagaccgaattgctctgtctccatgctccatatcttttactttatctttagaaaagtaaatgtagtactccctccgtctgacaatataagggattttg

SEQ ID NO: 102859 - DNA, 736 bp, Oryza sativa
agaaattgtgttgcttaatttggaaatggctttcccaacttgtttctgtttcagtgaaacacaataaacaaaggcaaaagtccattttacaccctcaaaccggtaagcttgtctacaatacacacccgaattactactaatacacttgaatagggatggcaatcgggcgcgacgggcacgggtaatgtctacccatacccgtgcccgtgagattatttttgcccgcggacatacccattactacatgacggacaataattgctgcccatgcccaccacccgcggacatcacatgcccgcttacccgccacaactagaacagtgcaacaaaatttcacaagtttagcaagttctccacctcggtgttgtgtcctcttacaacgatggagtaaggggaagagaaaaaagggagataaaaaagaaaccgtagaaaacaaagaagatgagttatatatcctagtggattttactcatggcccacatgtcagttagatttcacgggtaaacgggcaaagcgggcatgggtagtcatttcccatgcccgtgctcgtttacccatagggtacagtttttgacccaataagaaacccatgggtaaaaatggagaacatacctaatcctaataggatttttacccacaggttaatgggcaagaactattaatatcggacacttaacacccccaggctgttttaattcgtggttttgatatgccggatgccacgtgagcctttgcc

SEQ ID NO: 102860 - DNA, 784 bp, Oryza sativa
ttacctcttgtcgagagatcgcagccgatgcgctgactcgaagcaagaactcgtcgaaaagtaaagcaaaaaggatggcgatgcgccgaaagttgtattgattggattcaatcccttattacaatgatttggggcttatatttataccccgagtacaaaacctgtccattatggacgtgattcaaaactttgctaaagataaaatttgaacaagtccacatggctgactattaccatatctctaattcaaaccggtataaatatcctaattaatagataaaattaccttaaattagctcaatctctatacgacaatatcagttattccaatctaggcccaacccgagcctaaatcaatccgtattggctatctggcatatcggctaaggctctgttcgggagtgagggttgggaaccctcagtctccggcacgtaaaacgaagcagcgtttagtacgtgattaattaagttttatctttttttttaaaaaatggatcaatatgattctttaaagtaactttcgtatataaactttttttaaaaaacataccgtttagcagtttgaaaagcgtgcgggcggaaaacgacaaggaggagttgggaactactcctaacgaacgtagcctaagtctgtttccatctctattttcagttgatacgatgtccaaccgatgcacagcctatcctctaatccagttcgaatccggaccaaaactgcctcgatttgtcctccttcgagtatgatgcaaaattctggtgttaacaaagggccgaatttttaata

SEQ ID NO: 102861 - DNA, 642 bp, Oryza sativa
taggagaatgcccaacatcggtcgaccggaggaggtgggaaaatcagtcgcttccctccccacatgcgcgcacctgttgggcccaccaacttatctctcctcttttttcacaaaaatgtttcagctagtgtacttataatgttttactattttaaatagatataatgttgcagtgaattaaaatattcttttgcaacaaaaaaacccacatattttggaaactctctattaagagaatttcgtttagtttttgctccaccaaaaatgtttcacctagtgtactcacaatgtttcactatgtatagatctaatgttgcagtgaatgaaatattccattgcaacaaaaaaaaccaacatattttggaaccccctagtaagggaatttggtttattttttggttcacctaaaaatgtttcacctagtgtactcacaatgtttcactatgtatagatccaatattgcagtgaactgaaacattcttttgctatttgctgaaacattgtttttatataaggtgaaacaacacccgatttaaacgagtgaaacattttcgatctacttagtgaaataattccgatatgcttggtgaaacatcgtgccacatttaaaaataattcaataataagctaatttttttcgtc

SEQ ID NO: 102862 - DNA, 681 bp, Oryza sativa
atgcagtatgcacaccttgaggcattcacacactgacacacaagttccaggcgcttgaacttcttgcacctgtgcaccctttggcatacatccattgctcatctcccggaaatttcctcaatgtgcattagttctcaagccactacaaaccattattgaaattaaaatagcataggattaataaacagaaatacaaggaaattaagcagatcccaaaatactgaaaccaacccaaaagtttttaagaggaagattactactgcagtgtctgttctaccacttttatcaaaagcaaaaactgtttctcacaagttctagctgtcctgttggcgcccttgcatcgattgccctatccaaaatgatttgcgatgtgcaatcaaacacccccaaactttgtaccagatcaattctcgataatgaaatcgtcctaggtaaaatgcacaacccgaggacccgcgtgccaactacttcgtagtagcatataacagggaatcaagcccaggaacaacactagcggcaactttcttcggtggaaataaacacgcagcgactgaacaaaatccgtaacaacgaggattggggagaagtaaggaagcaaagctcgcgggaaggaaccctaacgaacaaaatttttgctcgaaacaaacttgaatccgtaactaactaggcactccaacacgc

SEQ ID NO: 102863 - DNA, 672 bp, Oryza sativa
attagatcgctttaaagggtgtgatgtgcgattttattttatgaccaacggtgaagattatcctatcgatttgatcaaaggccatattttcctagttaacttgggagcttgtagaaagtgctcattttttatagatatagatagatatagaaggtatatatttggagctatctctctatacttgtgtgtacaacgtagatatctttgctatgaattaatgtcagtacctaatgataaatcgtagaacataggtacctttgccattcggatatcttgcaaagaactgtaaaaatgtaaattaaactataaattaacgttacctcaaaaattttagtcgatttaaaaacatgaaaaaaatttgtactgaaaacaaataaatggttcgttatttatacactctgatatcaaattctgattctcaaaatatatagatctaacttcaattagtaccatttggtaatagagcaactacacgcagtggcttagcactgcggttcatccggaaccattggtgatggattaacactggctgttcgggcagaaaaatgattgtgtggaggggagcattcaagttctatatacaacactgaaaattttaaataactcctgtacattgtagtttgagtcataaatattttgaaaaagtacttggaaatctcataatcttctcac

SEQ ID NO: 102864 - DNA, 740 bp, Oryza sativa
taaaattttcagtgttgtatatagaacttgaatgctcccctccacacaatcatttttctgcccgaacagccagtgttaatccatcaccaatggttccggatgaaccgcagtgctaagccactgcgtgtagttgctctattaccaaatggtactaattgaagttagatctatatattttgagaatcagaatttgatatcagagtgtataaataacgaaccatttatttgttttcagtacaaatttttttcatgtttttaaatcgactaaaatttttgaggtaacgttaatttatagtttaatttacatttttacagttctttgcaagatatccgaatggcaaaggtacctatgttctacgatttatcattaggtactgacattaattcatagcaaagatatctacgttgtacacacaagtatagagagatagctccaaatatataccttctatatctatctatatctataataattgagcactttctacaagctcccaagttaactaggaaaatatggcctttgatcaaatcgataggataatcttcaccgttggtcataaaatcaaatcgcacatcacacctttaaagcgatctaatatccatccaattttaaagcccgtctagagcccatctaaccattacataaccgtatacgtatctcatcatgcaagcttctgaattatattcgtagacatcgtcttgctaatatatctctgtcccgactcgagatgtggccatgt

SEQ ID NO: 102865 - DNA, 638 bp, Oryza sativa
attctgtaatttgttttgttattagtctatgtttaatacttcaaatatgtatccgtatatccgatgtgacacgtcaaaactttacaaccctatatctaaacagagccttattgttctcacatgacttgtcttagaagcaagcttgcatgttaatttaatcacttcctgtttgaaggaaactgtgagcaggcataaaagcgaagatgggatatatggaatttatcacatcattcaatcaacatatgggtgctctagaaaacgtgattactagacgagagtttatgtattcattacttgttttttcggttgaagtttttaatttgagcttacatcatcatcccaacatatgtctaaaagacaaactatttaggttggctacataaaacaagtgtactaaaagattgtttctgatgaggacacgattagctcggatataaccatgactaccttatgtattaatcaatcaaaagtgcatataatctatattagatttacttgttatatatttgaataaacgttgctacataatgagttttgtgtgttttcgtttgcagaggtacttgtttgggcgaaagaaaagagaccgagtgtaaggaatgcatagatgattgaagaagtttacacgttttggattcgga

SEQ ID NO: 102866 - DNA, 694 bp, Oryza sativa
tttggattttaccaaatgtttgttgaatttggtcaagttttattcaaatccagtcaaaacatgtaaaagtacttcaactaattttggtccgacaagtgccaaaaatcacgaaatttctattttggtgctaccgaaattttggctgaaatcgaaaatgcaaaccctagtccctaagtaattatgaactaaaataaggtgttaaatcaggaaattaataccggtagaacagcggtgaaatcgtggttgtattactgctccctttaaggtttaaataataatgtccatagatattatgcgcccatagcttttttagcgaagaccaaagatttgtggttgttctttgtgagcgtgtattagggagtacttttatgatgagcttgtgtgggacgcgtatagttaaaaacaaataatgttaaatcatctacaaatttgtcaagatcaaaatatatttttgtagtttcggttaagtcttcatcgttcaaaaccttttgttgtgttcacatatatatttacatcatttttgttgggtttatatttatatcctacacgaacacgatgataccgacgtgtttggttcggttcttgccagtaaagcgagtggtttgttcaattatatttggtggtgacattttttatatatgaaaatattcgagatgttcatgattcgaatagcaccacaacagcatgtgtcatg

SEQ ID NO: 102867 - DNA, 703 bp, Oryza sativa
aaaattttccaccctgttacatcgaatgtttggacacatatatagagtattaaatataaatgaaaaaatacctatttatacagattggcgtgtaattgcgagacgaatcttttaagcataattgctccatgatatgacaatgtggtgctacagtaaatatttgctaatgacggattaattaggcttaataaattcgtctcacagtttacagacggattctgtaatttgttttgttattagtctatgtttaatacttcaaatatgtatccgtatatccgatgtgacacgtcaaaactttacaaccctatatctaaacagagccttattgttctcacatgacttgtcttagaagcaagcttgcatgttaatttaatcacttcctgtttgaaggaaactgtgagcaggcataaaagcgaagatgggatatatggaatttatcacatcattcaatcaacatatgggtgctctagaaaacgtgattactagacgagagtttatgtattcattacttgttttttcggttgaagtttttaatttgagcttacatcatcatcccaacatatgtctaaaagacaaactatttaggttggctacataaaacaagtgtactaaaagattgtttctgatgaggacacgattagctcggatataaccatgactaccttatgtattaatcaatcaaaagtgcatataatctatatta

SEQ ID NO: 102868 - DNA, 619 bp, Oryza sativa
  unsure (1)..(619): unsure at all n locations
aaagcgcgcgtaccttaaggaaccgagncgncgcggtcatgcgccgaagacgaagaggcggccgaagaagcaaatcggcgctcgcgctcacgaggaagagaggnacatggaggcgtgcgtggcccatgtactttagggccgaatggcagagtgggctgcggcccaaataatctttttacccggcccggcccgcttggaaggcacagaaggattatcttgttattgtttgagaggaaaggtaaacaaagatagatatgcaaaatgaggtaactaataattgagtattgattattttcaatttgagaaaggattcatatgagtttttaaaacaactttcttatagatttttttagaaaaaaaattatatcgtttagctgtttgagaaacgtgcgcacagagaacgagatattttttttctcccgatccttatctgcaaaacgtagcctagtggggtacctccacaaataaacaaattataagctgaattctaaacttggactccaaattacaacttcatctttttaagttagcatattttttaaactgctaaacagtacattttatgtaatttaaactatagtagttaacacttaattaattatatgctaataagaagcgt

SEQ ID NO: 102869 - DNA, 872 bp, Oryza sativa
tctctatgtagaatgaatttgaagatgcgactttgcacgtagatgtaatactattgaaagtacatgtatgaattttcctagaattttttgtgataatttttagttggtgtacacggtgtgtacacgcgagggcctgtgtacatatatatatatatatatatatatatatatatatatatatatatatgagataatttgttcaatgaaaaaaggcattaattaaagttactttccttttgttataagttacttctataatatatgtaaattacttttagcctttactgaatttacttttatatatctaagaagtaacttagtgaaaactaaaagtaattttgacatatcataaaagtaatttgtaatttttcatcaaaatataatcatgtgagatcttattgtaaagatttaattattacgaacacaacagtgtaattggattctaaatcggatgagtaatttaagagaaaattttatttgaagcatagatgagaggaatatttcccctacttgctcaatgaattaatagcaactaaaacttctaaagtactagtacatgggtatctctggttaagactaattggagatgcctctccaattagatttaccgctccaggttatgtggacaaaaacaaaggccaagagggagggggagagggggagggacgaccgtctccacgccgtaccctcgccatctaggccgacggggagagggagagggggagggacgaccgttcctgccgtacccctgacgtgccggcgagacgggagagagagggcgagagggagtagcgccgtcagtggggaggtggagggggagtggcaccgctgatggtgagaggggaggggaggggaagcggtatagggggagt

SEQ ID NO: 102870 - DNA, 1787 bp, Oryza sativa
aaggaggtgggccaagtagaaattggcctattaaaaggagtcgggcacaaaccgtgattttggtccgaaaatggcattttatttgaaaagtccttggtttccaaggcattatgcggaactcagaaattatgcggaaaagtcctatgggacattagaaactacggggaatatacattcgccatttatactttgaaccttcatgagttgggtttacgccaaatagagaagaattaaggatttataccttagtcccgtatttctaagtatttgctttaactatttagttagtttcttgaataatcatagtcaatcctagaaacattgtttttaggcaaaagagcttctatgaacttgtgaaacctttgttttagcaccccttttggaagcatcatattttatggtttatttcctggtaattgtttatttggggtaattgattgttctgtgggttagtagttctgtaaattacacatacctttgaatagcagaaaatcatgttaattgctaggattgtaataaaaggtgtgtatagaaatttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtccaattgtcgccacatttgtggaagacacaattatatattctccgcatagaataaatgtatacactcatcatgaagagagtatattattgacttagagatatttattagtgcatgactatcatagaagataagctacaactaatttatattaattgtgtccaagtagatacaatgtcattgaatttgcgaatacctagacgagaagtctatatgccaatatgccctacaccaaaattatctatcaaaagactatgtacctatgcagtgtctatagttaatttgattgataatgttatgtccatcttctacgtataaatgactttacaaatgaagtattgtttttatggatgtatgtaaattattttgagtaaattggtcatttacatttgaagcaattttggcctagatgcaacatgtttagttgttagaattgatacacaagaagttgtattattgtcaacatgtgcatttgcacgcacatatatgacttatactattaatatgttcatgaagaacatgcatactcaaaatttgtggaaggaaaagaatttggtgtatttaaatttgatgttcaacttagggggagacgaatagtaatgacagtaatcttgcattcgttcttttgagataatattttacaatacacgagttacattatagtttagattaagttcaacatgaagaacatggttaagctcatgtagagcatctttatcttttgctttaggcatagaagcttctgcattagattactgaattttttttttatataggtcatctcaccttacctatattgcctttttttacctatagtaattctttaaccttttgtggaataaaattgtgaattgtatgtctaaaattgaatgtaaatatttgtcttgcctattatttgaagtatttttggcgaatgtattcttattatccactaagcctcaatcaaccaagtaggttgatagttctaagtgcattgacgccatattggcatacatgtaaagttgtttacttatacacatgaacaattagaatatttatggttaagcattgaagcttaaatatatccaccagaaaccacattatttcttttagaaaagtcgtac

SEQ ID NO: 102871 - DNA, 663 bp, Oryza sativa
aaaatataatcatgtgagatcttgttgtaaagatttaattggtacgaacacaacggtgtaatcggatcatagatcggataagtagtttaagagaaaattgtatttgaagtatagatggatgatacctcttatagatggagtggtagctagtttagacaaaccagctaccactagctatgtagttacgtccaacccggagacagtggcagtggggacaagagctcaagctagagagacgacggcagatccgggaggacgacgcctcccctgctgcgagtgacggcggcagcagcgtcctcctggggcttccacaggcggatcaggcggtgtcgtgcggcttcccgcgagcggatctggcagcgacggcggagtcgacggcgccgcgggctgatctagcggcgactgcggcttcccaccggtggatccgatggcaacagtggcatcggtggcttcccgtgagcggattcgacggtgacgaagatcaagataagatctctgtggtttttataatttttcctgttcgttttctctttggattgttggattggattttgtatatatctttgaatttgtgttttatccgtcttacgcgatgtgttactcgttcgtgtgagaacggatgccatcattcgatcggacttacagatggaaaattgatgtgac

SEQ ID NO: 102872 - DNA, 687 bp, Oryza sativa
attattctagttaacgcgatcatgtggacatccaaatttaatataaattaattgaaactaaataaaactcctagaataaaacaaatgtcaaatcacctccaattgcatagaaagagatttgattatttattatgtattatgaacactgctggaatgttcccctttcaatgttaattgactgctgtgatgaatgcaattaaaaaaaacacaaattattgtgcttgcaatatgttgttttatcatattggcaaacacatgcttagcacgcgcatgattacttctagtagtaaatataggttgtaagtcaaaacaaatatgtatggtatgcacaccttgaggcattcacacgaatgtacgaggcacttggacttctggcatctgcacccattagcatacatccatgctcattttcctgaaatttactttatgtgcatgagttctcactacaaaccattattgaaaatttgaaatcaaaacagcataagattaattatttgggggtgctccaagaaagaagaatgcattaccggcactgcattagagctctggggttcaatctcacttgcatcttgaaccctaacaatcttgggatcaaatgctctcggatttttcatcttgatcatgtccacacgctcctccacaaagtcctcatagtactctctgttcttacagttagtgcaacggcag

SEQ ID NO: 102873 - DNA, 672 bp, Oryza sativa
tcgattttcccaggcggtcatattaagtcgattatcccgtacggttaagttataccacccgcatggaaaaaaaacggacaaaaaaaataaaatcgaaaaaatccgatcggatcgccgtcgtctctctttagtccagtgtccaaccccgcacaggcagccgtacctgagcgcatagctagcctttctcgatcctaatcccaaagctaccatttctcgagcaaagaaacggcaaccagccgatccactgtgcgacgcaacacaaagtttgcaaaaccatgacgaaaagaagaaaaaggctggccgatcgctccgcctccgccagcagtcgtcgtcctcgcgccgtcgtcgtcgcgctgccgctcatcatcgcgccgccactcgtcatcgccgtcgtcatgacgcccgtgcgctcagtgggaggcagagagagagaggagagggggatgtgaggagaggaaagtggcagagagagaacatgagagaggggaggagaggaaagaggcgtgtgggagagaataaaaagaaaaggaagagagattgtgtgaaaaattggaagtgggtgagagggaaaagagtggatagagagagtgtgaaaaatttgaagtgggtgtgaaggaaaaaaaagaatgtatttttccgtgtggtccacttaagaggtccgcacgtgaaaat

SEQ ID NO: 102874 - DNA, 561 bp, Oryza sativa
ttttgattactcctttaattcataatatctggcaagctcccgcttctggcttataggagaataaactaaaccttctagtttagtttggcttgtgcgttattcttacttataaagatctttttcttcttgaaaatataaggcatctttaacacatgggcttttctccccctgatgccgatatttgatctttatctaatagcatatcacaaaaatcccctatcataggcactggattaatggaattcggtctatttgtatccccaacttcatgtggaggcccatatatgtatgctatggtggtgatatatgaaggaaatgttcattcattgaacacgcacttatataaaataaagggggtaaatatattatatgcagtgagctaacataaaaattaatgcaatggcatgaaaaattgcacatccctaatactgtaggttatcccaattcatagagggttattattctgcgacaatgaagcccaaacaaatatccactagtcgacaaaattactctattttctagctctttttatttgcccaagacttgatccaattactgata

SEQ ID NO: 102875 - DNA, 531 bp, Oryza sativa
gcgaattcgagctcggtaccctgtcgatacatgatagccgatgtgtttacatcgccttgagatggccgatatggttatattgctcttagttattttttatattgtaatcggttgtgttttgccgatatacaatagccgatatggttatatcgcccttagttgttttttatattgtaatcggttgtgttttgccgatatacaatggccaatatggttatatcgctcttagttcaatttataattttattaatgccttcgtcattgtaaaattaggggggcacatatattacaaaatgagctatcctattacaagaccaatcatctagacaagtaacgctggatagccgacacagcccgttgtctaatttgatctacttcttcaatagcttgaatgtcttgggtgtcagttccagagatgaatttgagggacttggtcatgtcagccacattttttatagccgatctcaatctagacttatgttcttcaacagcacttgggagattggctagcttctgcctttcaagattcaa

SEQ ID NO: 102876 - DNA, 582 bp, Oryza sativa
ttcaaaatatcctattccaacaacccgttatctagatttttattacatagaaggtgaatcaaattcccatctaagggttgtccatatttatgttattttaaaccatatcattttttcataaaagttattaaagatgtgcatccatttagtttcttaccaaactttgataaatatataagaaatcctattaaaacttgacaatattaattaatcccctagcgttttcacaaaccagcagcgaacctccacttgccattcaaactcacatacatttgctagttcacggaacacataagattttttttttaaaaaaactaaaatggcaaagtagacgcataaagtaattctaaggctaaaactacgcataaggtatacgtacactgtgcatgcgtatacaccgtagtatatagtagtagaatatttggtccaaatagaggtgtaactttcttccaaaatgggccttcctactctggcccaaatggtcatatggcccatcaaaagtgagcggatccgactcgacaacaagatcccccgcgcgcgcacaagaaaaaggagccaaatctggctaccgatcgatcgatg

SEQ ID NO: 102877 - DNA, 591 bp, Oryza sativa
tatgcatggttcaaggccttacagaaaatacatgcactgcaaacatttaatccaataatacatattattagctatatatagtgtactagtaatcaatcattcgagctagtaattattactccctcagttttaaaacgcaagatatgttagttctttataagttaaaagtttgactaaatttataaaaaaaaatataatatacattacacgaaattaattttgttaaattcatcattaaatatatttttataatatactccctccatcctaaaatgtttgacgccattgactttttttaaaatgtttgaccgctcatcttatttaaaaaatttaagtaattattaattctttttctatcatttgatttattttaaatatacttttatgtatacatatagtgttacacatttcacaaaatcttttgaataaaacaaacggtcaaacatgtttaaaaaaagttaacggcctcaaacatttaaagaaagagggagtatgattgatgttaaaaattaatgttattatattctttataaacttagataaatttgaggtttgattcgggataaaactaaaacactttacttaagctta

SEQ ID NO: 102878 - DNA, 644 bp, Oryza sativa
aattattactctaattaataagcgaataaaatgtcattacagaggtagatagttcctctcaatcaataaagatctaagcagcggaaaaaaataagataaacggcgccgacgactccactccacaggcagcttgaccagggctacacctaatcttccacaccatcagcatcactgtagaactcctcctctgatgaatgattgctaggtgagtatatgacatactcagcaagccacgcaacaaatatgcaagtgcacaggataacaaaggatggcatagtagggtttcatttgcataaacagcatttaataaacatttcagaatttaataaaacagttaagtaataattaaacaatattaatccaacgctatacaacataccctgttgcttaggcccaaccattctgaacaatcatcccggctgcacattctgaacaatcatctcggctgcacagttctatctccaaaccaggaattaaccattccaaaccaggagctaatcaaattattaccagttatagcatcttttattatgatgagaagtgtgagactaatcacgaaagacattgttagaccccgccataacccggggcacggcttttcgaatagtgtgctctggcccgaggtgtccactgtcccacaagac

SEQ ID NO: 102879 - DNA, 605 bp, Oryza sativa
gggcgaatccgagctcggtacccaaattctgtcccttcccataaagagtatcttgcactctttcccataatatttgttttgtggggactaaggaaaaatattcttgtataatggagtagtacagttggcaataagtcttggaaccaattaattagttgaccagtcccagttaaaaaagtcaaagtctttatacaaatccaaatatcccatctacgtacactttgcgtgggaaatcaacattcacctgcataaatccatggactacagatcgatctgattattcagagtcgtcaattggatttggaaagatagtgataatattcatgtccattcaaacaaacaagctcgcatttcaacccaaaacgagattgcaaaccgtgagcgagtgaacctcggcagttcgctgcatacacattggtggatcaacctcatgcaggttttggtccaggtacgggcagatcaccgaaaatgagagactgatattgattgattcagcttcatatggatcgatcgttcttattaactttacgtgcctttcatcaaccagcctcatctttgcatttatatttatgcttaccagccagaatttgaattttcaatcttaa

SEQ ID NO: 102880 - DNA, 615 bp, Oryza sativa
ccccccccccacccggttgatcggatagaatcattatcgggaatgataatgataaggtgaattaggcttgggtggcagcggctattcacattgatggagtagaagagcaatgtctagtggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcatgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacg

SEQ ID NO: 102881 - DNA, 716 bp, Oryza sativa
  unsure (1)..(716): unsure at all n locations
ttttagattttggtaataagttttgagatggtttattttaaaattaaaaattaaaaaggttcaaataatgataaaaaaatcacgtttatacttttgtctgattaatttactagccgcttggtccatctgaaaatccaatgcattgctatacattcaaataatatatttgatcgtttactttcactcccggaaaactcttctttagtcctggtttacaacccctttagtcctatattacaaaccgagactaaatgcaacccgggactaaagatggtcgtccatctttagtcccgggtgaaataaccgggactaaagttagatgtttaccaatcatgactaaagatggtagtggcagtcccggttggtcatcatttttttctttttttttcattggttctttgctgcttgcattttgatttttccttcgagttgatccctacatgattttcccaaatcgagtgccctacatatcctaaaatcaaagtaacatcacaaatcataagttcatataaaaaattctccaaaaaaatacatcacaaatcaaatacatcacagattatatatctcagatccataccatgaatcacaaattctaaaaaaaaagaacaaacaaaatccaccgctgccgctgacggcttccgcctttcctctggcagaggggagggcgcagncgaccagccgccggccgctaccgtttatangaaatcgtgccgcat

SEQ ID NO: 102882 - DNA, 4907 bp, Oryza sativa
cccaaagaaacaatccaatactccccaagaaaaagaaaccttcttcctcccaatttcctcctcccccggaaagagcaacccacccacgcccggtttcttggaaagaaaaaaaaacttataccaaagcacacatacacacacacagcacaaccaagaaggggggaaagaaagggggaagcacaaagctagaaggcccggagcactgaccgtggcgggctggtgcgggaacaactcctccagcgaggaggcggccgcattcggcgggtgcacatccatgcccagcgacgaggaggaggcagccgcacggttgaggagagagaaagagagagagagagagagagagagagaagcggaggaagaagagggggtaggtttccgcttggagaggggagggagggtttcgcttttatctgagccggattgctctggctcgctcagtgagcccagccgtcggctcgtgagccgagccgagcaagtactcaatactggcgataatactggcctgtttagttccgaaataaatttttcatgctatcacatcgaatgtttgaatacatgcatatagtattaaacgtagacaaaaagaattaattacacaattcgccaggaaattgcgtgacgaatctttgaagcctaattgcgccctgatttgacaatatggtgctacagtaaacatttgctaataacggattaattaggcttaataaattcgtctcgtagttttctggtggaatcttatttgttttgttattagactatatttaatactttaaatgtgtatccgtatatctgatgtggtatgcagggcaaaaatttttgcgaactaaacatgccctaactgacgagctgtggtgagctgtggctttggctaggcttgagcctggaacgaactgggctcgactatgtgttttggtgggtgttttttccttctaataagaaattagtattaggaaaaacaatgtcaatatatatattggggatatatatctatcacaatgaatacgtaaatctgcagcaaatctggttttgttttcatattccttctcccattcaattcagttcttgcactttttccattgagtaaatttcacattactgtaattatttgttcaaaagtaggtatttcgtgaaactataactagcatttttttaattcaaaactatatattttcccttgcatgtacacgacatatgggcccaatttacaacaccggtattacataggtgtatcatgtgtggttctaaacttgttagacaaataaaattatacattatcgattatcgttacagatatccgaaacatccatctaaatctataaacaaattagttgcagttattcatttcatttattatgtttggcgcctgccaattttgctgccaaattttcatactgctctccctccattttctgctcttcctcttcctacctacgcaagcaaagtaaagcaaagctgagcaaagcaaggcagcagggcattgtgtcactcattgtgtgagccaacctcctcttggacccccttttccttacttccttccaaaaaggacagcacaaactgctgcagatttttttttaatattgcacctccctttccttgctgaagaaaaagaggaggtgaatctgaatatatactccatgatgttgtcatggcctttttgctgctttgatctctctggctttacctgctcttcaggcaattgaacttgtactgctactacacttcatcttccaaagctttttcacaagaatggtgcctttagttgttttcgaagaataacctcttgtttaacctatagttgattataggccgtaacggcttatcaccgagaaaaaataatttatttgtaaattttttatatatacttgtatagcgatttaaaagtaaaagctaaaaaataaaaatatgaaaacccccttgaaatcaactccaaaattaagttttaaaacttaattttctatagcagtttataggctgaaaagcaaatgattgagttaagtgatgatggaaagaaacaagtgcaaccatggccttgtttggatcctccgagctattaaatagccctccagaattttgctatttaggagtattaaacgtagattaccgataaaaccgattctataacccctagactattttgcgagacgaatataatgatgtatattaatccatgattagcggctgattactgtagcatcactgtagcgaatcatagattaatatacctcattagattcatctcgcaaaatagcctagcggttatggaatgggttttgtcagtaatctaggtttaatgatccaaacagggccatgaggacagtttggaagatgacgaactgtgtgtgaaggtgacgaactgtgtgtgcagagcctcttggctgttactgacctgaatagcattaatagaaatatatagctttggatgccatgaggacagtttggtcacactccatgagcaggggcacatagaaatgaggtatccttccttccttgcatatgcattggttaatagcagatgttctcttccacaaggaaacaaagagggttcttatttagttcagtgattataaaaggcagcatttccatcatcaattctttttaaattgtatgtattctattcatataatacccttcagcaaccactgtacaatgttagtgtgtgctcgttgtagttcatggctttaatttctaggcttatagtttacaagttatggcattgtattattgtttttctcgacataatagacacgccaacttggttggtttcacaaaaactatgttttgtttagaaaatcaagacaacatgggttttacagaaagaaaaaaaaagagggggagtatgggttgactaataaagtcgtggctctaaggaaaaatgcaccaactcatgaacagcccctagcattggatacgaagcacaatcaggatttcctttcctttatcacggtaaggatactcctttcggtagtaagcctagtaaccacatgattaaaaaaaagggagaagttttaacaagattaaagttttgtttaatttttttaaaacatggctgatatacagagcaatttaattaccctaccaaggggtaggccctgttaccatgatagctatagcatcaaacatgccatagaggggctaaatagagatttaaaaactaaaggctgagattacactcaattgtgataaacaaaagctactacatgcgtagggttcaaaactagcatggcacaagcttttttaacttatttgaagtcctactcaattctagtaatgtaattgcaagcagtagagagattgagatatgaagatcaagcacggagacacggagactttttagcaaggtatcatagactcagtaatctattagtcctcattggagcactctacattatagtctcacttctttttatggtcacaaagtccatagccgctcttttgtatagctattcttcactatggaagccaaactccaactctccaagcctttcccaagatcatcgggtcttccacaaaatccttaagagatgccatgaataacaagatgaaaacttcacttgaagctactcagcactactcttttgtgagtgcgtacaaagccactacctcgctcaagtaatcactctgaaagcttaagtcctccacgagttatctcaagttgcaatgttatccaagagataggaacaggtacatagcatagagtatttagtctcgactagcactgtatatttatacctcaactacacaaactagccatttttaaacattgcctttgaagtgcataggacatagtctaaccctttaaacttttgcgatggtcactgaaacaactagcagttgcgctataaaagggcagatagttcgatcttcaccggactgtctagctggtgattgtttggctaatccaacccatagaaagtacattgcctagacttgttcggtccattggtgatcaacttcatccggatagtccagcttgcctagtcatttcagcctattgaagttgagctggacaaattcattgtcctacgcgtcaaatttgtatataacaaattgaccagccatttgaaaaacaaactattcagacaagtctagaccaggttggaaaaacaatagctctgacctatttggttgcacccaagctatctggcccactgagccattagggcaacttaaaagaaatgcatcaacgattcatcgagctcacttcaacttcaaccataaagacttagcatttgatttgagaggctagcagaccctagtatgcaccgcttttcttgtatctaaaaaaacatctagatttattctcgccgtctcaaaataaactaacttttatcaacaaatctagacataaacaacttctgattatgaatctagatattaactatgtccagattaatagcgacaagttgggccatgggtaactaaaaatgcccataccgcctttgcgttaatgggcctgggactcctaccgacggccctactcgacccgactcccggaggcggagatcgacttcgccccgccccgccccgccgccttcctccgccgccgatctccatcccgcgagggtgaagcagcgttgccggcgtcgtccccctcctgctcacttcctcttccttccgctcgccgccggtgagcaccccgtatccctctcatccctctccgctctttctcccctcttctaggtttcgaagctctttcctctttgccttaaacccttgttaggactaggagtagtagttttagttctttgctccatagaaaatatttgtgggcggttgaatcgattgcgagttgcggcaatctctgatgctggatttcgtatcgacagggggcgcgctctctctgatggtgatggatccccttaccaacaaggctgccttcagtggcctgagacagtatgtgaaggagc

SEQ ID NO: 102883 - DNA, 575 bp, Oryza sativa
ccctgagtttccgtgccaacgtttgactctccgtcttatataaaatttttttataattagttttttcattgttgttagatgataaaacatgattaatactttatgcatgacttatctttttatttttttttcataattttttcaaataagacgaacagtcaaatgttggacacgaaaaccagatttgtctttttttttttttggagggagggagtacattggatcagccttgtcctttgtcgctgatgctatgaatgatttataccactacaaaaataataaagcagtagaaacaagaaagtcaagtgcctagataggagtagtagcttagacaatggacaatgctagtcttgtctgcaagtgaattcactgaagatgctcctaaaaactcaccaaagatgttgacaaagttggtttcttgattcagattaatccctagaagaagcagctattgacctttttttaaataaaaaaaaattaaagcaaaactatagatcaggtcaggtcaaaatcaatgtgagcgtggctccatttctacaggacaaagggtgtgcatttactagtagtaacaggta

SEQ ID NO: 102884 - DNA, 628 bp, Oryza sativa
ttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcct

SEQ ID NO: 102885 - DNA, 695 bp, Oryza sativa
tttccataggtgtgcctcctccctttttcataaaactgagaaaagtgatcaatggggaaggggttgtggttttgctcatcatggaggtcatccctgttgttgaagtgaatgtgcaagagctccttgaatgcacggcagttgatagagcatcgaagggtccccgacatccacttcatggcatcacaatcgccggacacctacacggtggcatagaattgccggatgaggtcttcatcaaaacgttgcttcatggtgacaatcttatcaatgccaacgggcttgaacatctcttgcaaacctaaaaactccggtgtctcaccaatgtgcctccaagaaattcacttgtgttcggcgaaggctttgtttgcatatacttgctcatacacggacttttgataccgtgtatggaatctcagatcattgcaatcattaggcctccggaattgatcgtgatgacagatgataatgtattgctaggcattcctcaaatagagcacaaattggatggtgggatctcgaggactcccatcatcactttgactcatcatactcaacatcggcacttgcattattatcaccaccatcactaccattgttataaccacttactttcaactcatacccctcaatatttttcataaccccatcacctctttgaacatactcatctccgtttgattcctcattctcactga

SEQ ID NO: 102886 - DNA, 640 bp, Oryza sativa
ggccatcttatatatatcatatagaagatttttcatggaaatagtcaacggtttatatcatataggagtataagattttcatggaaatactcaacggttcaatcttcaggaacaggatactttgtctttaaggggtaacgatagaaaaacctggatcctctaacttcgagggagtaaaggtaagtgtagtgtatgagtgtagtgctacagtggttcgtagatggcacagcaggcggtataaataaaacaaaataatataaacttattatattacagctcctatttcagtatacttatcatagaagctgcaactataccaaatattttttaaatcctgaataatatagagtggagttgactcttcgctgcctaaaaattaggctataaagacccgccgctcctcggctctactccacacccgaagtagaagccgtaccaaacgggtctaaaactatccgacatttattaatataagagcaagtccagtagcatactattagccagctatcaacatattttagtgagataaaagatgagagagaaaagcttcgggctatagatctatagccagctacagagtacggactccaaaacccaatgcgtgtatgataggtgggaccatatattaatagtatagtaa

SEQ ID NO: 102887 - DNA, 688 bp, Oryza sativa
cgttaccgaagaggagaagcttgagcagagtcggtgatggagacagaagaataggaggttgagagagagaggtgagtggttggagggagaagaaataaccctcacatgtgggtctcagaccctgtttaaatgggataaaactttttagtcctatcacattggatgtttggacattaattataaatattaaacgtagactattgataaaagccatttataaccttggactaattcgcgagacaaatctattgagcctaattaattcatgattagcctatgtgatgctacagtaaacatgcgctaattatggattaattaggcttaaaaaaattgtcacacgaattagctcttatttatgtaattagttttataagtagtttatgtttaatactccaaattcatccgatatgaaagggactaaagtttagtccctggatccaaacaccccctcactcgtcacatcatccaaaaccaaaaccagacactatactacctagaatcttgggtatactggttttacaagttgagagacgtgtgatgtatatctggtattgtggttctctgaggacgtaatttaaactacgtgtgagcataagggacttaaactgaacttattccaagagcgtgcaacagataaccgggccttatggcttataatcttgggcacactggttttacaagttgagat

SEQ ID NO: 102888 - DNA, 689 bp, Oryza sativa
aggggaagcagcccgagctccttctccccacaccatcaccatctctctcttctatctctttctcacgatttcactctatgtaccgccgcctagagccgctgcgccgcgcctcctagcgccgccgttgccggcggtgcctcgctggagttcgccgccgcctccccgaccgccggtcgctgagccgggactcgctgccgcggtgcgtcgccatcccagaccgagccgagcaaaagagcagaggaggaagaagaaggcggagccgagccgctgacaggctgaccccatgccccttttacctccatcccccactgacaagccgggcccgcgcatccttcctcccatccatcgccgataggtgggtcccctcttctgccgtcccagctaacggaatattccaacggaatattcccttacccgtcccaaaaaaatttgggttatttttttttcgccagaaaattttttattctttagaaattcgtagaaaatcaaccgtaactccgattgaccccgttcaagttcctaaatttttctaaaattgaaatctacacagtgccactattggttctctgatttgagctaaatttaatggcttttcttaattagctttgtttcacgtttagagcctaagtacgaggaagctttctgaccgccgttttcgagggagaaagacccgcaccctgtgcaaggca

SEQ ID NO: 102889 - DNA, 1244 bp, Oryza sativa
  unsure (1)..(1244): unsure at all n locations
ccccccccccccccccccgccgaccgccgttgtcgcccccgcggatccatcggcggcagcactggatccgtcgccccagcagcccgccgtcgtcgccactgccgcttccgtctcccccgccacccgccatcgtcgaccccgctggatccgtctcccccaccgcccgccgtcgtcgccccagccagatccgtcggcggaggcaccggatgcgtcgccccagccgcccggcgtcgtcggcggcggcggatcagtcgccccagccacccgccatcgttggcggcaccggatccgcgcagtgcggcggcgcacccgagtcggccaagccgcccctgccgtgncggcgttgagnaagaggnagggtcgcctcatcgtcgttggtgaggagggaatgccgggctgccgagctgaggccgccaagccggccgccgcccgccaccgccgctgtagccgctccctatggcggcggatccggccctcccgagggcggcgccgccggatccgccaaccgcgccgacgccgccggatccgccaaccgtgccgacgccattgccatccgccgctcggccgctctgagagagggagagggagagaaagagagagggagagagaggagagaaagagagggtgagtaaaaaattaatagagggagagagaggagatgaggtagaaaaattttgaagtgatgggagggaagaaagagtggaggaagataaaaaaattggggtggtatttttgcatgcggaccacttaaggagccgcatgcaaaaatagttattaaaaaataatttaaaaatatgagaacttggaatcaaaatttttaatactaaatgaactcaaatgaaaacgttgccaaaaacaaagttgtagaactcattgagatctaccaattttcttttggtcatttctccatccgagttttattgaactacagaaaatttgaactttataatataagaaattcaaataatttttttacatagtaaataatttcaaatagaaaagttgtcaacaacaaagttgtataacttatcaagatctgcaacttttgtattggtcatttttccatatgactttgtttgaacagtttgaatttgaatttcaaaatattacaactttaaacaacattttcaaatacaaaatgatttcaactgaaaaagtcatcaataagaaagttgtataactcatcaagatctataacttctattttagtcatttcttcatccgataaagtgatttgtaagatt

SEQ ID NO: 102890 - DNA, 678 bp, Oryza sativa
ttatacttagggttcggttatatttagaccgattgagtagtaggaaaatatatcgcccaggctctatataatatgtataggttctgggtagatgaagagtaggtgcttaacatatggcggataagtaatattgtagtgtatgtgggatctgaatggtagtctcattaaggtttcagttgtctaagccgatatcgaggtacgataaatatcggctagggtttgggtgttcgcaagtcgtcgctacagcatgacgactaggtttggtgtcttctcgacccggtgtcaatagacaatacatcagccagaggtatgggaggtttgtacaggtttagcaagtcagaagtgttactttgacacccgtgagtggcgacggatcgcctaggatcacacagggcccgagagctaactgtgcggcgtgctatggaggtcaagcaaatagtgaagctccgaccactgtacgcatcgaggcgtggggtgccaggagcagcacttcgaccttgggtttggttttgccgggctttacaaccaatggttcaacgtcggggccaatagaccgcatccgtccccatggaaggtgtaaagttccaaccgacggctttttagtggctaaagggtattttgggataaaagaaaatatttaaaaaggcaaatataaattcaaataaaatagcaaattgg

SEQ ID NO: 102891 - DNA, 1041 bp, Oryza sativa
agagaattaagaaatatcgtctaattcaattttagaaagtttacagacccaaaaagcagggaggctggggaaatggctatggaaaatgatgaatgaagagggtttgttgcaaagtcttctgaaggctaaatacttaaaaaaaaacacccttaaacagtgtgttttcaaacctggtgtttcttttttctggaatgggttcatgagcattaaagacgattttatgaaattctgttccaaaaagattggtaatggtgaagatacccttttctggcaggaaaagtggctagagaattcatcacttgttgagatgtatctagaattgtacaatataactttgtcaaaaattaggatagtagataaagtttttaagggcgggctggataggctacagtttaggagagaaaaaaattacagttcttgagaaaataccttaagatacctaaattttacactaaaatttttagtaccttgaggtattagtagctagaggcattaaattttacactagaaaatatggcacctccaggtaccttatcaaggatggtaaaattaccctttaggaaagcctgatagaaggaaaggctgttgcctggggtaagctacagagggattgtgaaaatgttgtccttaacaatgagaaggtgcattaatgtgggacttggataagagaaaatgtttctctgtaaaatctttatataataattcacaattacaatgtctaaacttcccctttaggaaattatggaatttcaaaatccctgttaaagctagagttttacctggctgttgactaagaatatcatatttcttgtcctttgactacatttatttggaatgtggtggctagttcatttggctttaatttgagaaaatccttaacactcatcatttgttgggtgactggttccaaaagtttgagaaaaagacaaaccctgattgcggttggtattccagcagtactttggtgtatatatttggaaagccataaataatgcatgttttgagagaaaatggatttctcattccaatgatctgatatat

SEQ ID NO: 102892 - DNA, 543 bp, Oryza sativa
  unsure (1)..(543): unsure at all n locations
attcatgggtcccgcattgatatagacgtgctcctcaacggtgacataattttatcggtacgtagcaggccatttaagcattgttgtcaacggtaacatctcactcggaccaccttaaccgaaaaatgcatactcctatataattactacaatgtagccagttgagatccatacttggcatcctttatggaatgagtgaaaagaagatggcggtgataaaaaaagattttgtttgagccttgagttgatctattggatagagtagacaaaatttgtttaaggtgttaatcaatagggctaaattttaggcgcatagacattctttttaaaaaaataccaaggctgatcattccactatctaatagctttagtgacacagacatcctttgctaacttaccagttagtataagctntgatgttttatgcgttgaatatacatctaattcacctatgcatgtacatgggagataatatgcgtcggaatttgagctaatttgttaaaactatttggatgagggtgacatataaatcgatatcatata

SEQ ID NO: 102893 - DNA, 666 bp, Oryza sativa
  unsure (1)..(666): unsure at all n locations
agatttttcttttctgtctaattcatgcaatttatttcaaacaaaaacgtatcttattccaggcaataaatagagttagggtagagtttaaagcagccaatagaaanccgaaataataaagggttaataccaaaacagactcggactcaaagaggcacttgtttttttagatcttggaaagctcaggatgaatttgaatgtgggaccaaaaatatctgaaactagatctcataagctttctaataagaagctgatattgtcaaaagggcctattcaacagctctgcgtggtggattatgtcttgtgcctaaaataaccagcatcgtaaactcatattattctttttctttaccgagatttgctcatggctttatcttgttaggctccaatagttctctcagatttcttcataactagataggtgtgagattccttttatctgtgtttcacaaactctgttctatttatcggataaccataaaatactctaaagtaaagtgctacaccaataaatctgtgttttcttggatacattttgtgagggcataagaaataccagcaataaaccaaatcacaagtaatacttgcagttttctccttttgaattgatgtcttagaagtagaatatattatgacaatagaacaaatgcagcgtatgtagattgg

SEQ ID NO: 102894 - DNA, 627 bp, Oryza sativa
cgcgaacggttgatggatctcgaccaggattactgattgaaaagatcgtgtacccgccgagataaaagttcttgacttcgatccatattctcgattacagcaagacgagagacttaggtcgtacactctatcgctttttgggagacatgagagattaagttatacataccttttcagttgccacacgaggttgactaaagaagaccaacgttatctctaaactcaccgagaacgggtacatgagcttgattacagcaactccaatgtctgcgcgcggttgagaatatgaattcattcatttgcatcaaaggcacgagctatggtcggggttatggataccacataactaatagacggttactaaatgtcggaaggatccaccacataccatgtcttattcggaaactgtcttcagatatggaaggagctctggataaggaaagacaaccagagttctacatggcaaccacaaggactactcggattatatgcatattgaattacctaggtctacttgcacaaagagacacctgcgggtattaatacaagcccccctaggacgacagggggtcacccatgatgtgaaacgatcgacacgatcaataaccgccatgggagaccacgaga

SEQ ID NO: 102895 - DNA, 601 bp, Oryza sativa
ccttgtggccattaccgggtactggctgagagacgggcttttgtctagctgaataagtctgacctgttacgccagcctgaccgtcggtccaatcgattcaaccggtactcaaagaagcgttataaactacttttttccgttttacagtagaaaactttctagcattgtctagatccataaaagatagggactatatatacatcatgtgatagattttttagcctcctatcatgcagatttcttaccctttagatgaacatctaacggatgacattaatatatacaaacaaaatacaaaacaacaaacgggccacgtggacaatctaaagctcacgtgggtataaatgggctcaagtagttttcagacttacatcgtaaatatactaaaattacatatataattttcagacttacatcgtgaatatactaaaattacatatgtaattatagtgtaaatacgatgtaattcagacaaaccctctttgcggcgcggatttcaaaatttcaacaagtaaagtgggccctacataaactctgatggacacaacatacagtgggtcccacaaagagaaaaaaaagtcccacataaccgtgaaagccc

SEQ ID NO: 102896 - DNA, 1047 bp, Oryza sativa
aagaagctctcttagttaactcactttgctctagtgctagtagagttagaattagaatagtctctttagttctcaaagtgtaacatcctaaaaattcctgacattaaaaatcactaaaattttgacttttttaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggcccgatctataatagagtttctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaaactcatttaaataatacaataggaaaatatataaaatatgggtaatattaaattttggtcaaatttcatctaaaataaaacatatattgggtaaaactctaattgtgtgaaatctagaaattatgggacaagttttaataggaaataggcctcaaaagtggataattaggaaaaagtcactgttcattatggcataggtgtttgatgt

SEQ ID NO: 102897 - DNA, 3535 bp, Oryza sativa
accaaccgggattaaagataaaggaggggtctgacaccacctgccgttttttgaaccaggactaaaaataatctttacttccggttggtgttaccattcggaacaaaaaatcaaaaagtagctctaaccttagtcccggtttttattataaccggaactattgtggaatttgctggatggaccaaagatggtttttccagtagtgtattatatactaaaagtccattaaacgtcctacaaacgctctcataccgctatatggcactctacaaatgcttctatgttgccacgtggctctctaataaatttagagaaattaaaaaaaatctaaccgtcagttatcatttaatctggtggacctatttttttaaccattggatctataataaaaatagccaattaaatttatcctgaaaaggcccacgtacatgcccccatacgtgcatgaacgtacgtacttcatgcaccgggccccacgttcctcttttttttctctttttcacgcacatgagataaaaaccgaattatttattctataatgtattatgtgttttatttattcatatattattagagatttaatatcaaatatattattttgacacgttgtcattgtcatttatctcccactttagagttcgatcaagttcagtacgtgagcttatccagtgcacacagagtggtgcaagtcattagcacataattaattgagtattaaatataaaaaatagaaataaattaattttattttaaaaaaacttttatataaacatattcgcaatacacgcaccgcgtaatatactatttagtagttcgggaaacatgctcgatataaataagggagtagccaatccgataagcactttagaacatagccttaaatgtattatttagtagtaaaacattaatatatactccctccgtcccaaactataaggcctatattttttacgcgctcttcaactacatactttgaccattaatttattccatattatattcccaataaatatgaaattaacatcatatgaaagcactttaaaatatgaatatagtgatataacatgcataataattagcatatatataattagtatgattattagtcaaaagttaccgagtttgattttccttaaaatgaggtcttcctatattttgggatggagtaatatacaatatatttgtatacttggtcaatcatagcctaaaatatcaaacttatgtcctcactgattcccatgtatataagttctacatataagccactatccactgattgctaaataatattatttacgaggtatccatgcacaatgcacctaaaaattagctgatatccaatgagcatgtgcgtcatccaacactgaagataaatggcgatactaagtacacaaccatcaacaaactatagagtaagtagacgatgcaaacaatagttgactacaagtagattacaactgtgagtaataccatccctacacttctacaaacgctcataagatatcatgtgatactctaataaattagaaagaatctacgaaaagttatataaaaaagtaagcatatatccatcaatttacacttaaaccgatgatccattattttcaaccattaaattaaattagatatatgaaagtaatccatctgtcctaaaaaaccatatgatctgtctctacatacgtacacaactcctatataattacgtacccaatagatataaaaagaaaaaaaggaatagtgtgtatgtgattcgtcccatatggtagttttctctttctttccagctctaagattttcctaaattgaggatatatatatatatatacatagcaaccactcctagcgaggtggtaaaacaagccattgcctataaaaacattgcttcactctcatcccgtcaattttttttgaaagtatttttttactagcaatgtaaaagtcaatcatatgagctcatatatatatatatatatatatatatatatatatatatatatgtgtgtgtgtgtgtgtgcaaatgcacactatgaatacacatgcatgcaccatatccctatattagaaaaatattcattcagaaaaatgaaaaaacaaacgtatgtacgagagactactattcactagaaaaaaacatacatataactatattatatctatttttatgtcaccctcatccaaatagttttaacaaattagctcaaattccaacgcatattaactcccatgtacatgcataggtgaattagatgtataatacaagaaaaaaaaatcaaaacttatactaacttgtaagttagcaaaggataactgtgtcactaaagctattagatagtcgaatgatcaaccctgctatttttttaaaaaaaatatctatactactaaaatttagtactattgattaacaccttaaacaaattttgtctactctatacaataaatcaactcaagacacaaaaaaaaactttttttatcacctccatcttcttttcactcattccataaaggatgccaagtatggatctcaactggctacattgtagtaattatataggagtatgcatttttcggttaaggtggtccgagtgagatgttaccgttgacaacaatgcttaaatggcctgctacttaccgataaaattatgttaccgttgaggagcacgactatatcaatgcgggacccatgaatcaaggcatttgaaaaaaatccttagcggctatagtcggcttcatccgatcgtcaaaggagcattcatatataattttaattgttttatcctattaattggtagaagcggtatttttaaatatttatatgtagatttggacctgtgaaatatgggcacttgggtataatgtggatattaactttttatggtattaatgatgtattggggtttttttatacagctgcaattccatcgattaaaaagacacacatacttcaaaacaatgataataagttatggtgaatggtgaatttacatataattgggataaagtgatttttagttggacatgatagccattttgatcatttactacatatcaaaatcaatggtctatttcttacagtgaatatggcgagatatggtttcttttagtattctttttataggaaataaataaattacccatacatctgcgcgggctttcttcctagttcgttttaaaatataaaagatttgaagaatataaatacatacaaatatttaatctcttatattttaaaacatatgtagtatataactctttttatcctataataaataaatgattatttctttttctcaaagattgaggatgtagctagcaaaagtacaatattgacacaaaatatgtagaagatagaataaactagtaaaaaattgatacgtacagattaaatcagtacaatccatacaaaaaaaaaggtaggtacgtgggaatttattttgggaacatttaaaatccgaaatatcttatactatataactgagtgtatggtaaaatttagcggtgtaggatcctctatagtcgacctgcaggcatgctagct

SEQ ID NO: 102898 - DNA, 948 bp, Oryza sativa
gtatttttaaatatttatatgtagattggaccctgtaaaatatgggcatttgggtataatgtggatattaactttttatggtattaatgatgtattggggtttttttatacagctgcaattccatcgattaaaaagacacacatccttcaaaacaatgataataagttatggtgaatggtgaatttacatataattgggataaagtgatttttagttggacatgatagccattttgatcatttactacatatcaaaatcaatggtctatttcttacagtgaatatggcgagatatggtttcttttagtattctttttataggaaataaataaattacccatacatctgcgcgggctttcttcctagttcgttttaaaatataaaagatttgaagaatataaatacatacaaatatttaatctcttatattttaaaacatatgtagtatataactctttttatcctataataaataaatgattatttctttttctcaaagattgaggatgtagctagcaaaagtacaatattgacacaaaatatgtagaagatagaataaactagtaaaaaattgatacgtacagattaaatcagtacaatccatacaaaaaaaaaggtaggtacgtgggaatttattttggtaaaatttaaaaaccaaaatatcttatactatgaactgaggaaatggtaaaatttagcggtgaacagtaccctccaaaaatttagccataataataactcacaaaaaggccacgtgtgatggacacgctgctgctcttccaccgaacccaaaaatggcggctacttgagcttcccctctcctcactcccccttattccttccttccctcgattcctcttctctgcagcagcttcacactcccactcccacttctctctctacaatccaaactcactctctccctctctctctcctcatcaccaatgc

SEQ ID NO: 102899 - DNA, 985 bp, Oryza sativa
acgggctagggtttgggattttttggatttttattttttggggggttttggattttattttattttgtttgctgattttatttttgcatgcggccggtataagcgaccgcatgcaaaaatcccattttcgcatgcgggtgccctggccacatgcaaagatttgcattttcgcagacgatttggtgcatgcggttggcgcaaccgcatgcgaagatcgctccggcccatttgcaaaaagggtttttgtagtagtgtgggtagctttagaacaagttttatagtggagctagatgtcgcctctaatttaaaccatatcatctactcattaattaagagataccaagtataatatatcacatctaatacacaaattaaaccccaatattagttcactctcacatcatgttgcacttttcttaaaaattgtgtagaggttgtcgaggaatggatcattctgtctctctttagcttctctcctctacctcataacctgatcctatgtggcagatttaggggcaacatgtaaaggcttatagtacttgctcatattaccacatattatgaaggtctatttggtccacctaatgtttcttctttaactctagatgaaagtcttataagtgatattccctaggtgtcttctttagaaaagtaatgcttcagttgatgaatttactgagaatgaaattaaagatgcaatctttcagatggaacataataaagctctgggtccagatggattttgatgtgccatgagttccactcgacactcaaggctaggattggcctgatctttcggtgagttgtagataactatgatttgagagaaatgttgacgatctgactataaccgtacaagacgttgcgttgcgccttagagcaggtacaatagcatgctataagctagctataaacatattttaaagagataaaggaagagagagaagagcagtgggctacagatctgtagtcagctgcagcacgg

SEQ ID NO: 102900 - DNA, 620 bp, Oryza sativa
acgcaaacgcgcgagacttaatcacttgcctctcgcaaagaacctcgccgcccgccatgggtcccgccgccggcgctaccgacgtgaagtctctcccgttcttcaagaccctcaacctcgccttcttccgttggtcgcgcccgcttgtcgtccctggcgccggtgccgcgtcactgcaccggtcgcagtcgtgcaaggcggcgccgacaacgttgccgccgccaatgaagccggcttgcccagagtccagagagaagatagagagatagaggaggaggaggaaagagagaggaagggagaggctggcctgctgacgtggcatcctgacatgtggggcccacgtgggtcccatgctgactcagctgccacgtcgaacaaaaccagggtcaaacccgccgagggacctagtttgcactggttttgtaagttgggggacatgttgtatccggttttgcggtcgggggacgattttgtaattcgatgacaatttgagggaacttgggtgtactttttccttttcttttttactaaacttgctacaaatagaatctctggggtagctcagaaagtaattagtcccactcatacaacttttatatctgggaggaatattatggagg

SEQ ID NO: 102901 - DNA, 765 bp, Oryza sativa
atgataaaaatagctcccagcaaagcctaggcattatcattatcttaatcttctgccggcctagatcaccctcatttctctctacctttttatctgcaagcgacatctttgcgtaaaggtaaagaaaaccgtagcatatatgattactgggcatgcatcgcgtacgtggatcatatctttctgcataaaagctcaggtgagtcgctcattggcttcttctcttagtatattttgctttgcattgacgcatccaaagaaccaaaaattagtcttctatgagacactttgagacacggatgggagcagggaaggaatgaagaatttgttgtggtcagattcggccatatcactgcaggccctatccgggaatcggggcagtctctctcgaggcaggctctactgaaaaagaaaagctggagattttctctgtagcttctgtaagaactttcacagtacgcttaggtgtcattcggcttgagccaaccaggtcaaagattcaactccacgtcggtctctctcgttgccccatgaagaacacggagccaagttgagcctcaggttccttgtcatgattagcatttctcgtgctaaaatagtggcatcgtggatcatgtatgcttctaagggcttgggcctagctagcaaccgacgcctagcaagtgtagtaactgcactgctatctccatgagaatcaaaaccagagtcctacgctccttactatatagctgagtgtgtttaattcacgttaaaattataagtttggtt

SEQ ID NO: 102902 - DNA, 643 bp, Oryza sativa
cggcgtgcgcacctggaagaggaagaaaaaagcgggttgcttcttgggctagttgggaaactagagagagaagggccgaaagagagaaaagaagatctcggcccataaagaattatttgtgaatttctaatggaatagaatttgtatttggagggaatttgaatagggaattttgaaaggaaattatatttgaatataatttccaaaagggatattttctagtttgagtgcaatatttttggaagtggaatatgggcaaatttatattgatgcactcaattgtggggagagggatatatgaataaaagttgaatatataattgggaatgtggaaagaaaaataggtggaggaaaaagaatagaatttgaaccctaatatatatggcatgggtttcaaggaattgcttgaggctaaaaggaaatttaggtgacaaggatataatttattttcttagcacaagagcaattattcacaatatttgtaataatattattcttgtgccgagaaggaaatcaagccacaagaattaaattagcggctagatcaaaaggaagaattttgaaaaaggggactaaggataggtttggaatcaaaggatagatttaagatcaaaggatgggtcgacaattaattccaataaaa

SEQ ID NO: 102903 - DNA, 710 bp, Oryza sativa
ctctacttctaataatccttatttttaattccaaatttcagctatttcctaattgtatttctatatgtactctatactctacttctaatattccttatttttaattccgaatttcagctatttcctaattgtatttctatatggagtctatcctctacttctaatattccttatttttaattccgaatttcagctatttcctaattatatttctatatgtactcttgtctcgtcttctaatattccttattttttaatttcgaatttcagttatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacataaaggctcctttttctattcgtttaataatataatagataaatataaggtgcttgatctacgacttagctgaatttaattactttgggccaatcaattaagctttttttttccaagaattgaattaacttcgggaaggaagaggttaggaacttctcccagcacatgtcaaacggggtgactaattatgtattaattaactaaaataaattttaaaactagattaatataattttttaaaacaactttatttgctatcgaaatgttttgaaaaaaa

SEQ ID NO: 102904 - DNA, 744 bp, Oryza sativa
tctcatttacttgttgtatttatatttgtgcaatttacatttctagagacatactagagatcatttcaccctaggattgctaaactagacttaggaagtgtgatttactttcctagtgatatacttgagccactttcaccctaggattgcaaaacataaattagttgcttagttagtcttgtccctcaccgagcctagcaacttaggttagttttgattaggtgtcatttaattttaaatcacatattcacccccctctagtcgacttctcgatcctacagtgagcatcagggagactaaatcggggatccctacctggcgcgtgcgcgcccctggtgctagtttttggtagttagactaattctatttatcttagtctcttagataattacagtttgagataatgatggtagtagttagtattttttcgtgagatttttattaactaacaaattaaaaagaaatctatatctgaagtcaaaatttcaaaaatttgaaaactttcaacttgaaatttgaatttttcaagtcaaaatttgaaaactttcaacttttcatcttaaacttgaaaaactttcaacctagatttgaaaactttcaactcaaatttgaaaacttttcaactcgagatctggaaacattcaactcaagatttgaaaactttcaacccacttttgaaaactttcaactcgagatttaaaaactttcactcagatttgataaatttcaactcgagatttgaaa

SEQ ID NO: 102905 - DNA, 714 bp, Oryza sativa
catggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaataactgaaattcgaaattaaaaaataaggaatattagaagacgagacaagagtacatatagaaatataattaggaaatagctgaaattcggaattaaaaataaggaatattagaagtagaggatagactccatatagaaatacaattaggaaatagctgaaattcggaattaaaaataaggaatattagaagtagagtatagagtacatatagaaatacaattaggaaatagctgaaatttggaattaaaaataaggattattagaagtagagtatagagtccatatagaaataaaattagaaaataatagaaattcggaattaaaagtaaggaatactagaagtagctattatattattaaaagagtttaaagtcaatataggaatacaatttagaagtaactgaaattcgaaattaaaaataaataatattgaaagataagtttagagtgagccttcacgttcgctctcatggcctagaaattctcacattaatcggagaaaaagaaaatgcagagttcatatggaaatacaatttagaaataactgaaattcgaattaaat

SEQ ID NO: 102906 - DNA, 789 bp, Oryza sativa
  unsure (1)..(789): unsure at all n locations
cgtgcgcctgagaaccgcatgactatacggctcatttgagctcggcaccccagcccgccttgtcaggtttgccaccatcagccactaccttctcaccacaagctccgtataccccaccgacaacatcgacacaccgctgcgtgctcgtcggtcagctgaaggaagatgatgcccctatgtggagatagaggtggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatggtttagttcacagcaacatttgatccatacgtagtgaaacattataagtacactaggtgaaacatttttcggtggataaaaaataaaacgaattccnttaataggngttcccaaaatatataaggttttttggt

SEQ ID NO: 102907 - DNA, 704 bp, Oryza sativa
gtatatcacatataactaacccaaaagttttatcctcaggaaaaaagaacaatttctttgctgcaccaacggttcctttggaaagtaatatatcttcctttttcagtttaagactgattatttttctggaaaccctccatgtcacccctgcaagaggcagctgcaagcaacatgactcagtgattagtgtcggctctgaataatttagccaatgtaatccgtgcattgtagtagaagaattggagggtacgagaagaatgaacagagactgcactcacctgctcaagtgctgcacgtgggacccacccatcgatttgtctccctgctgagccgggccccaccgccactgcagttgcattctttggtccaaccccggatgtcattgcagatggtgtggtaataatcagttttgtgttaatcatgcgtgatctgtttgccacaggatccagcattgatcatttctctctacaagccaccaatcattctccttgtttgcattggatccaacactgatcatgcgtgcttatggctttatgtcaaccattattactagtcgttactccgaagggagagtgcttggagctgatagctacgagtatccccgtttcgagcaagtttaatagtatagccgatataacagtcaattcatgcaatagctgattactatactattaatatatggtcccacctatcatacacgcatt

SEQ ID NO: 102908 - DNA, 659 bp, Oryza sativa
cttccaacttatattttgggatggagtaatatacaatatatttgtatacttggtcaatcatagcctaaaatatcaaacttatgtcctcactgattcccatgtatataagttctacatataagccactatccactgattgctaaataatattatttacgaggtatccatgcacaatgcacctaaaaattagctgatatccaatgagcatgtgcgtcatccaacactgaagataaatggcgatactaagtacacaaccatcaacaaactatagagtaagtagacgatgcaaacaatagttgactacaagtagattacaactgtgagtaataccatccctacacttctacaaacgctcataagatatcatgtgatactctaataaattagaaagaatctacgaaaagttatataaaaaagttagcatatatccatcaatttacacttaaaccgatgatccattattttcaacccttaaattaaattagatatatgaaagtaatccatctgtcctaaaaaaccatatgatctgtctttacatacgtacacaacttctatattattaccgtccacaattgatttaaaaagaaaaaaaggaatagggtggatgtgattcgcccatatggtaagtttttctttcttttccagctctaagattttcc

SEQ ID NO: 102909 - DNA, 714 bp, Oryza sativa
gaacaaattttgttttctactcatgtgcatctgatttcagtaaattctaagattgtggaaatatattatgaagtagttcaaaagcttcagcacaaactgaaaatggagttggggattctagaatgctgagaatgttctgaaattggagaaattcgagaacaaattttgtttgctacacatgtgcatctgatttcagtaaattccattgggcaatgagcagataaagttcatgtgtttactaaattttggcaatgtaaactatccctttatgtctgaaacttcgcaggtgtatagcatcggttacaggcttctgcgtttcgattaacttgtatagtagacggatttttttttagcaatttcatttcaaaaatttcccctttgttgtaaaattcttgaattggttaggacttggggtattcacatggtggtcaacctttcaggatcttcctgaaaggcagattgtgaaatactcctacattatgcatatcatcagcttcagtgcaaactaactggaactgggtgttccgagattagttaaattgaagatcaaattttgtttagtggacatgagactctgctttgagtaacttcaagtgcgtattgtattgagcagttcccattcatgttctatagagagttttggaaatgaaacccatcccttttatctctgaaacttcccaacattatagtatagtgttgaacaatttacaggct

SEQ ID NO: 102910 - DNA, 588 bp, Oryza sativa
actaggatttgtccaagagttgtgtggtgtttattactcttggaggttgaggactcctagacgactaggtgtcgttcttgggccaccgatctacgtgtggttggctaagaaaagtttgtgaaggccggatctcgtctccgcaaggaaagagatacccttagtggaaggaggagtgcatttgtgcaacctcacgaggatagggttgaaaaagacccggctctttgcgagcccctcaacggagactagaatccccttaaggatttgaactccgggaaatacatcggcgcgtaaacctcggtgaattcctcactctctttaccttcttgttccattactttgtgctatgctaatattgttgttggtcgagctcacctctttacttgtggattgaatctagagctcttaggttgttctcttgtttatattgttgttgtgcaggtcagatagtctaatatcagttcagactatccgatcacataggactatccgacctgatattagacaatctgaccctgttttgttatagcttccgcatttatttttaaaaccgcctattcaccccccctttaggcgacatcaaggtccttt

SEQ ID NO: 102911 - DNA, 2104 bp, Oryza sativa
atgtttacataaaagtatatttaacaataaatcaaatgatagaaaaagaattaataactacttaaattaatttttttaataagacgaacgatcaaacatttttaaaaaagtcaacggtgtcaaacattttgggatagagggagtatattataagccgtttgacttttttttttcaaactttattgagtttcatcaagtatatagaaaattttagcaacatctaaaatatcaaattagtttcattaaatctaacattgaatatattttcataatatatttgttttgtgttgggaatactactatattttttctgtaaacttgatcaactttaaataaatttgactagaaaaaaagccaaacgacttataatataaaacggagggtaccagataaagtaaatgtttggtacacaggaccaacaacactagtctattttttaaaccatgtatcattttaaaattctgtttataccattatataaaaaagtcaaatgattcgtaatataaaatgaagagagagtataaggtaggtgaacgatgtatatttgtaacttcgagagaaggaaatgtgtgatatgggatgtgggttggaaggcggctagtaggttttatattattggtgacaatgaactggacagaatgagtttatagagtgtgttggtcctgagagggagacgggagtaaatgttagtagcagcacgaagtccaagtgacctagctaggtcatcagaaaatggttgggtttctatttgccatttgtatgattgagatataattatattggacttttatatatcttattatagtaaattttagtagcagcacgaagtcgaagtgacctatgtcatgcgaaaatggtgggtttctttttgccatttgcatgattgagatataattatattggactttgagtagattgcatcaacgatacacgaacttatcagataggtgcaatctagcgcacaaacttgtaaaatacttgtaaaacacttgttttgatgtatgagcttgtctagtacgtgcaaaccaaagccaaaatggcacgagaaggctgatttttcaaagttaaacattataaattatattacatgacatgcgtgctatctataaatttggtttctactttatcttcctttgtttctatttcttgcattgttactcgattttttatctctttcttcatacaatcaatatgccttattatatgttttgctaaacagatctttatctacgtgatatttatttacatagcattcaaatcaataacaaagtcagcaagattaaccatgccgtatgattttggtcttgttcgcacgtatcaaacaagtttatgcaccaaaacgagtactacatccgtttcaggttataagatgttttgcaaactgattcaaatttgactaattttgtagaaaaaaaataacatttttaacccaagacaaatttattatcaaaatatattcaattattgatctaatgaaactaatttggtattataaatattactatatttctctataaacttagtcaaacttgaagtagtttgactttgaccaaagtcaaaacatcttataacttgaaacagagggagtattttacaagttcatacactagattgcacccaactgacaagtttgtgtaccactgatgcaatttactcttggacttttatatgtcttattatatcctattaagtgttggttagctagggtttccatgtgaatatggcccaaggtctatattgtaagagcgatgctccggtgctctctaccagcagaaatgatctaaaccgttcacaattaagggtaaattagtaatttattaatacagtgattacgggtaactttgttatttatgtatttttttttccgatctagatcgatttgtggtcatccattgcgctgctatcgtttatatcccattgaaaaagccaaaggaaaaaaagagaaaaatgtttagtgactgctaaataatgattatacccctatgtacctattgcctattggaaggtcctaagttcgaatccaactatgacgtgcaatttttaaaagtcacttgaaaaatcatgaatttctagctagtgaggtgtgaccatggttggaatgtcc

SEQ ID NO: 102912 - DNA, 798 bp, Oryza sativa
atatattatgaaaatatattcaatgttagatttaatgaaactaatttgatattttagatgttgctaaaattttctatatacttgatgaaactcaataaagtttgaaaaaaaaaagtcaaacggcttataatatactccctctatcccaaaatgtttgacaccgttgacttttttaaaaatgtttgatcgttcgtcttattaaaaaaattaatttaagtagttattaattctttttctatcatttgatttattgttaaatatacttttatgtaaacatatatttgatttattaaatatacttttatgtaaacatatagttttacacatttcacaaaagtttttaaataagacgaacggtcaaacatgattaaaaaagtcaacggcgtacattcagagaaaagagggagtaaaatggagagagtactggcctttgtattatctgacacataaaagatcgagctagcgatatttctggataatccaatctaggatgataaattttttggatcggtcgacgctgactaagtctaaatagtcctccctccgtccctaaatatttaaccttgttaatatttttaaacatatttgaccatttccaaaactttggtgaatattattaaaaacttgagtagtagtactttatttaacaatgaatcaaatgagtagaaaaaaattaataattactttatttttttaataagacgaacggtcaaacatatttaaaaaagtcaacggcgtaaatatttagggacagagagagtacatatatacgcgcgcactaattacagtttgcctata

SEQ ID NO: 102913 - DNA, 1980 bp, Oryza sativa
tttttttgacaaatttgccaaaaaaatggtatggttaaaaatggcatcaatctgaacagccccttactatttttgttgttatgagatgataaaacataaatagtactttactcgtaacttatgtttttaaatttgttcaaaattttttcaaataagacggacaatcaaagttagacgcgaaaaaccatgactacacttaaaatgggatgggggagtattaaaaagatgggaaaaaggtttattagttaccttttgagttttgtgattgaggtgattgtcgcatctaatattattcacatcatcaactaattaattagatggcaactcatacaccacattacctttaatatactactctcgatacaatacaaatatttattttattcactctcatccaatcaatgtcactcttttctccttcccccttaaagtttgtgaagaggttgcctcttgcatgagagcaagtttaatagtacagccaactactagctccaattcatctataaccaatctgatagctcatttatacaatagttacatactacactataaatacatggtcccacttatcatacacacactgtatcttggagttcgtgctacagctggctacaaatctgtagcccgttgctcttctctctcctcatttatctacttaaaatatgtttgtagctggcttatagcctactattgtacttgctctgagggatgactcattctctctcatctcctctttcctccacatcatcatttaagcttagatggcacctaagagatttgtgcttaaatacctatagtacttgccctgagataggtgagtgccctgagataggtgagggatagatccggactagttgacaactataataaaatcaagggtagtacaactaatatagtaatttaatggtaaaactcatcttttattagctagtaataaatcgttatatctaggataaaaattaaattatagagcactactacaaaatcatttttataatatctagcttttaattttccagatggattaaaaaattccacttgtaaaattaatagaagttcctatagatctagccccggttgtaaaaattattaacctgaaaggggaccgtttataaaaatacccttattttcataagcggggcctaaagagacccgcctgtaaataagactacctattaatcttttgacaaatttatagtttcgaatcttgccgaatttcaaccaatggatatagcccgttttagataaaataacaaaaaaaaaataaacatgtaaaataatcttaaatctagagaaaacattattgtaaaaaaataatctaatttcggtacattgtaattgagtgcaagtgctatgtaactgagtgtaagcgcactgttaactgagtttaagcgcactgttaactgagtttaagtgttatgtacttagtgtaactgtaaattaaatatgcaagaacacgaatcctatgcaagattctacgtacgaaaagtgaaagataggaatccaaaagtccgtcgcaaatgaaatagcgaatccgccgttaaaagcaaccattattaaaatcgacagagccaccatgtattcacgctaagtactctctccctggaccctccctctcgctcagctccctcgatcccctcttcctcaccctcaaaggagcaaagcccagggccaccataggggctcctctactcccctgccatctcctagatctggctctcctccttccagatttggccaaaaggggaggagactagcggttgacagtcgttacagacaaattttgaccgccaatattactaaaatatataatggagaactagctatgcttataatgcatatttgttttcaaataatatagttccacttatacttggagaataacatgttgcaggaatttatcaaataaaataaagaaaaagtgaagagacccctcattcctaagcaagcaaatggattaagataggctcacaagtcagg

SEQ ID NO: 102914 - DNA, 2076 bp, Oryza sativa
  unsure (1)..(2076): unsure at all n locations
taaaatanaattacttgagatcatggggttttgaattgatgagaaactattgtgtcgaacaatggaggtggttcctatgataaaatttagggtattttaaatcgccaaaaggatagcttacaacctcaaaacaaattcaataatatcattttttttgtttgattgtattttaatatatatatatatatatatatatatatatataatatattcattctaaccgtccttgtaaaatgtttgaatttttctatcaagtattggttttaaatccaacaaaatttgttcaattttcaatttatttcatgcccatttttattttttttcttttggatagttttattctatgaatcatccttgaaatgatttgatctttgcaatttgggacaaaaatatcagaacacataacctagtatggggtaaaggtatacgttctaaattttctctcctgaaatataaaagtaatggtcataatgtatttagcgaatcatcactaaagtgtattgtcttataacaaatacatgtttctagattgttctacgtcaagactttacaatgtactgtagcaagcttaataaaaataaataaaaaaaggacatggtcattaattcctatatggaactgacttgatttattgctaaagccactgcaaggttgttccacggttaaaatccttaggtacaacccacatgcttatcgatatgatgttcaaccaaccacaccttcattttcaccctattgtctatattgctagatgaatacctgctatgattagtgacttcgtagatcatatgtgtaattcggacgctatgatcatctttcttaaaaatatttatctatgtactaaaaacattattttgaaagtatcaaggtcaatttgtataggcatgttaagagaaattaattaagttggcagaaagtctttagatgcctaacatgatataagtaataaatggaggtccatttgtgtttttttcccatatagataattttaattttaattgtcaaggagataaaaaatagagagaaaagaatggcgcacgctgtacatgggcagggagggagggagggaggtttgggatgtttttctaaatgattaatctaacagactaaaataatgtgtcagatgtttatgtcgaaaccgatggtcggatgttttgttttcttgtcagaattttattaggattttatttgatttaagagaataacataatatcttaagagcatttataagatgtgtaatcgacttttaacaccgtatgccgcaaaggagggagggaagaaggtttagggtgttcttttttttttaaaaaaaaagatctaatgacctaatataatgtgtcaattaatccattgaaaaaatgtgtccatcgatttatgtcatatctaatggttgggttttttttttccaaaatttctaagatttttctctaatttaagaatgccatataatagcttagaggcattaataatatatttaatggattttaacaccgtacggggatggggagggagggaggaagagaggtttgggttttttcttattaaaaaactaacaaatcgatagccaaatgttttgttgtttttttaatattttctagtattttatttaatttaatagcaccacgtggcagtttagaggcatttgtaggatatttagagttacagagcgagagtgctagacctaataggtggaggtctctttgtgatttttttaatgtaaaaataattttgattataatttctcatgaacatagctcgttggtacgtacgtgacgggaggttcggaatgcgtgcttttttttaagaaaaaaatctaaccttctaatataaaaataatagatcaccgatttaaataaaaatcgatggttggattagagtgccacttggcgacctaggagcgttcgtaaggtaccacttggcgaattaaaagtatttttaagatatttaatgaacttttatatataattatctttttcttgaaaattctaagaagtatgtgatatagtagcttagaggtgttcataaagtgtttaatggattttaacaccgcataggggtggggagggagggagagag

SEQ ID NO: 102915 - DNA, 1570 bp, Oryza sativa
tagctcgttggtacgtacgtgacgggaggtttggaatgcgtgctttttttaaaaaaatctaaccttctaatataaaaataatggatcaccgatttaaataaaaatcgatgattggattagagtgcacttgacgacctaggagtgtttgtaaggtaccacttgacgaattaaaagtatttgtaagatgtttaatgaacttttattatataattgtctttttttgaaatttaagattttatttaatttaagtatgtgatatagtagcttagaggtgtttacaaaatgtttaatagattttaacactgcacaggggtggagagggagggacagaggtttgggattttttaattaaaaaatctaacaacttaaatccatcaatttaagtagaaatcgatggtccatcgttttgtattttttaagattttttaatactttctctaataatttaatagtaccacgtagcgatttagaaatagggagagctgctagtcctagtagttggtctatttgtgtttttttacctgtaaaagtatttttgtttttattttctcattaaacagaaaataacacatgaatgaaaatatggaaagacaaaagggaagtacgtacagtacatacgcacgtacgttcggcgttacgtacgttggtttcttttttctttataaataaaatagatctaactaaatccaaccatccaaaacaatgggtctaccaacataagtaaaaatagatggtcagatttttcttatttattatggtgccacttggcgatttgagagtgtttatagggtgtcacttggcggtttgagagcgtttataggaaatttaatggactttttagtatataatagatagatagataaagtggaactcttaggttatatggtttcctagtgttcataatagcaaagacattagctatttggtaaatccatagaatactgataataacttattagtaccaattacaatgacttcagatcagacttttaagtcctgttatagctatttatatatgcagctactccctccagttttataattcttaacgtttttgacagtggcacgaacttcaaattatatctttgacattgtttttctactataatatatacaataaataaatgtatgttttacttttattgtagaactttgaaagacaaattcatatatgtttttcttgttgttttaaactaaatactttttaaagttattgatagtcaaagttacaaaagttaaaccttgtccaaaatgtcaagaactgtagaaccaagggagtacaatttaagcagctattttcagagaattccttatgcttacatgtatgatgttgatcgattcccataaaaatattctgattacatgaaatcctaaggcgctggttaaatctcaccccaaaatttttcaccctatcacatcaaacatttaaacacctgtatgaagtattaaatataggctaaaaaataactaattgcacagattacgactaatttgcgaggcgaatcttttaagcttaattctacatgatttgacaatatggtgctacagtaaatatttgctaatgatggat

SEQ ID NO: 102916 - DNA, 592 bp, Oryza sativa
cttttcttttcatggaaaatttcatttctgatcctagtagtagaatatatctagattagctttctgctcttgttagactcctaagcaagataaagttaattttagtatagatatagcttggattagtgatgggcgtgaagctagctagcagtagtagtagtgaactagtgattgattgctgctgttttcatgtttgggttactggggtgcagtgtgttccacttccaccaacacactagtggcctgaaacttgtgcaatctgaggctaattggcttgattgtttgcgtggtttgattaattagtacacatgtgtaggtgcagacatgactttgtctgtaatcttatcttagggagagcgttatatttcatgtaacacgtgctactcccttcattccacttaatcaccctatagtttttttagttattctcaaataatcatcatattaatattattttccaagtctattcattatatgtacataggagtaaaaggatattgatatatccatgcacataaccctttataaaccaaaatacaatgttttgatttgtggtttgctagaaaatagtatggatgcatgtatacatcaa

SEQ ID NO: 102917 - DNA, 530 bp, Oryza sativa
ctatagggcgaattcgagctcgggtacccttaacctttaaattatcgtaaatctatagatttaaaatgatgtatcaaactatagatttatcaataaatttatcataaaactatatgtttaagactaagtatcacaaacttacagattatgtagattaagatttggtccggttcttttctccaacaagagttggatgaagattaagatttttgtagtacgcttttcaaactgttaaacggtatgtttcgtgtgaaaactttctatatgaaagttgctctaaaatatcatattgatctatttttgaagtttgtaataattaaaactcaatcaatcatacgttaatacaacatcgttttacgtaaaaaacttaatcttcatcttcatcttcaagagaaaagaacattagtataataaaattatcacaaaactacatattctggggtctaaatcctcagcattaatgaatatgttgttttgtggtaactttgttactaaatctgaagttttatgatattccacattaaatctat

SEQ ID NO: 102918 - DNA, 1465 bp, Oryza sativa
tcctcattttttttattttaattccaaatatgcgccatgtcaatcccacgtgggacaaagactaggtcaattgtgccacgtaggcgccacgtcagtaaaaaccaccttcaaaaccgtttagggagtcattttgcactggttttaatagttgggggagtcgttttacctggttttgtggttgaggggtatgttttagatttaacctatagttgaggggagtcaaaggatattttttccattttttatgatcgcttttgctcatcgtcttcgtcttctcaaatttcatgtttcttttctcaaaaaaaaaatttcttgcatcttcttccttttttttaaaatgcatttcatgcttctttttcttactaactgtttcttaaattggtcgggcttgttttaacatcaatacaaaatagcccaatgtagcacatatatagattaaatcgactggtcacgaagcctcaatcgtatcgatcggtcgatcgatcatataccagcatctatgtactctatttattaaccactaaattttgatttttgaccaaggttagatggactttaaccgttgccatgtgaaatatgacgcgccatatgaaaaagattggggggagtagtaaagtatcttgaattgaaattttggatctttttttttggaccatgggtttctcaaaacaaataaacatgaaaaatgcatgattagaataccatcacaccttaaatcttataagaaataaaaatacacagaaaatcatttagatgagcatagaaaaaacacaaaattttgagtatgaaaagaggtagatgcaaaggaaaatctcaagaggttaaattagagatcatgataggaattcttcaaagatccatgagatttgtcaacttgatacacatgatctggctctcgatcaatacgatccaaattcctagtattacctgtctagattcgtagtagtagaatgtgtcacatccaacgctaggtttttatattctggtactatgaatctaaaaagagagttgtccagattcgtagttattctttcgttccaaaatataagcactttaagattagcacaaatattaagaaagtattgtgagaatgattagaaaaagtgtatgattagttaagaagagagagtagatgaaggaaaatggtttgtaattggttgagaggagcaggtaggtggagaaataacttcattttgagacaatgtattgtgctagaaatagctacattttagaacagagatagtattaagttgtgtcacatcttatttaattttagatttgtttttcatgaaacatgcaaagtattttaatttataaatactttgtgttcgattttagtgcatgcaagacaaaaactcattaactcatgattaattaagtattaataattataaacttgaaaaatatatttatttaaaatttttaaataatttttatacaaaaaattttcataaaatgtatatcg

SEQ ID NO: 102919 - DNA, 547 bp, Oryza sativa
taaaatggtaattgactttcatagttgatttgtgcagttaatggcaaatgcgtcatcttttcaatatttgtatctatattctccgattcgttcaggacagcaagctcacggcggccgtggcggtcctgccactgtcaagcgtgcctccccgacccattccaggcgaaggtggaattggaggtggtggtggctgtggtggaggcgcacgggctccccttccttcgtagtgtgccatcgacgaccgcggccgtcaccgaccgttgccgtcgccgtcgccgtcgctgatttcgagtgtgcctcccgctctgcgtcgacgtgagttcaccataatggattttttgtgggaatacaattacacgataccacgggacctgggaggatcagagtagaatcactgtagcatatcgcgtgattgtctgcacaccaagacccgtcgagcacttcatttgccgctgtcgtgcgagtactcacactcattgtaggtgggaccaagaacaatagcggcaagctggcaacccaaacatttccttaatccaaactgcaacct

SEQ ID NO: 102920 - DNA, 943 bp, Oryza sativa
ggcgccagctactctggcgccccaaaaaggaccatttctgggataagtttttctaggggtctatttgcgaaataagtttttcaaaaggaccaaaatgtgaaaaatccagaaggcggaaactggcgctccgggggccttgcgccggattcgatagtcaaaaagtatgaattactaccgaactattacggtaataagatttacccttctaaatacaataccggacatttgatatcacaaactcttaaaatcggattatcactctaattcgattcgaagcggttttcagcctacgtcgcacacacgtgatgatacagtcagcaaaaacaaataaaaaccggtggagcccacttgtcagcgcttttttctctctcctccttctctgcctctctctcggggaaaagaggagaaagcaccggcaggcagggaccagggccaatccaatagtgagggcaccgaggacagcggcgagtagaggtagaagcagctgtgggcggcaggcgaggagccgaggatggcggcgggcaggggaggaggcaactgctcacggcgagcgaggtgtcgaggaaggcgaccggaggggcggaggtagctgcgggtgacacagggggagccgaggagggctggaggtggcagaggtagctacaggtgacagatggggagcggaggcagctggtcgcccgacgaggatgcagcgtacgtactacacgccggggcagccctcgcccggctctgatggcggccacggccgcggcgagggcgacgagacgtggagcgaggcggcgggatcctccttccccaccgtcgtggctacgcggagctcggacatgtcggggttgaagaaattggacacggcgatgctgctacagctgtccccttgcccttccctgcgcaaagcccgctgaccggttccccctcctcttctcgcgccgccgccaaccacccg

SEQ ID NO: 102921 - DNA, 1527 bp, Oryza sativa
gtcgccgaggtcggtcatcaccggacccgagccggatccgctgcgcccgagcttgccgccgccacccgccgccgtcgtcatggccgaggttgtcgtcgccgcggggaggtcgtcgtcgccgcacctgagccggatccgccgccccccgagctcgtcgtcgccgaggggagctcgtcatcgccgtgggggagggcgccggcgccggatccgcgtgggaggagggcggccgacccctgatctgctcgggggagggccgccgccgtcgccccccgcgtgccgcctctcgagcccgccgccgccactgccgccgccggcctctgtgcgtggagaggagaggatttgagagagagggagagatgaagagatgaggactgagagagagagagaagtagtagataaggccggttgaagtagtagttgaaatatttttgaacggttgagagggaaataggaggcccgcatataaaaatggagcacttatttttacatgcggaccacttaagcgtccgcatgcaaaaatcatgtgttttttaaactttaaattgatttttatgacattaaatcaactcatgtcaaaaagttgtcaaaaacaaagttgtagaactcattgagatctaccaattttattttggtcatttctccatccgagtttgattggactatacaaaatttgaattttaaaatataagaaattcaaataatttttcgggtagtaaatgattttaaatgaaaaagtcatcaataataaagttgtataactcatcaagatttacaacttttgtttttgtcattttttatatttgacattgtttcaacagtttgaatttgaatttcaaaatatgacaacttcaaacaacattttcaaatactaaatgatttcaactgaaaaagtcatcaataacaaagttgtataaatcaacaagatctataacttttattttgatcatttattcatccgataaagtgatttgtaagattgttcacgaaatgtgcatatcatatagtttataaaaaatatatagtttataaaaatatcagagagatgtacattttgtgaacaatcttataaataactttatcggataaagaaataactaaaatagaagttatatatcttgatgagttatacaactttgttgttgatgactttttcagttgaaatcaattactgcttcaaaatattatttgaagttttcaaattcaaaattttaattgataaaataaagtcacaagaaaaaaaaaagccaaataatagcagtaagaacacaataaggatgattttagaaacatttagaaaaaaaatcatctaatttggagttcatatgagtgagatacaccagttttaaatttttcaaattttatttttgcatacgtcttcttaagtggcccgtgtggaaaaatcgatttttccatgcgggcacttaagtgagccgcatgcaaaaatgagctcatttttgcatgcggcccacttaagagcccgcatggaaaaaacgaatttttccacgggccacataagaagacgtgtgc

SEQ ID NO: 102922 - DNA, 542 bp, Oryza sativa
caatcacacattgaccaaaagtttgaagtttgatccatatccattggtgcccagtagtatataacatcctcattattttcgccagccatagtttcctctaaggtttcttcggctttttcagacaaggatacctgatgacataagaatgtttaaaacttatttccatgtcattatcaattgaaaacggcctcattcaagtgttcaagcaatctcagcacatggaaagcatagaacaacaaaaggaaaacataggcatggcaagccaaaaaaaaaaaggcattttcatggagatgaaaccaaatagaacacatggaaagcatagttccaatactttttaacatctgaagcaacaattgtattgcaaaattgcatttagctggtgcagcatagaattgcctacatgataagcatcatgagttcatggctagagggaactgttgctactgcttaaaaaatcctctatgaaaaggtcgaggaacctattttattatattgtatgtccaggcaaactggaaaactgagatagtttgggagatttggaa

SEQ ID NO: 102923 - DNA, 843 bp, Oryza sativa
aatttatttggtgttgaaaatactactatatttttctactagtttgatcgaacttaaatacctttaacttgaaaaagaatataaaaaccgacttatatataaaatggatgagataattagttctcccaaaaaagcccctacttcgataaaaagtcaaaaagcttgaaactcccaagaacatagttggaattaaatttgcaaatatactgttgatttgttttttcccataaatattcggaatgcaattttttttatagaaatatactgtcggttttacacaaacattacgtgaaaataacgtgggcacgatgtcacaggcggtttcgcacgcgcgacctcgcgcgaagaaatagcgagaccgaatggctggggtctggggcagttcaagttgtttaattatcgattaattaattatttagtaagctaatcaggataattaattactaattattattgcttaattgctaattgggtaattaattagtcactaattaagcggctgctcactaggcaagccgttcgctctagctcttttattttagcgagaccgtttggtcttgctgtctcacgcgcggtctcatgctatcttgtgagaccaactgcggcgtcaagtcacgtcattctcgcgtaaccgttgtgcgagaccgacggtattttttgtcaaaaacaaattaacagtatatttataaatttaattcaagctggttgaacgattgaagctgaacagtggacgtgctcttccgagcagagatgatccagcatcctgttcagcagcataggctcacaccatcacttttgcaattttgtgcagcaattaggtatttatggacttggactagttta

SEQ ID NO: 102924 - DNA, 1052 bp, Oryza sativa
tttaggtgccctaaaatccttcgatcacgagcaaataaaaaggtcaaattaactagcgagcacaacagtacacaacatgcagatcggaatgaacccattgcaaacgcagtaccaggtaacaaatcaacttcacctctccggaaagacttctctctttatgggaagtaaggcagcgttcgagagggtgagagagtgagtttgtttgtttcgttttccgcgcgcacatttcccaaactactgtgtttttttacaaaaattttctatagaaaagttgctttaaaaaatcatattaatccatttttgaaatttaaaatagttaatactcaattaatcatgagctaatagctcacctcattttgcgtatcttcctaatctcctcaatccccttctcctcaaacacaccctaaacacaccctaagacatgtactaataatgagtgtgactgattagtcgcacgtgcaacaagaaatataattattatatgattaattaataaaaatgaaaaataaatttatttgattttttaaaccaacttctacataaaattttttatactaaattaacaattggagaaacatgctaatagaaatcgaaatcgaagaagtaaccaatccgttcactttagaacagagtaacagactccctaaggaaaggagatcaagaattcaacagagatgggccgacccaaaaatatagggtatgttcactttaatatcatttttaaccttaccaaatttgagtattaccaattttagcatagttaccaaaattttggcaggatttcttatatagttatcaaaatttgacagcaaactaaatgtaaccacttttttgacaattttactaaaatttggtaaggttgaaaatggcatcaaagtgaacatgcccatattagcctacaaaatttcaggtactgtgtcctagtggattccagatccgacaaagaaacaaaagctcatattcgtgcacaaatcttgaagagaaatggacggccacaaaattcaactaaaatttgtcagttcccagtcacctgaacactagcaaataccaaa

SEQ ID NO: 102925 - DNA, 695 bp, Oryza sativa
ataagaataagtaataactgctattagcaacaccaaacacggcgataagcaagaaaacaaagtgaagtgcaggatgaaaaactcacgaatttctcgggacccctcgaaaccaccgtgccctcctccgctaaatcgggggcacacacagcccctcgaaaccgtggcgctggcgcggatcaacgccgcttctcggagcgagcgatggggccgattcgatccaaaagaaaaagaaaaaaagaaaaaaaaacagaatccagagagatacctgtatacaccggccgccggcggctgtacggctagctgcaggtggccggggctccgtcgcgcgcccaacaccggccggctgccgccggagcccaagaactcgatcggcgccgcggttgctggggaattggatggacaccggaagtggctgacgagtgacatgagtgagcgagcgagatggagtataaaactagagagcactagagcaggggacgccggacttcacgacttcaggggacaaagtcttcgtttttaattcagtaataattgcgtcccataatgattgcacattcaaaatttggtccaaaaaaatcatatatactcgccctaaatataagcattttaagcatagtgacaagtcaaacattttaaaccttaagtattaatagcaaaaatataaaaaagataaatcatgtaaaattgatatttct

SEQ ID NO: 102926 - DNA, 607 bp, Oryza sativa
agtgtgttcccttaacacaagctcatcaaatattcaatataaagcttcgaaagcacctcacatatacattttcactgtgctaagtaggtaaatacagaattaaatgtgctttacagcagtaaaattaaaattttctttcttcaatgtacttcagtaataaaaactaagaagacaagcaagagctgtcttcaaaaataaacaaatatgagatacatctgtatcatggaaagcttgatgtatcctatgatatggagagtaactgagcctcagtgtgacgttataagcagaatggcaggataaacaaggagacaataaggtttcaccattgtagggtcagtcgaagctcagtaaaacaaagaaccatgatgtaaaaagctatacatgcatacttcacgaaaatataagatagccgtgtgcttaccgagttgaacaacctgacgactgaatcaccagcagcaagacaatcggtgtaaaaaaaatcaacaggagaggcatccaattagctaacaaataatatgtagtttgtgatatgcaaaataacagagtagaaaacagaagattacccccttgggttgcgattttgatgagctccttctctttactatct

SEQ ID NO: 102927 - DNA, 1027 bp, Oryza sativa
ttattaagcctaattaatctgtcattagcaaatgtttacggtagcattacattgtcaaatcatggcgtaattaggctcaaaagattcgtctcgcaatttacatgcaaactgtgcaattggtttttttatccacatttaatgctctattcatgtgtctaaatatttgatgtgacagaatttttggaagtttgaagagaaacactacctaggtatagatttaaatttcttcaagagtaaattacacaagactatagttattctgactaaactatcacaaaactcaaagatttaatactaaatttgttaaaaatatataaatttaaggacaagtaacataaaactacatatttaatattgaagttatcacatcactacaaattttagagtttaaatccctagaaccatcgatacgttggaactatatattatagttttgtgactaaatttgttctaaatctgtaattttgagataattttcttactaaatgtgctgttttttgacactccatgttaaatatgtagttttgtgatactatctatagttttgtgaaatttactctttctgaaatttgatattatctaagcaggatggtaaataatagaaacccattttatatcattttggaccctcgaacttcacaccgaaattggagccctgtcaaataggtcataaactaccaaaaattttttaccatcaactttcaaaactagataattaacaccctgcaatatatttttttgttttttaaataaaggtggttttcctggttcatatatttattatccatgttcttctatgtaaatgtcacttaattaggtacagagccatgaaagcctattgaagttcatattattgaaaaccactttcacatagtagttcaaaccatcatgaaacttggtttataatgttatttgctcggttttgaaatgttgagggtttgaagttcacattgctgagaaaccaccatcatatccatcaaaccatcacgaaacatggaatacgggtaccgagctcgaattcgcccta

SEQ ID NO: 102928 - DNA, 550 bp, Oryza sativa
ccatggatcgatagataaggaagaacatacataccttaaaaagaaagtaattatcagcgggggaagtctagaaggcaaatacactgcttacccagccagtatatgtgagcaaaataagatgggcagggtgtcctaccattatcatctgatatcaggtgccgcccttgcacagtgctcctgcacatgatgggtgctgcaagaccaatgtccttcttgcacaatattcaaaatcaagccgcatcattagatatactgaaataaatactccaacatccatcctatattcaggatggaaagaaagcatgaatggcgtaacagtttgggcacgctaataagcttgacacacatgggtcatgggttcaaaggccacatgatgccatatacaatgaactctgtcccaggctactcccagttccagaattcagttgaaagcacaattagataagacaacccgttaactcgtagtctcgtaccacagtatttaactgaacacctgcacttctataactctattctgcactttgtagaggtcatgtattagtcagcaaga

SEQ ID NO: 102929 - DNA, 587 bp, Oryza sativa
  unsure (1)..(587): unsure at all n locations
aacttagccatgaataatacctcatacaataaaatcataaatataatagtcttatatgacaaaattatacacttcaaacaatatagctagtctacaatttccagatttccttcatgtgtaagggcaaaatggtcagtttcatagaaattaaacattcaactaactaaataggcatgaaagggatcaaaaccaaaattcaggggcataaagggggtgggcaaaactcaggggcatagaaatgattggttaaactttcaggggtgtagaagaaattttctcaaccacaaaaccagacatattaaacctcgaactattgtaaccggacaaattacccccccccccctcgactcaatccagagtggttttgatcgtacgtggcgccgatgtggaaatccaatcagcaaaaataaaataaaaaatatagggcccacaggtcatactaagcccttctatctgtgtgttgttggcgttggaggcggcagcgagcagcagtgggcgcggctctggtcggcggcgggcgcggcagggagggggaaccggtcggtggcgacggacgcggctaggcgagtggcggcgggctangcaag

SEQ ID NO: 102930 - DNA, 714 bp, Oryza sativa
cattccagtaagccgcgagacgaatttattaagcctaattaatctgtcattagcaaatgtttactgtaacaccacattgtcgaatcatgtcgtaattaggctcaaaagattcgtctcgcaatttacatgcaaactgtgcaattggtttttttatccacatttaatgctctattcatgtgtctaaatatttgatgtgacagaatttttggaagtttgaagagaaacactacctaagtatagatttaaatttcttcaagagttaattacacaagactatagttattctgactaaactatcacaaaactcaaagatttaatactaaatttgtaaaaatatattaatttaaggacaagtaacataaaactacatatttaatattgaagttatcacatcactacaaattttagagtttaaatccctagaaccatcgatacgttggaactatatattataagtttgtgactaaaattggtctaaatctgtaattttgagataatttcttactaaatgtgctggtttttgacacttcatgtaaatatgtagttttgtggtactatctataggttttgtgaaaattactctttctggaatttgatattttctaagcaggatggtaattaaaagaaacccattttatattcattttggaacctctaacttcacacccgaaattgagccccgtcaaaataggtcataactaacaaaaaattttt

SEQ ID NO: 102931 - DNA, 588 bp, Oryza sativa
tgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagcaaacttatgaccttgatgctactttagtag

SEQ ID NO: 102932 - DNA, 819 bp, Oryza sativa
gggcgaattcgagctcggtaccccaattttacatgatttatcttttttatatttttgctattaatacttaaaggttaaaatggttgacttgtcactatgctaaaaatgcttatatttagggcgagtatatatgattttttttggacaaattttgaatgtgcaatcattatgggacgcaattattactgaattaaaaacgaagactttgtcccctgaagtcgtgaagtccggcgtcccctgctctagtgctctctagttttatactccatctcgctcgctcactcatgtcactcgtcagccacttccggtgtccatccaattccccagcaaccgcggcgccgatcgagttcttgggctccggcggcagccggccggtgttgggcgcgcgacggagccccggccacctgcagctagccgtacagccgccggcggccggtgtatacaggtatctctctggattctgtttttttttctttttttctttttcttttggatcgaatcggccccatcgctcgctccgagaaggcggcgttgatccgcgccagcgccacggtttcgaggggctgtgtgtgcccccgatttagcggaggagggcacggtggtttcgaggggtcccgagaaattcgtgagtttttcatcctgcacttcactttgttttcttgcttatcgccgtgtttggtgttgctaatagcagttattacttattcttattactattactattattattattactcactcccgtttataatgtatgtggttagaattattagtatctaaaataatgtaggcaatgttagaaagtcttacattgtgaaa

SEQ ID NO: 102933 - DNA, 1032 bp, Oryza sativa
aggtattaaacttaactttattgttcatattgcaagataataataaaatattgaaaaaaaactgcaatttttaaaagtatcaggtgttaacattctgtaaaaaagtccaagtcaagacaaacagagagagatattaaatgtgaactatacacaatacacatatgtgtatacatcccttacatggtagaagagtccttaaaatcttcatttgtgccttaatctttggacatgtctgagacatattagatctgtctggtctatgtaatttcaccttatcaatacttaattttccttcttttttaaatgacctattggattagtgttaaccatgccattttgtagtttcgtatttttatactcttgtttcttctttcgatctttaaatttttttttccgtagattcaactggattgtagtttttatttataagcaagtgacattgtgacatggggatactgtgaaatagctattgacaataaatcaaatattaaagtccctacaagagatgataacaggaaattaggagtgaactttgaacagtttttgaaaatgacttggttttgcgccttatctaaagcaatatgaaatatggttttcaacggaaacgtacacagctagttgtcatgtgccatggaatattaggtacagagcttatttgtattccagttaagtataggccctatacttttagagtaaggcgtctagtgaaaacgatggcatctgcggagtcatgtgaaggagattgacttgagtttttagcaattacattgttaagttcactatgacagcccggccaaaaaagttcactatgaccattgtatttgttttaaagcttcatggaagccccaattgatgcaaaagacaaggcattgtgttcagttagctgtttgggagggcaatgtgtgctttattttgtgtagaaggactgctatatttttttggggtggctgcatacttgctattcccattttcaaacagatgcatcaataacatttttgcgtcttaagtcacctttaaagaatttggtcaggg

SEQ ID NO: 102934 - DNA, 744 bp, Oryza sativa
cagcatttagaaaaaagttcgcttaacactttgtggtaagtcaatgtggaaaatgacgtggtgggtggtgttgcttgcatgacacacacaccaaagcatgtttcacccaagtttgcccaagcaatcactttctttagtcagcaagcccagaaaccacctcaagtgctatttgtacttcttctccaagctattctgctagttaaaaaatatttaactgaatccatcaccatgtcactgttctcgtcatcgtccacatggggaaaacacttacaatacaactccaggggggagggggggtttcaaatagttgttcatgcgttggggagtagaatatcaggttttgtacttcagggggttaagtagaggttttggctttttgccattatttataaatcatatggtcctaattatcatttgttccatgcttaattgaacgctagaaacatgtaatagtgaaacagaacttcaaaatgaagcaaatcggctacttacatcattatgaacagcaacatcttcaatcatcaggtaaaactttattgcatactcatattgtcctaaattttcgagagtgctagcaacctccttgatcacatcggtgttatcttttgaacgctccagatgcacattctgaagaaacacctgcacaagtaataccaattcaataactaagaaactcaaaactatacgttgaagtagtcttggatacagtatatacacaagcacaatctaatcttgcagagtaca

SEQ ID NO: 102935 - DNA, 644 bp, Oryza sativa
caaattctctaaggtgacttaagacgcaaaattgttattgatgcatctgtttgaaattgggaataagcagtatgcagacaacacaaaaaaatatagcagtccttctacacaaaataaagcacacattgccctcccaaacagctaactgaacacaatgccttgtcttttgcatcaattggggcttccatggagctttaaaacaaatacaatggtcatagtgaactttttttggccgggctgtcatagtgaacttaacaatgtaattgctaaaaactcaagtcaatctccttcacatgactccgcagatgccatcgttttcactagacgccttactctaaaagtatagggcctatacttaactggaatacaaataagctctgtacctaatattccatggcacatgacaactagctgtgtacgtttccgttgaaaaccatatttcatattgctttagataaggcgcaaaaccaagtcattttcaaaaactgttcaaaggtcactcctaatttcctgttatcatctcttgtagggactttaatatttgatttattggcaatagctatttcacagtatccccatgtcacaatgtcacttgcttataaataaaaactacaatccagttgaatctacggaaaaaaaaattt

SEQ ID NO: 102936 - DNA, 693 bp, Oryza sativa
ggcgtcgtcggcggggcccgtgtaggctcagacggcggcgacggcgttcaagctccggctgtcggagtacgcggcgcccgccggtggggaagatgcgaggctggggctccccgcgcaccgggacacgagcttcctcgccgtggtgacgcagaacggcgtggacggcgtcgaggtggagtgcggccgcggcgacggcggctgggctcgcccaacgctctcgccgagctccttcctcgtcttctccggcgacacgctcaaggtatctgtgcatgtgcacgcatgtcacatctctctatctctttcttctttttttttaaaaaaaaaatggattaaaagaaacctggcgatcgatctagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatgaataacaatgttattatacaatcaatttccaacaaaagattcccgccaccaactcaattaggtggtggtagctagttttgcataagactcctccctgctattaccgttggtcaattacattatttttgggcggaacgtgacgaaa

SEQ ID NO: 102937 - DNA, 756 bp, Oryza sativa
taattttgaaaaaaataatgtgtaagtaaatatgtattttttttcttttgtagttcgttagatgtaatctaaaggtagaaaaaatctgggtgatttttgttagaaatcacacgacaaatggatagacagataatgggtcgaccaatttattatattgtcaagtggcgacttaggagcgtctgtaggagttccatgtgatgatttgagagcgtttgtaggaagatagcctacgcatatgcacgggtaccttgtttaatattgctttaatttttattataaatgttaggatgacattgttgaaattttttttactccattttaaacatgttttggctaataattggtttggacattagttatgattttcttttgattacccttacaatgtataaagtctatactaaaattattggcaaccgtacaaccttaaatttatgaaaaaaattgtgtcacaataatggagttggttcatatttgtttgtactatgtgtgatttttttagaatatttagcgtatcagtttccaaaatttgactaacatttttcttgtgtgctatagatgactttattgatttattatatattaatgaaattatttttcattaaaatgtagcagactactttatctaactaaagatagacttatattgcttatactccctccgtcgcataaatccgaggagtcaaattttatgtcaaaattagaggaatttatatgtaaccaggacaaagtcattttttgaaatatcatcaagat

SEQ ID NO: 102938 - DNA, 685 bp, Oryza sativa
aattttgcccatatgcaggttgatatcgttcctgacattgaagattttcgatatggcaaggcatcgccatctttaggtaagaactaagaacagttataccatatagttaccaaattataatattcttaacactttgttccatgtcttgcaaaaaagcttacttttgctttcttcagttaggttggagaaaaaggtgagagtttcatctgctataaaaggtactcagaagactacctgatgagagaagctatgcatttcttgtttaacatctttgtaattttcttgttatgtgttagtttctttctctgccagctgatatcaagttaaatctgtacaaacaatattgacaatactttactgaagttttcagttatatattttatatattgctaaaatgtttatgctgctctggattgcaaaaataaacaatcactagattatgacttgcatcatcttaaccagaaggcaatatagtactacatattggttcatacatgatggctattcattcctcaatttcccacacacatcattcatggaatatctaaatctgttgttaagttcaaaattttcattgcatgttcacctactattaacaaaaataacaatcctagctgccaaaaagctgccaggttggtagcagaatgttcaacatcagattcagtgtattcttgtgacacatatt

SEQ ID NO: 102939 - DNA, 999 bp, Oryza sativa
tttagtagagtagacaaggtaaaggttactgtcatcctaatcaaacaacataatagaaattgataaagttagattgtaaaaatttctaaaaattctatagtgttgaaatcacatattttatggtcataactgcacagaaccctatctttcatgcctaatgttactaaaccccaggtttcttggtcataaggttctggaacaaatgagtctgtaacaactagattagtcaaactggcagtgatactatttacactgctggtttttctgatgaaccggactttccttacatcaacaattagtttcacctagcaacccccattgctaccacaataaattgtagtttggttaaaggtgggatttcacaaaggattatgagtcttaacaagctaaggctgtgtatttgacaacctgccctttcattgatctgttggttgtagctgaaggttttgaaatttctgaaataccctcaatcaaatggatggctgtcttgtttgatgattaaggattaacattacctggatttttttttaatcttcatttacttgaaattattggtatatgtaaattgactgcaaagataatggttgaatgcggaatctcatgaatttaacattttctgtcttgttccaagaacagtatatctgagctgtgttttatccaagaaaccaacaggaaatcaataagaaaacttatagtatgtgttataaagcaattcttgcaacacaggaaactcatctccagtaagaatctgaccaaatggagcaaaactcttaattgttctaatcatcagcgagcaattgcatctattcttataaacaaaggaaacttctaactcaaatggatataataaaccaagcctattttttggtgttccacaaatctgtttcttcagaagtggttcatcagatgctcataagaactccagaatcagaaatccgctctgtatttcagcgacttccaatatctaaacttgaatagtcaagaaatagcaagacgaaa

SEQ ID NO: 102940 - DNA, 517 bp, Oryza sativa
tgcctgcaggtcgactctaaaggatcccctgtcatcattgcccacggcctggacttctatgctcttgcacacagcttcaaaatcattctggtttgatgcatcgcactctttccaagaagaactgtcatagttaagcagaaccatcgaaatattaaattaatctattcagtcattgcagcaaaaaggaaaaccatgcccagccacgcctcatcagaagttggtaacaggatgaaggcattggcattagtagcgaatagcacaaggttggcatacctcatagcatcaggtaaaatggagctctgatgagaccctgatggagtttggcaagcctcaaccttcagcccttccatgaattgtaagtcatcagaaatggcaggaagacatgtcaaatgtgtttgactttggtcagtattttctggcccttttatgatttcatttgtagtttccaccaatgcatcacggtgtatgagcaaacggacctgttgacaccggtgaaagtcagtctgtctaccaaaat

SEQ ID NO: 102941 - DNA, 645 bp, Oryza sativa
ggtcgaaagtattacttatttttatataaacttgatcaaacttaaagcagtttgactttgatcaaagttaaaacatattataacctaaaatggagggagtagtatgttttaaatgagtttatgtaagaaaaaagcctaaatttggatggcgattccaacccaaatgctaccaaacagtattacattcggataggatgatatctcagagatttcgtttgatacctactcactccgtcccaaaatataataacttttagccctcaagatttgtcccaaaatataacaacttctccaccaacattttcttcccaaccaatcccaactcttcaccattcaccttttccacctacctccactactcaaccaattacaaccctccaccattcatttctacctactttcttaataaacgtgtccaactctaaaaatgcttatattctgggacggagggagtagtacatatcggctgatactttgttcagacaggatgatacctcttagatatcgcttgctatccggtaactaatgtatcattcagtccgaacggaatacctttttgcagcattgtccaaaaacttctcgatagttttcctggaaactatatttctttaaaataaatccccatccatttacttatcttttcct

SEQ ID NO: 102942 - DNA, 616 bp, Oryza sativa
ggcgaattcgagctcggtaccctagatctaaaaaaaattatcgtaggaatagacccttttcgcgatgccagtaaccatgcatcaagattcaatatctaggcgccagcgccgatatccttgtcccccagcagctgagatgtggagggtcggtgccaaacatattggcactaaagatctatttgtaaaatatatttttttaaaaaagggttaaaatgtaaaaagtttttcttacaaataggttcatatcaccaaagagactgagtgtctatttgtaagaaaaaaatatttacattttgacccttttaaaacttttatttgcaaatagatccttgataccgatctcttttgcactaatcccttcacatcagcgacttagctaccaaggatggtgaggacatcaccatcagtgccattgacactgagacattaaacctgagcatcaataactctggcgtcgagaagcctcaccccttctaattatttaatattaggtccttctctaatattcgcgttttttatatcctcgaattttggtatggatcattttcataccctttttgttagttgaccatttaattcctatgaaaaggtctattttgtccataggtacagaaaa

SEQ ID NO: 102943 - DNA, 623 bp, Oryza sativa
cttgttcctatacgcatgtgtcgagttattaactcttgtgatctgtcgaaatgtaaatgcatcttcgtttttgtcaagcaatgcatacacagaaaatgtgcagacactgactttttctcagaggaaagcactatgtgtccatcgcaacaagtctcttttcatgagatgcatctaatgttccttacaagttctaagtattttattttctgattatatcaagattgatttctaaggagctcctacagctgcttgaagggaagaagagaatcatcgagaagaaaaggagagcccctcatgcataaacaattcaatgttttatgcgcaagagcaaaatcgttcacctgtgtttcgcatttcttttaaatgtttgaatgactaactcttcgtttcacgagacaaatgcaaaaagttttatgtttcagacggtcaaataaaacattttgatcacccaatccctagtattatccagaatacatcagactagggatcagtttgcagaaggcagtgacaagtccattgtaagacaagaacattatccggcacaatccctgtaactacctacccctgtaactacctaccctccaaaaccgcacagtctagcctatccgacggatggactcatt

SEQ ID NO: 102944 - DNA, 696 bp, Oryza sativa
  unsure (1)..(696): unsure at all n locations
ctggtgattagaacaattaagaggtttgctccatttggtcagatccttactggagatgagggtcctgggttgcaagaagtgcttcataacacatgctataagcattcttattggtttcgctggggattcttggataaaacacagctgacatatactgttcttggcacaagacactaaatgttaaattcatgagattccgcattcaaccattatctctgcagtctatttacatataccaataatttcaagtgaatgaagattaaaaaaaaatccaggtaatgttgatccttaatcatcaaacaagacagccatccatttgattgagggtatttcagaaatttcaaaaccttcagctacaaccaacagatcaatgaaagggcaggttgtcaaatacacagccttagcttgttaagactcataatcctttgtgaaatcccacctttaaccaaactacaatttattgtggtagcaatgggggttgctaggtgaaactaattgttgatgtaaggaaaggtccgttcatcagaaaaaccagcagtgtaaatagtatcactgccaggttgactaatctagttgntacagactcatttgttccagaaccttatgacaaagaaacctggggttagtaacattaggcatgaaagataggttctgtgcagttatgaccataaaatatgtgatttaacactatagaat

SEQ ID NO: 102945 - DNA, 695 bp, Oryza sativa
atgcgtgctccgtatgatgcccaggttcaagatgctctcccaatgtggaaatagcacgtcttaacatgatgcgaaactgtaaaactgaaaaaaaaataaaggggaaatatgtagtagaaatatggaaactactattggatccaatatgggacgcctgagagtaaaatttttactcttgataaaaagaaatcttacacgttcatttatagattcaccggtaatttacaggttttgcactacatatgtagtttgcactatatatttccccaaaacaagaaactctgcaaaaaaaaaagagacaacttggtacaaaacactaaaagatcgtggtctttgttggacacccaaaaatgtgtatctattcatggaaaccgtaaaaacattatgttctatggacggccaatgtattttattatattatgttcaaatggagagggaaaatttcataaaagataagttgcccatggggcctccttcttctcacctccgctgccgccaacagtgccaccgtcctttgcccccaccaccctccctactaacaaccactgccaccaccttcttctcgccactgcagcgagcactgccataacccggcttgctgctcaacgcactccacctacagggctgcgccaccactatcgttggaccactcgtgccctctctatcaatactcctattgtgccctccaccattgc

SEQ ID NO: 102946 - DNA, 573 bp, Oryza sativa
ccctttgtcaccggtggcgacggctttggtagaggctcttggaagcgccattctagagatggtaattgccaagcgagcgtcagcaccaaggtttggctgcggataggtgtcgacgacggtggagcatctccaacaagctcatagcagttagggcatgagcatatcgtgctggacggctccgtgatgctctaaaaacggaggggagttcgatagtttctgaaagatggtggtgatgtggtagatgggctttgcgaagcactagtggcattcagaatacggcgtcggcgtaaggtgttatggacagtgatggtggacaacgaacgaagcagttgatagtatgtgggggttgtgatccgtacaggtgaaaatggtacgactacgagcgtgacggactagttccgactcttccctgaccgaacttttattgtgtggcaaaaagaataagtcgccgatggagtttgaaagtttgaagctaaacttttatcttttttttttgggttggacctgcgctttcttggtactctgggtaagtctggaaatttgaaaacctgcgtattattttggatgcgtatg

SEQ ID NO: 102947 - DNA, 519 bp, Oryza sativa
tacaacggttttagataaaatattgtcagttgtaaacttgaaaatattgtgaatatatatgtatcatggaataacaatgttattatacaatcaatttccaacaaaagattcccgccaccaactcaattaggtggtggtagctagttttgcataagactcctccctgctattaccgttggtcaattacattattttcgtgcggaacgtgacgaaacatagacataagatattaatcgaaaaccagttaatcgaaaaccagagtaccacaatatatagcaaaagtattgattttggaaaactaataagtgatgcgcgcattcacagttatatattcgaacctgagttttaaatcaacatttaacgatcagccttcttaaacagctaaatagcagggtaaatgggaaatagattttattctttgagggaataggttcactcgttattgcatgtcctccaaatagtaaaaaaaatttaaaaaattaaaattaattaatacgtgatgcatgacccgtgatgaac

SEQ ID NO: 102948 - DNA, 692 bp, Oryza sativa
  unsure (1)..(692): unsure at all n locations
ataatcatattcgaatatcttgctggtactgtgttcagttttaggtgctaaccactaatgtttgcctctttgtatttctaaatcccctctcgtacttgatttgaagctgtgattctgagcttttgaggtattgcactgaaggaattggagatgtaattattcccggcttgtgattaattttgtacatgcatgagctgctcacattggtagtctttgcaaggttatgtcaactacaaacattagttgacttggaaattgatatgcctacaactatggggttctaagtgctactgtaatgcaaatttagggacccaccacacctaaattcgagtacaaggacctagatgtcacatccatgcaagtttgtggacctcagtaaatcgtgtcttagttcaccattataggcctattgtgattgccccatcaaagacatactgcttacatcacanacactaagttgtgtgtacattttagtgctcatagcttaatgtgcaatggtaaaataagattctacataatagcaggcatgntttatatgtacccctgtattttggccaactgtttgattggttccatgatgtctgttctacattgacatagctcacttcttgatgctgcttttctgatcatactctggctattaacttcgccttggttttgtagctttgccaaacattagctttgcttcaccg

SEQ ID NO: 102949 - DNA, 542 bp, Oryza sativa
  unsure (1)..(542): unsure at all n locations
tcattaattgtccaaatcaaatagtgggggcttgcatgcactttcgattatcttagtaagaaaaagcattgttattttggcattgcattagtgatatagacctaaccaactatttcatcacatcctttaattgagaacttgtagctagttgtgttgtggtcatccactcaacttcgcagcttcaaatgtctttgtgttgactttgtgtttggttgagttagctttcctcccttgggagatgctctattttaagcccctaaggacctgtttgggggagttttagattctgagaagcagctgtttggcagccagcttctgagaatctggaaaagctctgaaacctagcttctccagcttctggcttcttagttcaattttcaaaatctaaactgtggactgttgaggcagtttctagcagaagcagctgggacaagctcccctaaacagggcctaagactatctncaacaggctaggctaggcatagcagtacccaaacccaaaatacgtgctccaggggctactgtagcaggaaaaaacatgg

SEQ ID NO: 102950 - DNA, 684 bp, Oryza sativa
  unsure (1)..(684): unsure at all n locations
taaaaggttagtgatccaaatactagtggaatattattattctaacatgtatatgcattacaagtataactagttctcctctattgataatattgacggtcgaaactgatcgctaacgaccgtcaacggcggagcagaaacccagtgaagaggtgagcaaacaccggctaaaaaaccagtgacgctcaccacaccaccaggacgaggagcgtcggagccgacagccaccttgagcaccaaaagataagggacacactagtacaacgagaagacaagaaaataagactactacttacactactaaacaagaggagatggccgccctccccccacatgccccacttccatccttcgtcggcgtcagcggtaagccgccgaagaggaggaagaggggtcggagaaggcgagtctactgtagcggtgagtcacgagagctcgagagagagactggttgagtgtggacgagttccacgagcgtcgagtgtcaagttatccgttctcgtttttgattcttttccgattccttctctcttctgtctcaccatctttgtcttctctccctcatctcctctcacatggcggcggcggtgacagctgcngaggacgaggagaagctgctgcngctggagtagtangcggagcactgtggcaccagcggtggcggcttgtgagactatctcttgc

SEQ ID NO: 102951 - DNA, 643 bp, Oryza sativa
  unsure (1)..(643): unsure at all n locations
atgagcatttctgtaagtcgacagcatgtgactacttactggaagatcggtaagtgttgtgtaaggtgtgtggggggggaagggggcattatatcttaactcttcaaaaaagaatcccaaaacagaacaagaatgagccacattatccggcgaataatagccgttagatcaaccagcagacaaaacaggtagaataaatctcaaccattggataaaaaagtgtgttctaaaactttacggtgtctctccttcatatgtgagaaagagatattgaacatagaagacacatcttaaacatagaataaaaaggaatgtttgtatgatatagagaaatgatgaaaacattctttaaaaaaaactaatatatattttatatatatttcacaacaaatttttccattacataatattactaatggattattcttaaacacctatagaataagataatgatagttacgcacatgcgcgacttcatgcactaaaatatggngaacttttcctgtgatgcctacatattgccttccgaaaagctagaaaccacatcattcatattatgaggtattacttggacactagcaccggataagtcatcttgaaccggccacaaacctcgcatatctaaaatatcttgatagcaaag

SEQ ID NO: 102952 - DNA, 686 bp, Oryza sativa
tagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatggaataacaatgttattatacaatcaatttccaacaaaagattcccgccaccaactcaattaggtggtggtagctagttttgcataagactcctccctgctattaccgttggtcaattacattattttcgtgcggaacgtgacgaaacatagacataagatattaatcgaaaaccagttaatcgaaaaccagagtaccacaatatatagcaaaagtattgattttggaaaactaataagtgatgcgcgcattcacagttatatattcgaacctgagttttaaatcaacatttaacgatcagccttcttaaacagctaaatagcagggtaaatgggaaatagaatttaattctttgagggaataggttcactcggtattgcatgtgctccaaatagtaaaaaaaattaaaagaatgaaattaaattatacgtgatgcatgacccgggatgaccggcagtctgaccagctttggatgggcggtctgaccatgca

SEQ ID NO: 102953 - DNA, 679 bp, Oryza sativa
aaaaagaatgaacatacgagagactaccattcgaaaaaaacttatgtacatatgtacaatcaaaaatgtcatatggaatcatattttatcctttttaattatgtcattctcatataaattgtgttaacaattagtaaaaataattttgataatatagagtatttccttgtacattacccatgaacatgcataggtgaattagatgtataataaaagaaaaaacatcaaaactcatattatgtttgcaaaggatgatgatggtaagtttacatataaccaaaacaaagtgatttttgtttgaatatgatagacactatcatttactatatcaaattatatggtctatttcacaatataaatattcccttctttttatggtaaggttacgaggtaatctattgttcctatagttaatatgatgatataagacttttttcagtagttttttatataaacaaaaataaattgcctgcgcatctgcgcgggcttccttcctagttttaagaaaatgtggtggtttgcctttggccatacttcatattgctagtttgttggcaaccaaatctaacacaaaggaagagtgggagttggtgctaaattctattggctcagcactggaaaatagccatactctacaaggtctgaaaaagataccactccctccgttttaaaatatttg

SEQ ID NO: 102954 - DNA, 610 bp, Oryza sativa
cctacaatatttgttagggtagcaaccaaacactctatcaaagcattatttatgccacaaatttagctttgcccatgaacttgtgtcttatcggcatattttggctttaatccaaatgaacatttttaactctaccctaccaaagttttggtagtgccaaaatttacccaagatttggcactaccaaaattttgatagcacatcaatcggaaacatgaccttagactaccatatcatcttcctagtcactaaactcgagaagtttctccacctcctgctaatttgcaagaaaattactagtgaagaatgaccgaagatgtgctatgccaaatgaatgccaccccatgcttgcaggtagacacaagaccgtttgtgctacagtttagtacaaaatgatgtttagcatcctgtcaaagagaaaatgaaggggattcagcaatgttgttttttaatacacaagtgaccatctaacatcttttgtttgattgccatgttacacgttttgtttggttgtcttctttgccttcaatatccccctcttcacaatgcaaaagatatttttggtagctggctaatgggagtgcctaggcccacaaaagaaatgatttta

SEQ ID NO: 102955 - DNA, 621 bp, Oryza sativa
agaaaattggaaatgaaagggagagtgagagggtccatgctgcatagactattggttagaatgttcttaggatattctaattagagaaaatcccttgtatattgttaaattagtcaatgtcgttgagttttactcattcttttatatactctcgaattttaattttacttttgatcttttctatatcctttttgttagttaaccgtttaacaagtaaaaaagagagaatctattctataccactgagtttgtccgagtttaaaaatttaccattgactttgtctcttcctataatatattggctactttacaaattattctacaatacgccattgaaccgggttttcttttcaaaaatacccaaaaatatctgtatggacatataacattaacaattggtttatctcattagaagtttcaaaaaaaatatgaaaattttcatgtagccttcttacacaacatggaattttgtatttaagtttcaagttttttgcatttctatttttttaaatatcacttatctgttatatgctatataaaatattttttgtcggtgtatttaatataaataatctttcatatggtacataagatatttttgtgctattatattttgggtaa

SEQ ID NO: 102956 - DNA, 594 bp, Oryza sativa
tctttaggccacgagacatttggattatcatagatgacttgtatgaaaagtaatctatgtctattataaaacttgatatcaatatatatacatttgtggattttattatacattattttttctctctcacaccaagttcaaactatactttagttttacactgttgccctaagccaaaatatagtgttatatagttcaccccaacccaatgtcactctactttaacctaaagatcacagagttagtatgaaaagatcaatttatatatgcatattgccattgtacaacttaaaatgtactgtgatattttcagttgcaagataggtgcaatttaattccttagtttttataaattatcctaatgtatcattaattttattaggcactctatgtgtaaatctagcatgtgtcactcaagttgtttacactaaatgggacaactatgttgcatttatatgacacaggccaacttcatatagtttctatttcttctgatgcctaaggatataagtaaaattatgcatagggttgtaatagatctggcagatattagtaagcttatgtcatctaatgcataatttcagacaaaacaca

SEQ ID NO: 102957 - DNA, 638 bp, Oryza sativa
tggaggcatctggaattcacatcagagccgagaaattccgcctcgtgaattttccttcgaagagcctatagttatctttagcaatttattttggatagaaaaaggatacaccatggttcaagttctgtcttgctgtaaaaatttcgagccctgtgcacagggtcagcaagatcaagccggtgacggccaacaatacagcagtctaagcgatcggcaatacaacgtcactggcatgtgatactttgagaattgctcttgctgcaaggaatgcagcggcaacgttagcaggtgattttttttctagagagggatgtatgttaatattgggagtacagcaaaatctaattagaactgcatgtatcatattgctaactactcccctcggtttttttatatgacgctggttagtttaaactttaactagccagcatcatacaaacaaaaatggaggtagtgttagaataattaggctaggcccgatttatcctattaaaatctcaaaggcccataataagtgttaaggataataataccaccttaggatttaagcgaggagtatttcaacctaaatagggagttattagaggcttccttgtgaccggttgaggtgggagtcggaaagccacacccgcgcgcgc

SEQ ID NO: 102958 - DNA, 1322 bp, Oryza sativa
ttaaatcaagagatgaaacaagttaaaatgtgaatttgtaacgatttctcaacctatactatctctgtttttaaaatagatgatgctattgacttttttgtttgattattcgttttattaaaaaaaattagtgtaaatttgctgaagtgtaagtcattcttgaagttttttttaatgataaaacatatcacaacaaaataaatgccatttatataaatttttttaatagtaggaggattggtcaaacatcgtgttaaaagtcaacggtgcagcattatgtattaaaaaaacaggggagtattatttttagttctgtagatgttcttgtctaatgatgattttcagcgagtgcctagctggttggtatggcttctcgtgaaatacagcagtcactcagagtctcagacccttcatgattcatgtatttgcttcatcaatgatgcgtccatagaaaatatttagctttcagaattttcgcatagggatacaaagtatatggaaattctatactttgaatcctgctgaaacatcaagttgctgaacgtcagaggttaagttagttaccccagtgcttatattaggcagaattttcttagggagtgttaggatttagggactaaactttagtccatctcacatcagatgtttggacactaatttagagtattaaacatatactacttataaaactaattatataaatgagagctaatctgcgagacaatttttttaagcctaattaattcataattagagaatgtttactgtagcatcacatagtctaatcatggattaattaattaggctcaataaattcgtcttgcgaattagtccagggttatggaatgagttttgtcattagtttacgtttaatacttctaattagtgctcaaacatccgatatgacagagactaaaattttttagtcccatccaaactcccccttagtctgatgtacgaagttatctatttttgaaaggcaattgttgttcgtcctgtttgaaaagtttacagtgaaaatcgacttcactatgtataaaaaagaaagagagaggtgcaattaacctttaggccctctttgaaacgcaggatagaaaagtagtggatctcaaatagtaaaaggaaaataatttgcaagaagttagacaacttgcttattttccaatcaaattaagccatagactgatagacatacaatcttatgggaaatttcctgtccttttctaatgaatccgaaaaatacatcaaaaggctgaattatccataatttatatggtaatcttaaatttcaaaggagtcagtaatagttgaaaacttagata

SEQ ID NO: 102959 - DNA, 685 bp, Oryza sativa
aagaagaaaaagaaacgggtgttgcaaatatttggccatatgcattgttaattaaccatatcattgcagtggaagattcgaacctatagctatgaaaaaggtgagtttggtggaggagcaggacacggcaaaagaggaagaaggttgactgttgacaagtatactccggtcttaaacttgaaggcacatagatgataagatgatagccgataggcactaacattaggcttaaatttctttcccctgaagtttatcggagatgggcaacctcctcgatccttgcatccagaggtgaagggctctttgaattgaaggtttgagaaaatgtaggaataggaaaaacgtagaatttcgataggaatataagtataaaacggaggattgcaaaacgtaggaaaaatacaggaattaccgtttgattgaaccgcaggaaaaacgcaggaattggatgagagagatagtcttaaagaaaaattaccaagaggttgaagctcttgctaaattttctctaaaatttctataggattgtccattccatatgaatttccaaggattggatatgattcaatcctttggttcaaaggctttatagaaaatttttctataggattgaaatcaccaaaattctatgaatttctttgaatcaaagggcccgaaatgtagcagaagttctaacctactgaca

SEQ ID NO: 102960 - DNA, 671 bp, Oryza sativa
  unsure (1)..(671): unsure at all n locations
ctttgcatgactatcagaaagctggagagatatacgagcagatagtcagaatttatccttcaaacattgttgctcgtaaagcagcagcacaggtttatttgcttataacaattcttgcgttattttgtggtgcatataaattacaaattgattttagcttttatgggctagtagcgttggtgaatgaggttcttcctggtagccagcggcagggaaccattgtagtcagggacaagagggagatacagatataatgatctttcatgcctctatttgagtcaatgaatacaaacatataggtccctagacatgcatgtaaacaagaccaattagcaccatccaaacaggacacttatctctatttagcttaaggcacaagcaagtatgagggctcttaacttctatagactcttggactnctggatgccaactgctaagacttgactctagacacctggatgcacatgacacaactaagaactcatatatctgaactgctatctaatcactgaagccaggacataacaatatggactgctgaggtaagtctagactttcacttatttgctttgtgacttttttgtccagatgtacagggactgtggtccaaatgataaagctataaattattggaagatatgtgaatgctaaactacaaacatcgacttgaa

SEQ ID NO: 102961 - DNA, 686 bp, Oryza sativa
  unsure (1)..(686): unsure at all n locations
acgcgattgtgatgttgcggtcacagatcggcggcggcggagaggagaaggggatgatgtggacctcaagatggcaaaattgcgattacggcggcggccggcgattgggttagggtggggtttgtgttgtgtgcttgggtgggtgggtgggcgtggaagcnatataagtgtgcatttattgtgagtgtctacgtttatactttttttaaaaaaaatgttatactaattaaaccatgtggaaacaataactgacatacacaaaaaacaaaatagtgaaatatgcgaaatggaatgattttgatgttgtaccaactgcttttggcgtattttttatagaaattatcggttttacaataatataattaaccgtatttctaaataccatataaataatatatatgatccatatatctattttagcggccgattagaaatccataaatccttaatttgggtaatgtcaatgatatacttataaacatgtgctaaataaatactaaataaatcccctcacttaaaagtaagaaatagttcatcgggtgattaaaatggttggatttgatcctaactagccccttaaagtctattagaccaagggcaacttagactatctccaacatacttgcctttacaagagacccattggaccgtatgcgtcccgctgccgcaaaaggttctgcccctat

SEQ ID NO: 102962 - DNA, 838 bp, Oryza sativa
attaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatatatatatatatatatatatatatatatatataaaccatgcagcaacaggggcatgcaaaaaaaaaaggtcagctctatctttagtcccggttggtaaacccgggactagagatagcgatctttagtcccggattggtactcccggtttggaaaccgggactaaaggggggttacgaactgggactgcaaagggtttctccaccagtgacacatgattggaatccaggacatgcctcaactaactcaaaaatgaccatcacatggaaccaaattagaaagtgtgatcagcacttttcaaatatatgcattgtatatttttgtcatacacactctctccaagcagtttcaatatttagatactttcaattgctagcaaggcttgttttctttagtttgagagaaacatctgccatcatatttttcattattattttttatatttttggtaatacgtgatgagcagagcatcctaatatacataataaaagatgtttttagttttaaagcgcgcgcatagagtgagtgtgcatctaaatatacactatcaaaacctgatgattttgaagtgtgcgcagatagcgagtatttatatgtttatgtgcaactaaatatacacgtcaaaaaatgaccgcacagaccatg

SEQ ID NO: 102963 - DNA, 744 bp, Oryza sativa
atatggagttggtatagttgatggctccgattgctttggtgtttgaccaaatctcttccaacgagatgatcttggtatttttgaatcactagtttgattatcaaatcgttgaccggctaatcctttcttgtacttagccataagcatctcaaaatcgtgttggcaactttttgtgacaagttgacaagcacggtcacagcacctaaacgccttgcggtgatcctagtcgccaaccacctcgatctagccaaagggccgaatcaagatgggttttgtagaaaaatagctaaaccggctagcggagtcaccaaaaatcgtgttggcaacttttttgacaagtcgacaagcacaatcgcaacacctaaacgacttgcgatgatatggagtcgccaaccgcctcgatctagccagacggccaaatcaagatgggttttgtagaaaaacagctaaaccggctagcaaagccgatttagagatcaaaatcagcctctaggccgatttagatcgatttgaggataactacccgtctcgtgggcaaaacggaaggtttttaggacaaacctacaaagagttgtcgcactctcgcagcggcggcggacggcgtgatgcgtagattaatttcggccgcttggtagaaactattaattcaacgaaacgactaggttaaagcaaattcggccgtaatatgtccgaatagatcgattccccagtggagtcgccaaaaatcgtgttggcaactttttg

SEQ ID NO: 102964 - DNA, 1382 bp, Oryza sativa
aataaatgctagttggtgatgatgtgaatatttacatatttggatatacacaaacataaatacttgctgtgtacacgcacatcataattgtcaggtcttgatagtgcatatttggatgcacacaacgacacaaacattcgcactcactctacgcacgcttaaaactcaaaacattttttgatcgtctatatttggatgctatgctcatcgtacattgattaccaaaaatattagaaaataataaaaaaatataatagtacatgtttctctcaaacaaaacaaaacataccttgctagtaactgaaaggtgtctaaatattgaaactgtaaggagaaaaggtgtgtaagacaaatatcacaatgctgtcaatgcacatacttgaaaagtgtggatcacactttctataatttgcttccatgtgaatgtaagatggccatttttgagttagttgaggtatgtttcatggattccaatcatgtgtaagtttctctttgctggttgatttgtttaattttgatgaatcatcaaacaataaaaggctagctagtgctaaataaaaagtcaccatatgcatcaagaatatcaatataacgttgtgcaaggcaaatgatcacttgcaacaccggagccccatacccgaaatgccaagtgagcatatacggaaaataagttataagcaaatgccaactgcttgttcaaagttctacaccctgataaattaagtcttggtttcactgatcaccagcataactttcaaaaaaagttctagacatctctttattttttttctcgaattcacatgatagatgtttattattgtattaataaaataaaaggaggacacaaaatcactatttttatttaatctttggattagcgccaaccgtttcttgcatggtctatgcggtcattttttgaccgtgtatatatattgggatgtacacaaacataaacattctctttctacacacgcttaaaaattgtcagtttttatagtatatatttggatgcacacaagcaaagacgctctctacgcatgcctaaaacttaaaagcatttttattgtgtatatttggatgctctgctcatcgtgcattaccaaaaatatcagaaaataatgacaaatatgatggcaaatgctccaaaatcatgcgaaaatgcgaaatttgccccatctgttgttgtactgctagctatttccccttttgcttaggtctgtattcggtattcctagacacattattgttgatggaatttgcgtcttgagccgtaaactgccctaaatttgtaactgaccttaccaactcctttccaccttcattgcttctagggcaagtagatgatgaaatttgcccatgacatattgtcgacatttgatgtc

SEQ ID NO: 102965 - DNA, 716 bp, Oryza sativa
tcctactacctccctccaatatctcatcctagtgctaaatatcctgctaaataaacatcaaacaaaatgattgtccatataattcgcgttgtatgcggccattgctttgcctactttgcctctctccaatatttcatatctcctacctccctccaatatctcatctagtgctaaatatccggctaaataaaggcttgttggtaccctcctttctctctaatgagagagatgtatgtttacctatcaagaaatcacatcatagcagtaaatatatagtcatcatgagtttttcaagcaataaaccgatatatagtcattatgagtttttgaatgtgcaacgaactgatcatggatacatgcatatataacaagaacgaggcttgtatatattgtgtgagggaacaaggatgtcatatgatttaaggaatgaaaaagcatgcggctagctcaactccttatttatcgagtaacagatctagatgattctgtttcggcgaaaaaaatttagaggactctacctgttgtcaacaacaatttcattaggattgaagcgtcacgagaaatgttttattcgtttatacctacctcccggtttcttattttctttggatctcgaattggattgatatttgaaatgtgtgttcgtgctaacaaaatatgacagcaacactgatttaattactactcccttagagcgaccatagggggttgcattt

SEQ ID NO: 102966 - DNA, 1556 bp, Oryza sativa
cgttgctattcttcttcacgctcacaataaagggggattttgctgtttctagaagagcaactttcaacatcatttacagtaacatgtctcacggtctcacctgacagtttgtcaagtgagttggtgtagaaaatgacacagcaccgcaacacagaaaaaaaagggaggcttgatgcagcaaaatgctgctgcctctgaattatgatgcaaccaaatggtgatgaacaatatattggacattgataaaaacgattagagttgccctgcttatctatacattaatcgattctgctttcttctagctgctattatctcgcaaatgctttctgcaaaaattgtaagagcctagaagaacaaaatttatcagcagcctgctgaaaagattgtgtatgcttgctaaccttctcgagtgacattgctgcagataagaagatgaatggctagctcttggtgtttctgcacaacaaatggttgtttccatgaacacctctgatgctgcgtcttccatggattcctagaccttcagtcaccaagaacctaccaccaatcaagagcaagaaagtattgcaatcctattcagttctccataactagctgaagagaaggagaagaataatccaattaccgaaactaatgaacttaccaggctgatatatcatgagctgttgctatgcagtgtagctagcaatgagcagaacagaagaagaaggccatgattcagcttggtctggatgatgagaaatcttcactctctctcccaactccaatcccccagcttctacagaactcagcaaagggtctgaagaacagaaggaaatgcaaattctccttggtactagagtagagacaagaataatgaagaacagcagaaatgatgggcaggagatgtcctggactcctggttgccagtactacttctccaacctatgctgatagataataatggccaggaagctgatatttaagactggatgagaagagtaggattaatagcaagaagaggtggtgacccacaaggccaaagaagcaaaggaaagcaaatgaaacctgcatgaagatatggtcaggaaaaggatgaccaaagaaagcagagtttaaaaggaagcaaagcaaaaaagaaaagaaaaatcgatcaatggcatcaagtgtgtcgtccctctgtccctcccagctgcttgcctattttcctccattaaaagaacaaagaaagccgagctgctatcaataatggcgtggtggcgataatgatggcttagtgctgatgaaatcgcagcgctgctctacagaaaaaatcaaaaaggatatgagaacaagtactttctcctccgtttcacaatgtaagtcattctagtatttcccatatttatattgatgttaatgaatctagacataatgtggaaaatgctaaaatgacttacattatgaaacggagggagtagtagagattactagtaggtggctgcacgagcagatgagaattaggttgcccgttgctaccatcttggcctccttcttggtccatttgagcaaataaagccacaaccaccacaacaact

SEQ ID NO: 102967 - DNA, 2075 bp, Oryza sativa
aagacatgatcttttcatgatgctactgatgtaatttactgtcaattttatttagatgatgatgacacattcgttcttggcttgttacttttgtccaggagctatagctcaagtaaccaactttggctgggctttttgttgaggattagttgtccaatccctttcaaaggtgcagctattacaaaccttgtgcctgtgtgattataatggtatgattactccattcggttggtagctctccagcgaggccgtgggtttctttcatagaatcgggcatgagaagcaatttctgcgtcacaattatggattttgcaaggctgtacagtatgctattagattcggtagtgggctttgggatgttgtgcgtgcagggcagggtatcacaggatgtcgacctgtttcaggttctgaattgtgtccttggggagaggcatatgcagcatttctgtcatgtctaaaaatcaccatttaacaagtgaatgttgatttggacaaatttggatgcttcgtcttttcaatgagcaactgtgctcattttggtgttatgatcgaaaaaagaattgtccgtgcatatctgtatttagaaaagaaaaggtgagggagggaaaagacagacctgtcactcatgccaaagtgtacggcagtatagatctgtctgcctgttttgttctttttatatctctgaaccactgtagtagtttgtccatgaaacttgaaaattaataaaacggaatcttgatcattctggttggtgctggctgctccctttgtttatctcctacagcaacaatcatcaatggtaaatactggtggagttggtagtagcagttgataattactcaaccagatacaactcatagttgatcaagcattcataagaaggcccctagcctaaaaagagaaaaggccctagtaaatcacaacagttggaatgtgtccctctatccagaacggatgagttacctaggacattctgccctctagtcagtgatatgtggacctgttgattatggggctcacatgtcactcacttaaaattaaagaatagtacgttacaggatcaggttcacccagaacatatatctcatccccgtgcaaaatgcaacagcagataaagaaagaagtaactaaccacatgcctgtgaaaccaagatctgctggcttgacgtggacactgagcacagtggaggtcaataaccaataataatgcggcggtgtggctccagtggcaactcatgtcgactcggcgcttaactgccgaagcacaacacatggggcactcttttattgcacttcaaaccggcaagctgtgaagtgaagggacccggttaactgatgtaccagtaggaatccatgtgagatgtgacaagcatcacgagctgatcaatgtactaggcttgattatgatctcatcctgcagttgttctatcaaacaagaagatattagggcttgtggaaacaaggatgtaagtcagaagaagacacaaaatgaaacgtacaggtgcaatagtgcatagatctatatttgataagtcctatatgtgcatatatggtgtgtcccatactctcattctatatctccccgtcccagcacaaacaaactaactgatggtcccatgaatgaacaaaataaacgattcttcaagtagacagatcaatctccagacatactaccagttaggactccttagtccttaccaatctgatgaatcgactgtttccaagcttgagtttcccgcaaatcacagtactgttgagacatcacagcgaaggcagcgactactgagggttttagatgtaatgctactcacctaactatctgtactgatgatggttgagtggactgtccagtgaaccatgaaaccatgatatctgcagaacacctgaaactgagcaaattagcaaagccagatgaatgttgaaaacgacaaataattacttagcctttattgcattttctttgaaagtacaccatgcaactcaatatgtctacaaattcttttttcaaaataaacctggatgcattttcccggaatgtgtttgttcagcaagactcaccttcaggcttcaacagt

SEQ ID NO: 102968 - DNA, 985 bp, Oryza sativa
acgtgtaaaacaaaagattccaaaacatagaaaaaaaaagaatgattgtttgattgaaccgcagaaattggacgagagagatagattcaaatgaatttttctaagaggttagagcttttcctaatgtttttctaatatatatatatatatatatatatatatatatatatatatatgcaatgagccattgcatagaaatttcatagaatttaaaaagctccaattctttgtaccaaaaaccaaataaaagaattcctgtaggattggaatcatatgaatttcctacttgaatcttttgattgaagggtccctaaaatttatcaacaatctaaatttccgtttaattcttttaaaagaattggtggggttacggatatttaacgttactgtacaaacataattgctacacgtgctaaatttttcttactaacaattatctcaaccgtttgatttaggtaaataaaagttatgtcttttcctaaaatatatagaagcaatatacacaggttatcaattatactagtactacattactactatctactagatactacgtactccctccgtctcaaaatataagtatttttagatctcgatatagtctccgagatactactttgaccaacaatatctataaaagtaaaatgttttacataaaaatagttgcatattatgatagttcgtttaatgataaatgtagtaatatcaaatttacatgattaatctttcttaatttatcgctattaatagttagaattttaaaagtttgacttggcactattttaaaaataattatattttagaacggagggagtagttcagttccattcaaagaaagatgtctctgcctatgattaacttatcactgtgtacatatatttttatatggcgtcacatctcacgtggaacacgcagacagtagtacaggggaggacaacacatggccgtgaccttttatttgtcctgtggactggttgggaaaata

SEQ ID NO: 102969 - DNA, 502 bp, Oryza sativa
gaaatttagcatgagtttcaacctctcggtaacttctcctttgagtctatctctctcatccaattcctgtgtttttcctgcggttcaatcaaacggttattcctgtgtttttcatgtgttttgcaatcctctgttttacacttacatttctattaaaattttacgttttttctatttctatgtttttctattcctacgttttcttaatcctgcgattcaaagggagccgtagtatccgtgaatgcctctcttgggttgaatgcctctcttgggtcttgggctcttggccacatcaaggtctgcctctgcatccactggttccaagcgcccaggccatatagacccagcaatggcaactgcgtggtgtccaccaatacccgatctgcatgcaaaattttccggtgactgcattgcaggtagtactaggcacggaacaatttcaactggaatcgtgtacgtgcaagtagtatgtgaacaatccaaggtattgcctgcgcgaccc

SEQ ID NO: 102970 - DNA, 533 bp, Oryza sativa
tatggattaaggcaggcctgatgattatggagtaaagtgtaaagaagtggctaaattggtgtttctaagagcactaaactattagatggtaaataattaattggcatctgttaagtggtaaactattaaagtcatcaatatgtcgtggcaattaataaattaccctacatattatgttatactgaatgtgacgtcatttaaatcattaataattaaccagattgataatgttgttttgagtgattaagcacaacctacaaaattatttgttctttcctagtttaactaatgttttgctcaattaatttgaaaggaggagcatacaagtgttttgaaacaagaaggatcagtataaaaatcttatttcaaaaacttaaaattttaatgcggaaaaagtaataataagttatggttgataccttgctgtattcattatcactattatttcacaacgggaaagccaaacgaatttcttcacaggacctgggttgtttaagttgacaattgcgcttacagcttatgttgcatggttg

SEQ ID NO: 102971 - DNA, 1130 bp, Oryza sativa
tcctgccccccacaacaagttcactatcctgttgacattcgaccttaacattctcaaattccaaaaatcctgcaaatgaaggaaatcaagcagcacatgtgttttcagtctaagaggatgacacaacagctcaaattctatcaggtgaattgtactgggttcttcatggatcaatggaccgctggtttgcaaattagaattatgcttttgcaaaccaaattcggacctaaagatccctttctatattctaagaccttaattctcatatttatgaaacataatatagagaaatgtcaaattataacaacaggaatggttttttaaagagtgctaaaataactcaacttggtgtatctggcatacaccaagtagtacattttcacgaaacgtttccttgtgtggttagatggctattggcctattagtggcaataacagaactaactctataaaatgtcgtctactgtgtattggacttgtggttaagtatgccatattaaaataacaaaacaggtcatggtttgttttcaaaaacatgaaaaaaaaacaaatctagctttgttttcaaaaaacatagaaataaagcttagatcgaacattgagaagatttttttttgtggggtgtgggtgtgggtgtgtagggagggggggggggggttggatccatcaagacagaataacctttcaatagtgtggccaggatgctcggaatcactctttccttgataatgtccaattgagacgtggagttggattccacctgggctaccatagtgacgcaacagctcctattcttgacacactcgttgcctacagaacatttgctgcagggcatagaataccaaatggcaaacgatttgtcatgggaattacaaagagataataggatagctactagcataagtaacatgaaacatgtatatgcattctataatcagctgcgatgcccagtcctaaaacaaatacagttgtttgagagcttaacagacaggttacatttactgacatgatatattagatgaaagattgatgcgcaaacattacttgggcagggcatgaaatttctgatggcaaacacataatgcaattcaaaaatagacaactgtagaaatttcagtaagtaaagattaa

SEQ ID NO: 102972 - DNA, 1032 bp, Oryza sativa
ccaatttggattcccactcgcgtccgcgcggccttggtattgcggtaccgattttcctatatatttgtcgacaaatttttcctcaaaaatttgacagatgtaattacagtataatcgtagtgtaattacactgtaacttgcatgtaattacactgtaaatatagtgtaacttgtatgtaattttaaaaaatctctccgtaacatgttatttcggtaaaatggaggtcgtgggaacaaattatttcacatatgtgtgtgctatgatttgttttcttcctcaccaaaacaaatctggtaatagatctaacgattaaaaattatgtgaaacttatatataagttacactgtaattatatgtaagttacagtgtaattacatataagttacagtgtaattacactataattgtactgtaattatatctgtcaaatttttgaggaaaagtttgtcgacaaatgtataggtagtcccgaatgaatcctaaacgaacgttgattacacattaaaatactcgtatattaccgatatacgcaacacatcgccccaggcatatgtacagatagtactcgtatattagttgctggagtattatcatactaatgttaaaagaaaagtattattatactactccctccgtttctaaatatttaacaccgttgactttttagcacatgtttgaccgctcgtcttattaaaaacttttgtgaaatatgtaaatctatatgtatacataaaagtatatttaacaatgaatcaaatgatcggaaaagagttaataattacttaattttttttgaataagacgaacggtcaaacatatttaaaaaagtcaacggcgtcaaatatttagaatggaggaagtataagtttattagaatatacttgctccatccttaaatataagacaaatgaacaaaccaacatcatataaataaaataacagagtaaaaacatgttcttcaattttgcaataacttaatgagataatccaagaaatgccattgacaagcgtccaagtcccagaaatgccat

SEQ ID NO: 102973 - DNA, 4740 bp, Oryza sativa
cctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatgtactcagcaagctattatatcaaataatgaatgcatgaaatagtatttaagtagatctaggtttactggcagaaagctaagaataaagatgaagaaagcctggtatgtctttatgcaacagtatttagtaaaatcttgagttaagtttctaaccaaataccatatgagtcctgatactcaattccgtgagcacggctattcgaatagtttcatgaatactctactgcagtaaatgtacgctttacccgcagtccacgacttgccaatattcattagcttagtcatgcccagtattaggttactaacaatagtggcacctgttccatgaactctagtccccatgcgctctgaacgtaacgttatcagcagcgagaggagttctggcgttcccggggtttttagagagaactggatgagagaccccacgtcatctcaaccaggtttccataaaatcacacacacagctcatgagcgaaaatcagtatatttacctgcgccttggtaaatatcataagatgccctactcagcataagattgcctcctgcgcgaggacttacaaaaggaaccactgtacagaggtaccacattgttaattaacctaataactaggtctgtccccattctagaagctgcggtcgtactcgttcgtttgacataagtatttggtggcaattatatcgatcgagacagtactagtcacccggaaatcaaccaaatcttacgtactgtcccaatctaagttcattgaattttatgcatattctaactaagcatggctaagcaaaagctagcatataactggttcgctatatgttcagattatgcattcaaaatcatgtatggctagtgcatagaatagaatatagaatataggacatttatgctcaaagggaaggaataataacttgccttgctccaatgcaaataaatccgagataggcaacctgattatccgatgctcgaaataccacaggttgccatccagaataaaatagactctatttaagaagaggaagaaccaaattcaataaaagccataaaatagcaagaaaacgatgaaaagcgagaaaggctaggtttggggtataactatctccttaatgggttattgagatagtattttatgcgtaggttctaatgggttggagactaggttggagaggggatcaagattaggctttggtggaatagtggctagggtttagttgttctcgagtcgatgctgaaatagcatagcatatcggctcgtatttcatgtttaaactatgggtagttggagggtaaatggctgatatggagtttggatggcaggctggctttggtttcatttgattaagccgatatcgaggtaggatgactatcggctgggatttgggtgtttgctagtcgtcattagaattgggtagtatgacgactaggtttggtgtctagccgatgtcaacagacaatataacggctagagggataggaagtttgtgtaggtttagcggggtggaagtgttactccgacaaccgtgagtggcggtggagcggctaggatcacacagagcttaaaagctaactgtgcggagtgcagatgaggtcgagggaatagtgaagctctgcacgttatacgcattgaggcgtaaggtgtcagaagcaacacttcgaccttaggtttgagttttgtcggactttacaaccaacggttcgacatcaggtcagaagaccgtgcgaacgtccccatggaaggcgtaaagttccaaacggtggttgtttagtggcgaagggtatttttgggtaaaaaggaaatatttgaaaggcaaatatagattcaaatggcattaaggaatttcaaatggtgaaatagcaaatttgatatcaaaatatagcttttgaatttagatgaatttaagtccaagtttcatcggaatcggatctacggtttaggagatatggacttctaaagattgggatttgaattaaataagaaaaatatgaaaggctactgttgatgggcccacctgtcagggagattcttttcttttctttttctcttcttcttcctcccgtatcctctctccttctgcttcttcttccagccgaacacagaggagagggagaggaggggcgccggtgctccggtggtcgagaggctgcgacgtcggcggaaaaatatgttcccgagcgacgcgcatccagggaaccagtcggccagcgaaggaaacaagcgaggaggccggaacggcgacggcaagagcttggctcggccaatttgggaggtggcggtggcggtttatctcaaggtagagggagaggggaaaggggaaaaaatggaatcacctcatcgaggccgagctaatggcgcaaggttttgggatgtagggctgtggaagaggagatcggccggtggcaatggtggtggccggtcatggtggagagagaagaaagagagagagataactcggatggatggaagaggagggggttttctctggctatttataggcaaggagaggcggtggagagaggcggttctggagacggtcgacggcttggccacggcgatgctggcgtgaaggaagaaaagacggcgcagattacttcgtgacgacggagggcgttggcggtggcgtgcgcgtgaggaccgaatatccatggcagaacccgcacggcatgcgcgcttgcgggaggaggaggggcggctcagctatgggccgacttgggccgcgcgagagagaagaagaattcggcccaaagttaaaaaggaggaagtctaattttcctagagattcaaataatagatttagaggaatttggatggctagattttgaaaaaggatttgaataatttgaatttgaagtaaaattgactgagagagagtttataaggaaattatattcgaatataatttccaaaagaaatatttctctagttggtttgagtgcaatattttggagagggagtttatttaatgcactcaaatagaaattcaaaatattcaacaccataaataatatggctctagatttgaatatttttgaggatgtggagggaatatggagggagtagagtaaataaaattttagcccaaaatatgtggtatgaaatttagagaattagatatgggctaaatgaggttttggatttgggacggagggataaagtctattctcttagcacaatagcaattactcacaatatttgtaataataatatttcttgtgccgaagagggaatgaaaccacatggattaaattggtggctagatcaaaaggaggaacttgaatatttggatcgagaatcaaaggatgggtttaagatcaaaggatgggctaacaattaattccaataaaattggaattgctttggtttaggttctagcacaatataggatggtttcttggaccataattcataatagtaaaaagggtttttcaaactaaatttaaataaaggaaattttaggcgaaagaaggttttagattaaaaccaaatcaaggaatatttcaagataaaattttaaatgaaaatcacaaaggcttttgaatatcaaagagggattttatgcaggttagcttcaggaggtctcgctaattatattgtcctaagtttaaagaggttattaagaacataagacccggcatgatgcaagattagaaaatagctaattttcggtatgttacaccatcggccgccgctcggaggcctagagagatggggaagagagaggacagggcggagatagaggaggaagatgagttgggcactgatttatgtagggcccacgtgtggatcccacactgacatagcctggttgaacacaatcaatttgccaccttagataaaaccgaacattatactgccctaaaaccggttttaggtatacctattatgtaattaaggggcgtgttgtatctagtatttgtggttcaagtatgagattcgaactggacatcaagatgagggacctagagtaattattccaaatcaatggcagtgaacccgatacagcccaccaaaatttcgtggtagcgatccagtgcagcccactgaatcaattaagcccgccaaatttcagcgatcaaattcggcccacccacccaactgaccagccaaaatttggaccgttacaatggtagcgacccaactcagcccatcaaatcttcgttcgctaccgttgcaagagaccaaattcggcccgtcacagtttgatttgccatgtcacaactctgaagagcgtcagagatttgccgagaaaatcgtactgttgatggcttgacgccaagaggtaaactcataagtcataacccatttttatcatgccatcttacattaacgaaagaaagaaaga

SEQ ID NO: 102974 - DNA, 1218 bp, Oryza sativa
agtatactttgctgttgtttcagtagtgtgcatctctctagttattgctagctagtactccaaagagtgagatgaaattagtggatgaattataagtgagatgatgatgatggtgctagtgtgaatgagtgaagctgccagcatgatctagctctgattaatcggcactgttggcgtacagtcgattgactaatcgtcagatctgtgtgtgtaaatcactgttagatcatgcatgacagcctcatttcttcacactgttgggcatgtgttaaacttgattagctgtgcacagtactgcaagagggtacagacaggataaggtgatgcatctatgatttatctctgcatgtttgatgttttgattactttgtacaagcttgattagttgtacaatactgcagaaagagtacaaggtacagggtaagttgttgcaaactttgcatctacctctacgagctgctgttattttttttctatctagtataagtacgtagctagtgaagtagtatcaatcaatgtatatggttataatagttaattagtttatgctggatttctcagtgtatgtaattaagggtacctattgtttttattagttcaaaagccctagtcttaggattagttgatgatttaaaattataaatgtgtcagctccattcaattagcttcaaacttcttgagtacaacaaaaattaaagcaattgggctagactaatatatcagttaaaagcctatatattgagcactagtacttcactaacttgaaacagctatacaggcccatttatttagttactccactaagcaatgtgtagtagtactaagctagctaggtaattattagtttttggcaactactacatgttgacatgttgtgagtgctttcatataaatctgaagcaaaaataggattcatgtttgctggctaatgtagttttttttctttttgatgcagcaaacacactataattatgtatatggatgatttactttttatatcattaatgtagttaaaaatatattctacgtactaattaaactaacaagacaaccacttcatgcatatcctaattaagacataaggcccccatactttcaccaacatcataggttaatgcattcaacaatataagaattgataaattaatgtagggatcacttaatttgtgtccacttgtcacttacacaaaattagtcaattgtgtagaaaagcaacat

SEQ ID NO: 102975 - DNA, 1826 bp, Oryza sativa
tgaagatctgatggttcaaatagagaatcatcttatataaggcggtttaagaagcttaagattacagagaaaacaaaagtaaccctacattaatagtactagtactagtagttatgctagctaggagtggagcaacaacaattgttaattgtaatgactatattaattagtgtgacagttaatttgcttgaccccagatgagagtctctagctagctgtagttaaccccagatgtgtaattaacttattaaaggccatgcaaccatcacatccaaagcatgagaagacctacacagcacataatagcaacatggttacacagatttgtctcatctccttggtgccatctctcacacaggtatctgatcaacaaggccactgggccaggacatgcctgctgctaactgaattgtattattaattagtacaagtactcagcaataggagaggcagagttgctggatcatgctatagatagatgctctctgcatttcttctcttttcagcagcatgcatgctatgcataaactgataaaaggagagatgtagggtttagctagcaggtcagaaagggttgaggaggcattggaagcataaactaagttatgatcagaggagaaagctactgctacgcatgcatgcatgcacagtactatactatgatcgataaagaaaaaaaaagaaaagaaaagaaatatacaagtatatatattattatactagtagtaggagtattactccctccgtgtttttaatatatgacgccgttgactttttaacaaatattttgaccattcatcttattaaaaaaatataattatcatttattttattttatcttgatttatcatcacatattgtttaagcatgacaaatatttttattataaattttttttaaatgagacgaatagctaaatattgataaaaataattaacggtgtcattcattagaatactgaaagagtatgtactactgtgcaggcagatctcatgcctgtagaaagttttctgtttactcgctgctgtaggctacgcttgatggtacgtgtgctggtaccagcatgtctctagtgcctgtcgttttggtataatataatgtccgatctctacatgtttaaatttacatgaattttcagcaaacacaaaaaaaaacactttataaatcaatacatgtcaatttagcgtccaaagctctctaattaatcaattgcttattattgccacatatgcaaacaacgggtactatgtgcaatgaaatcgatcttctttttaattagcagatgttataatgaaaaccatcagagaatcaaacactttcttacttaaatagctacctgtttaattcagtatcgaagttaaattaattggtggaccaagatgaacatggatgcaaatatgcaatggagaggatgagaaggattttatcagtcctcagctgaagttttgactacaattcctttgtccaaaagacagtttaattttagggtaaagtccattttagccattaatttttttttctcaaagtctattttttccaccctaaactacaaacatgttatttttttattctcaacttttaaatacacctagcaagcttaaaacacatttcaagttttctcactataacacaagcttcatttaggtatgtttatagctgtagaccaacttagtggcatctgtacattagcaaaaattgtgcaataagagtataaactaataaaatcaccgtcattttaaacaaaacaactaaagaaaacatgtcccatggtgttttcatttttagtttcaaaagttaagggtgaaaaataaccgactttgtaattc

SEQ ID NO: 102976 - DNA, 875 bp, Oryza sativa
ctagatatgtcttggaaattattgtcataatattttcaaaaacattatatcttatgaaatcattttaatataaaactgaaggttaaaactagattgaatcaatcttatctccaacatcaaatacttctattatgtataaattgaactaaccaatgttatacataaaagaacagagtgtattatttttgacggaagagaataagctaagtatgtttttacagagaatttctttttgcaaaatacaaagaatttaaagaatttggtgatgaacagtaaaaattctcatgagtatatgaagttagtgaattttctcactactagcatgaattatattaatttaaatgctacttaaatggttaattagttgcgttagagatcgagaacttttcgtgcaggcagtcgatggacgtctacctcaatatatcgatttgtgtagacagtgacagcctgatgatattaattaattaattaatcgactaaagtctctccatgtctcttgaattatttttttctgtctatcaaaagattgatagagatggcacggaggatacggtatggacccgtatctataccaaatctgaaacagtagccgtatatacgtatcgtcttctttccagtctctttcattttttctggaccgattgatgatggatatgaatacgtctgtcaaatattatacaatgcatgtgtactatgtatgaatgtacataaatctaggtcaaatgttgctacaagcttatcacgaaatattaaaatttagaatgaccagtattaatcccagaatgcagtacatctcaattaattaagagttcaccaagaccacctcacagtgattaatcaaggaccttgcagtatagatttagttcattattcat

SEQ ID NO: 102977 - DNA, 1792 bp, Oryza sativa
ataatgctaaattatcatagtacaaaatagaatctactccaatttcacttttacaatgagaccatgggtatctgatatgtacatgaattatcctaccatgacttttcctggacttatcttgtattcttcagaaaacaagcagtttatgcattacgcttgtccttttgcagctctgccttttgacagaagacgtggtaggattgtagatcctggatcctactatatccaggttacatttttctctactttatttatagctatatatctggcctttattatttgtgtgcttttgctcaagaaagtagtaatattcaaaccgaaagtaagagaatcatatatgcttcttaatgcggttcaaaatgattactggccataggttttcagtcacagtttaactccagctaaaaaatcagaaccacagaacacaaaaacatagctgcaacttccctgatacatcactgtactacggcttggttttgttcttacagttggaaatttgtgtagtaattgtaacgctttcctttaagcatttctaatctgctcaatgcatttgactcgaacagtgtgagcatgtaccatgtcacatcagagggaaacaaatgattttgagtatgaaactttcctccctcccattttaactcttccactgaagaatagacacatcatgagaaattccgtagagtttcggttctccctccatcccattgtttatgatggaagtgcaacttttcatcagtcattctaggtctccagccctccaccaacctgtgatcgtcacttgtctgtacgaagcgtctatattattcatctttctctatggccttgtccctactctctagtgtttgacacggaagatgtcagcatagagtaaacaaatggtttgctcctcttgttgctcattttagtccacacagagctcttgacatgctttacctcttattatcctctgttagaataagcagaacgcatgcttatctaccgtgctgtactgctgtgtttcattatccttttgaaaaggctggaaaggccactatggatgcgcttgagacactttctatgcaacatttaagctgatatgcaacgtagcatcatttgttgccagaaataaaattttgaaagcaaaatctccttccaaaaggggtcataagtttgataagctgctaagcaaatacctaatgaaaaacagggtggtgtgattgtccctttcataatgctgttgttggtactctgtttcaggttataagactttctagtattgtccacatttatatagatgttaatgaatctagatacatatatatgtttagattcattaacatatatatgaacgtggacaaagctagaaagtcttataatatgaaacggatgaagtacctttttacatactctgttatcaggattacatatccacaaacctagtgaatactgaatacagatcaggctgcgttcggcagatgctgattgagagaagatttctcttattctccgcccgcatgttttctgaactaaacgttatttttttttgcaaaaaaagaggaaagttcttttaaaaaatcatattaatctatttttgaaaattgaaatagttaatatttagttaattatgtacggatggtttatcttgtttttgtgtatattctctttttctcccctctcgtacacagccaataagagtgctcccgagtccctactcccctcggacagtccaacctcttgattcaatctggtaggataaaaccatgtttggtccttagtacttactacctccgtattttagtgtatgatgccgttg

SEQ ID NO: 102978 - DNA, 1507 bp, Oryza sativa
ttggttggtgttcttcgtctggtggtggtggtggtggtggatcggccatgttcgtcaggaagcttgtggagaaggcctccaagaaggtaactgaatctctcactctcctctccgagtcctctctgctttggcactccctcgatcggtttccaatttgcctcttgatttctggttaaagatgaactcttgcagttcttgtttgatgccgtgcagtagcagtatcaactacaatctgacaaaaaaatttcagagcatgtagttctgattaagtttgtattgtcactttctgctgtttagaacatattttcttgtaggagcaagaaaagaatgttgtctcttagacgccgtgccgtatggtttgctcgacagagatgggttgcctctgttttgatttgaatttctttcaaatttcaaacgcacacacgcgcacaattgccattggagatttggggtagtaataattaaggcagcgcgcagaaggccatgtgatctcattgaagtcgaagcaaatttactgttattgaatgcatatatagtttattcgatgcatacgcgaagcctacgatctttgttaatggcgatcgagatggataagaatttaggttgacgtcgtttcatactttcatgcatatggattacttctagtttgtacttttagcaaaaaaaaaatcacaattaaaagttttatgataaaaatatcttggccggtccatcgagatcaccgagattcgattattcttatgctcggttgcaatcagcgtaagtatcgccacgccggcttttgggttggtcgcgcgtttcagccatttggatttcaccgtcagtttagcatctttgctttggcctctaatgacaccgacccgtctgcatcatttctagctctgcaaatgcttaagttcattaccacaaattactcttgtgctaagcattgatagggggggtggggggggatgatcggtgaagaggtcaacgaatgataaagaaacagtcatactgtagtaagtagtaacttcgcagtggagcaactgatcatgaagtgaagtagttacagaacggaaaaaaggcaggtaaaaattcgtcataagttgaatgcgacagatatggctcatggctggcatagatatctgcaaagaaaattgtcgatgttaagttgggatatagtgtacggtcaacatagttttgtggttagtacgaagtatattattattctttttagtagagaaaataacacgatgagtgtgcagttgtcggttagcaaacatgattctcagtgcgtgttagtagatcatgatgacatctggatgtgttttttttcttttttttttatcgtctgacggtgactggggcatgtgcgtggccggttgagctaatgctggagtgctggaccaggacatccaatgcaaaacctttgcgtgctcgcgacacgtactcagtactacatgatctgaatatctgatcatactactttgtactatgatcttaaatattttcctcatttaatcttggg

SEQ ID NO: 102979 - DNA, 1158 bp, Oryza sativa
ctgttacactatgtggtagtgttgcaaaagcatgttagcgttcagatgcactgaacatgaaaacatagaatcagtatcatcttaattgcttgaattatttcactgatattcttggtaggcacacatgatgaattgcactaatcaagttggttgcaataagctaaagtcataactggtctacaagttcaagaactaaaaaaacatgtgacatttacaaaaacggctaagactgaaaagtcaaaacggcatggcagtccaaacttgtgggggggataacataaaatgcactaatttagtgtttcacctgaaataggtatgcatgatcactgaatccattaacatacaaacgccctgcctttccgtcactattgacccatcgcaaagagactatagacaccctgtctagcttgtatccaaggttaagcctctgaagaggtaggttttgattgcccatcgatgagagattttgtgcatttaaaatatcaggaatagaccaaagatatatatcaccactatcaaatccaatagcaattttgcttcccttggcacaagcccagcatgccgatgttacagctttagcctcctgatgtgactgttgttgcatagatttgccggataaagataccactttgctcgtcttaatatcccacaaagacataatcccatctctgaagataatgagcactctgaagagtgtaccttaattagacatttcactacgtctatacatagaatggatgaaaagatcacctgagtactatctggcataaaatacttaactgcttgtgccaaactagtttggaagagatgtacagaatattcagaagagacaccaacctgttattttcagccaaaggctgtggcgatacaaatgcaacttcaacctcattaccaacatttgctccagaaccttcagcaagaatcaattagattccaaagttggtgctatttttatctttcatgtaaagtatgataattcaaccaatacatattggagtaaacctaccataagattcagagaaaggaatccaatatggcatgtcaactagacatgtctgacccaagtcaagcttcaacagggacacattcccaaaactatcacccacatagctgcatagacaagatcttctaatcagagcacttaactccacaggactc

SEQ ID NO: 102980 - DNA, 1613 bp, Oryza sativa
tgcgcgggccagcctagaaattctcacattaatcagagaaaagaaaagcagagtccatatataaatacaatttagaaatagttgaaattcggaattaaaaaaataaggaatatcagaagaggagactagagtccatatagaaatacaatttagaaatagttgaaattcggaattaaaaaaaaggaatatcggaataggagactagagtccatatagaaatacaattaggaaataactgaaattcggaattaaaaataaggaatattagacgtagagtataaagtccatatagaaatacaattaggaaataactgaaattcggaattaaaaatgaggagtgttagaagtagagtatagagtccatatagaaatacaattaggaaataacttaaattcggaattaaaaataaggaatattagaagtagagtatagagtccatatagaaatacaattaggaaataacttaaattcggaattaaaataaggaatattagaagtagagtatagagtccatatatataaaaatacaattaggaaataatagaaggaatattagaagtagagtatagagtccatataggaatttaaaactaactaaaatttggaataaacataataaaactaaaagtagagtttagagtccgtataaaaatatattttacaaataactaaaattcgaaattaagaaaaatatgggaagaagagtttaaagtcaacataggaatacaatttagaagtatctgaaattcgaaattaaaaattaaagaatattgaaagatgagtttagagtccacatttaaatacaattagaaataacaaaaattcagaaataaaaataaataatattagaagaagagcatagagttatatagaaatacaatttacagaaaattcggaattaaaaaaagaaatattaaaagacgagtctagagtccatatagtaatatatataatttacaaataactaaaatttgatattaaaaataattaacaactaacacgtatataaaatgtaatatgaatattacacattagtagttttgtaaagttattgtaaaatttaaaattatgttgtcgttttaatatatttgaataatataattagtttagtagaaaatagatctttgatcacctcgtatggaaatttgggtgtgacaacatatacactttgtagataaatttttctatacgtgtaaatatggtataattatagtgtaattatgttataatttacatgtagttttaaatttacttttaagaatctcacaataatatttattatttcaatgagcgaaggtcgtgtgattgaattccctcacctatacgcatgctgtgatttttggttgcacgaatagtgaaacaaatataacggttttaaattacatgaaagttcatacaagtaaaatataattagactagcattatgtgacaaatttttagaaaaaaaaaattatggataaatatatatagcaaaactgaatttgagatgatatgtaaccgttagatgggagaaatgcagttggcccaaaattccacttggcccattctgggatgatagatttcccggcccaataaccctcaccccaagtgagatctctccactgggcccacc

SEQ ID NO: 102981 - DNA, 678 bp, Oryza sativa
gaatttgctcatattttattcaaatttattcaaaaatcagtcaaaatttcaaaaaaattcgcacgaaaaaaatccaaaatttcgattctttcacccacctgcggcagaaatcttagtttcaaaatttcaaaccttgggtacagtacctcgagatacttttggctggaccggagcaaatctcttgtttatttgttcctctcctcccccacctctttaatctctgatttgttcataatgtttcgtcccttgcatttgcatttgcattttgttgtataattactgtctgaaatagttgtatgaatccgattgtgtataacccctcaaaatgtacatatatgtgtattagcaacaaggatggaaatttcggaagaattttgcccctctcctgcaagcaaatattttgagcaaactttttggatttttttcaaatttgtgaatttggtcataatttattcaaattcaataaaatttattaaaatttcaaaaaaaatcattcgaaatatctaaaaaaatttcccgaaatttcagaattggtgcccaccgaaattttttgcctttccaagaggaaaacccagtttagaaatggattgtcatgcgtctctgaaaatgtttgcatctcttgaattatatctgtaataattgctatgtaattatatagtcgtagatgtcaatctcatg

SEQ ID NO: 102982 - DNA, 717 bp, Oryza sativa
tataatggttgatcatttgtccatttattggagcatgtgaaataaactcttcctacatgcaatctgtagaatgtgccggaggtggacaaatttcaactgctgcagatgtatacagcttcggagttgttctcctcgagatattcataaggaggaggcccacagacacatgttcaaggatggattgagcattgcaaagttcacagagatgaacatccctgataagatgctgcagattgttgatcctcagctagtacaggagttgagcctctgcaaagaagattcagtcattaacgatgaaaatggagcacaatgtgttctttctgtgttgaacattggactctgctgcaccgattcagccccaagcaagcgcatcagcatgcaggaggcggccgacaagctacacacaatcagggattcatatctcagaggatactgaagcagtcagtttcagttgctctgctttgtctgaaactcactggagcaatgccttttcagtttcagttgttatgttgtctcaagctctgaacaatcctcagaagacttgatgttcatcatgtagcattgctcaatacttgacgcaatttagttgacatgaatactacttccgacttccaagaaaatgattgctaacctgtttccccacaacaatatcagctccaaaagtgacgttccagtattactgcttcccatgtcaacatttcttgactgctgcaatgt

SEQ ID NO: 102983 - DNA, 726 bp, Oryza sativa
ctgcaccccagtcgttttcatggattacgacgtttttacataattactatgaaatctttaattgccggccggtttgatcttcacataagatgctaactaatgacaagttaacaacgttaaatttgttcggtcacgaactcgacttgagacatgtcaacattccatgactaaggccctatttagttcacaaaatttttttcccaaaaacatcacatcggatctttggacacatgcatggagcattaaatatagataaaaacaaaaactaattacacagttagggagaaaaccgcgagacaaatcttttgagcctaattagtccatgattagccataagtgctacagtaacccacgtgtgctaatgacggattaattaggctcaaaagattcgtctcgcggtttccaggcgagttatgaaattagttttcttattcgtgtccgaaaaccccttccgatatctggtcaaacgtccgatgtgacaaaaaaaaatttccctttcctcaactaaacatgccctaatgtagtgataatagtcctatattatcttgggtgcatacgcaaccaaactatgagattttggagtactcctttcattacgtaatataagtcattttaacatttttctcaaattaaattttttaaatttgattaagtttatagatcaatttagcaacatatagaagttccaatgagcacaactcgcctgactgatatggtggcatgcat

SEQ ID NO: 102984 - DNA, 953 bp, Oryza sativa
tcgcgcttttgttatctgtttccgtgcgttttttttttttatgggaagcgcggcgcggcggcagcggcagcagcagagagcttcgggtaggggtggccgggtggggcgttcgattggcaagcgccaagcgaggtggtggcgtggcgtggtggtgggtgggtgggtgggggtggactagtgtagtagcgtggatgccggcgctacgtgccaagtctccagggtgcagtttagagtgagggagtcctaaccaaaaggggtgtttgttgttagcttgcccggtgtaccgcgttcagtggtggcgttcaaatatgcgtgaccactgacgtcgagttcagtgtcagctttgtttttttttcttttgcttaaaaaattagatgaagacaattagcaagcgttttattgtactctccggtttaccatcatcgagcacaagttttacaatttagcatcatacggatttgagtaatttagataaaactatacgtactttaaccaaattattgtaaaactataggtttaaaaatgtgtatcacataacaacaaatttaagtcatcatatcacgaaattatagatttagtaatgaagttatcaaagaactagatattttagactttatatccataacactattgagattacaaaagttgtacttctgtgaattgatgtaaatatgtagttttgtgaaaaaaatgtgttgttaaatctacaattttgtgatacattttcttaaacctatagttttgttatagataaatcaaagtacctacgttttgtgatctttacgatttttttaccatttttactagtggactagtaaccagcgtactatggttagatagattccaaactaagagagttgctctttctcataagtcgttccatggcgcgtcctccattcgtgttatcgccgatgcccctccagtcccttcctctattccgacgtcctcgccaa

SEQ ID NO: 102985 - DNA, 782 bp, Oryza sativa
cctgcacccctcacaaattttttaaataagacaggcagtcaaacgttggacacagaaacccaaaaatgaagtctttgtgggacggagggagtactagaatagacacgtgtccaaattcatagtactaggtaacatcataattatactagtttactctatatcggggcggagggagtaataattagagcaaggctaataatacaaccgacctgttggctacaaggttctttgtagcattttctcaacctacccatataatagtttgcactttacaattaatacagggcccacttgtctctctcacagagtttcttggttcttgtgtccaagccggctgtaagtttacagcccgcttcttctctctctcctctcttctctcctccacctcagcatttagccggcttatagcctactattatacttgctcttaagttggttgtttgttggctttctgagctctgtccacttcccctgaaatgatgggtttttgtctcctttacaacatccttcttgctgttgaggtagctatatggtgtattatatctcaaacctgtaaggagaagatttgtattagaatgtcagtataacttatctctacaaagataaggaacaatggtaaagtctgagcacaagtaccttctttacaactgtgtggattccaattgataatacactgttcattttactgtgaaacagttcaacccaattgctgcttgatagatgaactgcacctttttttactgtgactttgtctgggttgctgtattcactaatttctcaaa

SEQ ID NO: 102986 - DNA, 689 bp, Oryza sativa
gtagatcacaggtgttcttggttgcctgtacaagtttgagagttgtggcacgaggttgcacggaaccagatcctctgaagttgggaaaactactcccttcattctaaaaaaagacaacatattacaacgaatctggatacagaggttgtcttttttaaaaaaaacagagagagtacgtcagtagcccatcgatcgaccgtttctcaaatatggaacgctcccaagaaaaatccaatgttgtccttgctcgcacgctagcgaacatgatagtgactgcgagcgatggcatcattggcttttttttttggagcattccatactcggaggacaatgaattgatacaccactgccctctaacatagtttttctaacatcagagaatgcggtgccaaggttgcacaggttggatgggtcgtggatagggctggaaaaaaggatgatggcactttagctcgcacagctcggcttgtttgggtttgttaacaagtcaaaactaaagtttaacctactcgtaaatctcaacttaactcatccccatccactcattgtcacaccactccacttggtcataggcctaaatatttagactgactttagatgattatatgaaagtatgaaattaatggtgcatttgctaaatttgtgatgatttaatacttatattgtatgcaaacatttgtaactttgaa

SEQ ID NO: 102987 - DNA, 514 bp, Oryza sativa
aacctcctctcaaaagagaacaaaagtagctaacacactcaacttaaacatgactccatgaagattttcttcatagaagtacaccgtctttgtagtacgaaccacccaccctttaacatatataaacttatgttccctgatggtatgtggtttttgtcagcaaacttagttgaatatatatactttttgtttgcaacttgacgctggattttaggccattttggatggctcctgtgccatactgaaataaatacggctctgagtatcttctttatcacacacatgtttacggacgaacagtgttcctggtagactggtggaccaggtggtaccctggcactactgcagctaaaattaattagtaattcaatttatataggacccatttctgccatacaagctcaccagttgatgactgtcatactgatggtatactgctcctcgtattgcacatttgaaagaactaactgaagaaatctataaatatctgtatgaaagtaaaaaaaaaaaaact

SEQ ID NO: 102988 - DNA, 556 bp, Oryza sativa
ttgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgca

SEQ ID NO: 102989 - DNA, 704 bp, Oryza sativa
acagtacctcatcacggcaactgaagcggcgaaattgcaacaggcacaggcaggtgaggtgaggagcattctgatggttattatttttttttgcccccaccacctccgccgttccgcttccccggcccgaatcatcatcccccaatctagttcgtgtgcgctgttgtcgctgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtga

SEQ ID NO: 102990 - DNA, 1327 bp, Oryza sativa
aaggtcgaggcagatgcgaatggaaagatgagaaggtagaaggcgggatacctccatctaaccaattggacgtgtttcaacttattataaatatatatttttagacagaattaatttgatagttaattacagatctactgtattaggatggacataattgcgccttgtatgactcgtccagttaattcgaatagctgtatataaacagctcacaaagacttaaatacattgtccacgcgattagctatctgtcatatagtatagtggtttctcatattctgccataatgaagtaacttattgcatgcatgtactttatagccaccctgcttgaacatttgatcatcgagatcacaagcaaataattggttaagagattattattgcattgggctatataattaagaagctatagacagatcgaattgtcggggaaggagcattgaaacccggtgcccacacacagtgtgtgcataggtggcctagctcgacggctagccgtctactgttccaattaattaggcagctggtgcgatctctgtacatagccggtggggatttaagaggtaattgatctgatccatgcagctagcctgaggaaacacatgcgtcttaatacatttgtgtgccgggtccactggaccaaaacgagatgccgccgtgtgttatcaattgggtttgggcattcattcatacgctatgcacacattgcaccacctgcgactgcgacctcttcgaattttgccggtatatatgttttttcttcaatttttgagaaggaaaaagtccaggagaaggtggttatattgctctgagtaattttcttgagcttttatcaacctaaaattgtagtgctccctctataggttctggacaacatcagctgtattttctttgttagcctagcgacggctagttcagtgctaaccttctcctaggtatttgcgttggtgttgtttgtgtttttttttggggggggggggggggtgggtgggttattttttcttcgtttttctggttgcgaccttctaaggttgtaatcgtgtaattttttttcctgctctatcaatataaactttacaatgtctggtttgagtcgttcaaaaaaaattgtagcgctccctgtagccaaatatttttgatatggagagaactaaattctattctcccaacgtaaataaattagcccagaagtagctagaactgctgtatggccaacaagataagttttagtagtaattagagcccaccgatgggcgatggtctgtatcgcagtgacttaaaaacgatactggagccactaaatttctgacagacaacatgtttgt

SEQ ID NO: 102991 - DNA, 675 bp, Oryza sativa
tgaacaaaaactcctgttctgcctggacaaaaacaaaataaaagcccccggcgaggatcgaactcgcgacctttcgcttacgaagcgaacgcactaccactatgctacggaggccaacttgtttactaataaatactccctctgttttttaataaatgacgccattgattttttgtcatatgaccattcgtcttattcaaaaaatttacgtaattataatttattttgttatgagttgttttatcacttatagtactttaagtgtgatttatatcatatacatttgtataaaatttttgaataagacgaatgatcaaacatgtgagaaaaagtcaacggcgtcatctattaaaaaaggaggtagtattcaataattttattcttgtttgagctttcaacacgaaaacagcataattaacagcacgaatactagccggagcagcataaccataggacgcaaggcaactggacgtgaaatgcatgccgccatgccataagtaggggaaaccaggaaaatatatagcagaaaactgaaaacttatcattgtatcgaaaaatagatatttcagattgtagatttactcatgagtaaaaatttactagatcatgatgacgtggataaattttgaatatctaatttttttatccaatggtagtttttaagttttcattata

SEQ ID NO: 102992 - DNA, 704 bp, Oryza sativa
gatcttggccccatttgttttcaataaagatgaagataaagttagcggatgaaaaaaagagttattagcatacgataattaagttttaattattataaacttaaaaaataaatttatttaatattttaaggcaactcctatataagtaagtttttttccatgaaacataccaaataacaatttaaaaagcgtactatatatcagtttagaatatgtatgttagccaggagtgaacgaggcccttatgtcgtttttcctagaagccccggctgtgcactctctttctagtatttctcttgcactaaacattgtattcttactaatcatccacaggcacaacctcttgagttcatgtgctttggaaacttgtaggaattcaaagtgtgtgatatcacatttctatgttcttccgttaaaaaaaaagcatttctatgttcttcctgatcatgtactagcgtatgatatttctgtttttatcgggcgctcgaataggagagtttttggattacattgcctactaggagtatttgccttgtcctaactaatcctcgtacgttacgttacatagtataggttcaagtcttgttgacgaacggaacggacgtacgtacggagttcacacaagctaagctaagctcggtcggaaggaattaatggcagcgaatccatccggcgagatcctcacgtaggagtattatacgtac

SEQ ID NO: 102993 - DNA, 508 bp, Oryza sativa
cctgcgccccctcagagaagagattgtagatatttctaaacaagaaatcgagtctaatatggataattgtatctgttaattaggataagagccaggttaagtttgagtcgtgtctgatatggatgagttttgtattatgggtataaatatatgcctagggtcttgtaaggaggataacaatagttcaatatactctcgacgcatcgccacccttttcatttttggttgtctcgatgagttcttgtttcgagtcgagctgcattggcttcgatctttggcaagatataagacttgtctattatcatatatcttagctaatctaagtggatgactctatttacctatatcggtgttgacgaaaaatacgcactcggctgatggtgccagatctgtgttggcgcgaactaagtcgacgaacacaacggcctaggagatctgcttaattagctctagtgcaggtctaaaatactgataagatgcgggtgtgctagtcagtttgatcctacaa

SEQ ID NO: 102994 - DNA, 5936 bp, Oryza sativa
tccccctcctcccttcccacgcagcaggcggccggctgggccgcgcacgggcccagtggcgagcggcggcaggcggcagccgctgccggtatttttttttacaatttgtgattcactaagatgtataattttgtgatttgttgcatgatctgagatatataatctgtgatgtatttggtttgtgtgtaattttttaaagatttgtgatgtatttgatttgtatgtataagtaacttaagatttatgatgggaatgttttgggatgttactttgatttgaggtttgatttggggatatgtatcctacttgatttggagatatgtatcccacttgatttgggagaaaatacaaggattaaactctagctaaaaaaataaaaaaaagagacctaatgggactgccgctactctctctttagtgccggttggtgttaccaaccgggactaaagataaccaacaccaaccgggactaaagatggatctttagtcccggttatttcaatcgggattaaagatgggtatctttagtcccggattcatagtcctggttaaaaaaccgggactaaagggggttaccaaccgggagtataaatgatttctttaccagtaagggacataccattgtcaccaaatgacaaacaaaaggctagttgctgctgcatgcaaataacttgtcattgactagagaaggaggaggccatggtttctttttagggaaaaaaaacatgtatcccgacattagactgtcgagtcaaagcgagaagccttgaaagcgaaaaagaaagaagagcaaagacaaatatttacaggggaaacagcacttagggctactcctcgctaaacaggaaaatgccggcagctctctagactgtgacttcctcctttatctctgcaacaaggagttcctcagttttctgcttatgatcaaagacccgtgcgttatgttccttccaaatacgccaacaggccaacataaaagaaagaatcaaacgaggccatggtttcaactccccccaatgcaagactatatccatcatctcagagtaaagcattccaatatcttgacaagccaatgcaagacaacttactttagttggtggcacccaaggtggcaaacgatgtactcaaccagtcagttcataagaggaaaatgaaaaaggaaggggggaaaaataatacaccttgatgtagggtttcgcagggatggcggtggcggcttcgttgctgctcgaatacgtcagccgctcgctgcggtggccgattcctcgcgctctcaaggagctcctcttgtcgccccactgccttaaagagagcccacggtggctctacagctcaagacggtgttgggacgaaatcccaacagaatatggtcagctctctcctaagccagtcgccagatttgatctgtgtaaattgattacccaaatttattgcatatcggatccaattagctgtgtgtttttcctaacattgggtatatgaataatgtcttttttttttcttaaaacttctcaactctgttgccatatatgcagagttgttctttttttcatttgggcgacactgggacatctaatagttttcttttattttggtggttcactcagacgaatttccttaaacatgtaaccagagatattactgcttattgagatctcaagcttaatcacgccaatagcaggggatcaaactatctttattccaggagttcataagagctcggatataatccatgttccattaatttataatacgaaggaaaatccatgttctatctttatcaaacggaagtttaattgcattataaaccaatgttccattattaaattataatacaaaagcatgttgcatgtgtttgcaggctttacagcttgaaagggcacaacgagatcctgcagagaagaataaaggggctgtttggtttacacgaacttattccaagtccctgtcacatcggatgtttggacactaatttggagtattaaacatacaataattataaaacccattccataagcttggactaattcgcgagacgaatcttttgagtctaattacgccatgattttgacaatgtgatgctacagtaaacttttgataattatggattaattaggcttaaaaaaatagggtgagaaagggtgagaaagcacctcgttttccacgcgcacgcttcccaaaatactaaacggtgtgttttttgtaaaaaaaatttataggaaagttgctttaaaaaatcatattaatctatttttaaaatttaaaatagttaatacttaattaatcatgcgctaatagctcacatcgttttacgtatctttccagtcttaccaatatccttctcctcgaactcaccctaaggctctagaagagcgcatgatttcacatatgggtaatttaaaccgcggattagataaactagaaggaaggatcgatggcctgagtgctgtcttagaaagggaggtgctacataaaaagtaattaaccaatcactttatttatttactgtatatatactagtattgcatatgtgttttcgttgcttgtttatcctaattatgttcattgtaactttcagatgcgatgaatggacactaagggtggtggtgggtctgactggtatatatggtgttgcttttcttgttaagaaatcatgaaatgcagagtcataagaagaaggaagatcttttcagaagcaagtcaacaagtgagataatggtcaaggggaaaatccttttaagcctttactttggcattttttttgctagtttagtgtttagtgtatatgttcttcacttcatcctggactagaatttaactttgctatctctgacttggggtgtttctttagtgtaaaaccattctgtaagattttggtgaagctccttttttattggcaaaattggttcttagcatccaaagttttcaattttggttttatagtaccaaagttcaccgtttactataatagcaccttatatcgtacctccgtttctatttatatgccttccgtcgcactcttctgttttccgttttctttaacagtgctggagatcatggctgagagaatggatcatctttccccttcttaattacaggattagttttgatctcctgacgaaatgagcgaacgtactcgttccgggtttgcatcgtctgcctttgacgcaaacggcaaattttgtccaagccgttcgtctcttaaccaacaactccatcgtttggtcccacgctgacactcccattctatggactactctgcacttaatactagccaattaattcagaattaggtcttgtttatttccctaaaactttttcttaaaaacatcacatcgaatctttagacaaatacatgaagcattaaatatggataaaaataaaaactaattgcacagttagggagaaaatcgcgagatgaatcttttgagcctaattagtccatgattagccataagtgctacagtaacctacatgtgataatgacagattaattaggctcaaaagattcgtctcgtggtctccaggtgggttatgaaattagttttttcatttgtatctcaaaaacccattccgtcatccggtcaaacatccgatgtgacacccaaaaaatttcttttcacaaacttagttgtttgctctataggaaagccaacaaaatgatctccgcaataaaacaaggtaaaatagagctcgcaccattggcaaatttgtgccaaataaaaagaatatagaactacatctaatatatttactcatctctcgttccataatacttaaccttctgaataaaattagagtcaaacaattaatctttgactatcaataatatttgaaacatttggtttgaagaaattagaacatgatgtataaaattagtctaaaaaatgatttaataaacttaaatatttactttttacgtatattataatataaacaatagtggggttagaaaaaatatttgagcccgggcaaaaatttcaccatcagtttattcaaaagtattaaaatttaatggtgttttcgccggcgatggcttcgcccctgaatattaaaatatactacctgtgtcccaaaatataagaactaacgatcagatgagacattctgtagtactacaaatctgaaaatgtctcatccgatcctaagttcttataatttgggatggaggaagtagttaaatatatattttgtaatatgtttcatagtacaaaatgttaagaactatatatagacatagtgatatgtagattttttttttaattgtacgataatttctcttttgtttacggtgaatataggacaaaatagctaagttgattatatccatgagtaggttgttaaagtgatttattagcacatcagattctattgattagtggctgttaattagactatgaggtgggcctaacatacaacggttgattgagtgatgaacggtttagatgttatcaacggcaaagtttgccgtttgcctgaaaggcagactatgcgaactcactcgtcctgtcgtccgttctcggtggcgacgagctcgacagttctcgccatccctgtcgccggacatccctatcgtacgcggtgacggtggcggctggccttgtcatgccgatctccttgccctcctcctcccctggacgtccccatcgccaccatcgctggcattatgcttggagaactgcatatgaaatgaaggtgccttctaatgaatttcatcgagtttttttttaagaaaaaggtcataagacctggcttctattgaaagtccgaaggttgtgctgggaaacccagacaccagattacagcatagggagggacgaggccttcaagatgaagaaaaaacagacttagactcaaactaccagctctaattaaaagaaacaccacgcccaaaaggaccaaaagggttgctcatacaagcagtttcagacacaaaacacaacctcgggggtcgacctagttcgcgattgatcgcgagaccttatgacccacgatcaggtccccccacatggtttctttttttggcaccacattacttctctattttagtaattttatacacctaaagtttgtacacctcaagtttacacatctaaaatttataaatcaaaagtttatatattgattcaaatttaaatttgaattcaaatattttttatatatagaatttctatacatctaaagtttatagactcaaagtttataagtcaaaagtttatataccctattcaaatttgattttgaattatatccgattcaaatttgaatttgaattcaaaattttttatatatagtatttctatacatctaaagtttatgcacctaaagtttataaacccaaagtttataagtcaaaagtttacatacccgattcaaatttgaatttgagtacaaatattttttatatatagtatttctatacatctaaagtttatagacccaaagtttataagtcaaaagtttacatacctgattcaaatttgaatttgaattcaaatattagtttatagacctaaagtttataagtcaaaagcttacatacccgtttcaaatttaaatttaaatttaaatattttttatatagtatttttatacataaataaaggtctaaacaatcgctaacatcagctgtgtaaaaatcttgagcaataaagcaactaagtattctccgcactcaatgggccgaaaaatggatttgcactgatcgcgtgatgctcccgcacgcgagcgatcgctgattagccatttcgcaacctcagcagacaggaagaactgaagcatctaagacaccccctcaactaagctatcaccctatgcccagcctattacttccagtgttggcagcagcgaccttcatcttctctcccaactccatcatcctgttagcttcttcagcacgccctaaagccttccactgcagcaaataggaagcaatc

SEQ ID NO: 102995 - DNA, 1425 bp, Oryza sativa
acttagacacctgagcgccaaatagcatggcgctgaatatacattggcacgctgacttagtctaccatccgccatggcacggcattcagtggcaactgacgtggcgctgaggtgtctaagttcagcgccatatgatttggcgttgagcaaaaaggtcatttttaaaataagttttggcagcggttcatttataaaaatagtttttgcaaagggtaaaattgtcaaaattaatgcatggtgcaagctagctacttcaagctccacacacctatatgtaatttagttctagtatagccgtatagctagctaaactaaggttctacacggctgactttgatcctacaactcggctaaactgctactttctccgtttcataatgtaagtcattttagtatttcctacatatatattgatgttaatgaatctatatagatatatatgtctagattctttaacatcaatataaatgtgggaaatgctaaaatgacttacattgtgaaacggagggagggagtattctttaatcatgattacgtgtctagattctttaacatcaatataaatgtgggaaatgttagaatgacttacattgtgaaacggaggagtattctttaatcatgattacgtttcctaaaccggtaaataatatattttctaaatacattttccataaaagtttttattaaaaaacaaataaactcattttacttgataaacaacgtgttaatagcccatatcgtgttacgcaccgcgttaaatataatcttaggcaagatgccgtttccaatgcagcccctgtctattaaaacacagggttacccatgttatgggcaccatctcagccaatctcccactcaatatattccccctcccatcctgtgctgtcttgactcttctccttcgtagttctaccaaatggcttccggcgccgccgtcaccgccgccgccgccatgtgcaccgtgctggtgatcctctcaaccggcggccagccaccggcggcggcggcgcagaccgattactgcgccaccgcttgctcctcgagttctaatggaacggtgacgtgctacaacaacgctatcaacacatgcagctcaaactgcagcatcacacctcagtattgcgaccagtgccgcagagagtccaaccagcagtgccagaactactgctacaatggctgcttgtacggctgcagcttgcagcacccgtaaattcaacgcatcccttatttctttttattcactgtaagaaataagaaagggcaccccccgtctgctcttgtgcatctgtctattttgtgtactcgccgtatgataaaaaatatataatgttagaccttttccattttgatacaggtgtgactttgactataacttagccacaataatttaaacaatatataataagtgcaggagatttaaaaaaa

SEQ ID NO: 102996 - DNA, 1113 bp, Oryza sativa
gaattcatgatcaagggtctattttccatgctcaaagactggactatttattattcctcgaagggttatcaaccgaatacttgcgccagtcgagattcaattattatatatattttggagtatctcataagggataatcactcagatcaaaagctattcatatgagccacacttggtctatatcacccggaagatttattactcgggagcatgttacatgcgtcatcctttaaagggtgtcgaaggcatattttttggcccaggcctaatatgtctgcagcccatattttcaggtgtggcctgtcacgttcttttagggacttaggcactttttgcttacgccaaagtgcgcgtgatcaagtgcccaataccttaaaatccttttataccgcagttactcagctttttaggagttggtacaatgcatcttaaaaggtgttaaacagtaaagctttatatagctgccccgctgacttttttatatatagtcagggcactgtttgggtttatcaagcaattgattggatacaatatcattgctttttgccacgtaagtgtgcatttttattgaccaatattatggcttaggctgattatatatcttggtcattttccaagtggttggtaaatcctttatgagtttatttactcggatttcacaccacatatgccgtatatttccgggtgtggtgaaaccatgtgtcttttagggacttaagcacatctgttaaagcagtgtgcgcatggcgtatgcccaatactttggaaatttctttattcacaacatacaagcttctctatagctgttttgctatgtgaatttttaatgatgtagccaactttaggttacactcatcatattttacaaagtagtcggtatatcactcggatcatgttattcagggattcacaccgcatatgctacatattaatatcaagtcgcttagttgactataattatcgaaaccactcggttggttggattatttattccttgactatatgcttggtttgttcaattaaccacatagtcgagggctacacctattaggtgcatctagtcgatgcacctgactttatttttcagccctccacagtcttcagatttggtaa

SEQ ID NO: 102997 - DNA, 897 bp, Oryza sativa
tagctagctgactgcatgcctggctcgcggtatcgtgcgatgaccgtttttgcatgcagaatctgtaccttaaataagtatagtattaactaaatcaaatttagattacaaatatgttaaaagaatattatgcccttccttaaggaacagaagaaagtatttattcaattaccaaaaatgaggaaaaaatacaataatattggaaaagtatacgtaccgtcgactactctaaaactacactattttagcaatgaaattttaaagtaaagctgcaattttttaggtagggaattctagtgttgaaagttcaggttatatttttcttccgtttcgggagctaggatgctcggctaacatttggaaacgtggggttaaggttaccatccaaattaaggttttccaagaaggttaactattagtagcatcgacgtcaaattaatcaaccgggtcaaatccttggcgtacgtcttattcgagctttttttttatttagtgtgtactataagccaaattaaagagacatgtgcatgactcaattaattaagcaaccaaaaataacttttagctagggaaaaaaaaccatgccacgttgaaccaaccaggtgcaaaacggtatagattatcacccagcttaaaattgaaaagctgtattaatcaagcaccatatagaaacataatgttgatactcgtgattcgcccatgatactcaatgatactcctacatttttatatgatatcgatgatggatagaaatagcttacatgcatgatatcttgaggtctaattgtagtaccttagagatactcgaattaaatttaaaaatatactgttcattcaattttttttgaaatattcgggatgtaaattttttttaagaaatatattgtcaatctcgcg

SEQ ID NO: 102998 - DNA, 791 bp, Oryza sativa
ctcgacaaccgatgcgatgttcccaaacatcgcatcccctgcggttggcaccgcttcacattgtataaatgtactgttgatcaatgagaaaatcatccattcgctctattgtgttcaattctctctctcgctcaatctctctcgctccaatcaattcatccactttcaacacgttagtcgtgccttatattttagcatgaagagagtatgtcatattaataagtttaagagataatatttaaaaactgtaatagtaacatgtgggctggcagattcactgccaacatcattagagtccttttaaggaagtataaatcaatgatacattaaagaatcatatactacctcagtctcaaaatggattttgacaatatatcgataaaatcctttaaagtcagagatatcattgtagtatccttgactttcggaatgcaattctaaagatagcataaataagtgatagagaattttttttttgtttgcaagggacaaaagagttcattgatcagaagataaatccttccccataggatgtgagatgaggttataagagttaccacatcaaaattctgagcttgcttcacaatgagcataatttgcaggctcgtagagagttgcaaacatgacaaactttttttttccttagaaagcgtggcacgccatatatatttttcgtggccgaaatttagcgttaatttacatgaattgttgagttgtattttccatatctgaatgatcgtatagctgctaaacgtaataaatcttcctttttttcccggggctgcaggaat

SEQ ID NO: 102999 - DNA, 602 bp, Oryza sativa
acccatacctgctttcgacccctagtgtgcaccgaacggagaggtactcatcatcatttcgttgcttctaataaataaacatgtcacaaaacttgcaatgcttgaacacctattgcatgaaattgaatgttagggctttgtttcacaatattggccttaattttattggttgatgcattgaaatgtgaatctgttcatgttattaagagttaatgataatcatcactaacatcaaggccattaattgggcccaatttgagaaagaagccttacaagataaggtgttaaaagccacggatggaatggttagttgatacaagtctcattagagattactttatactaatttcagcttagtataagaaatgagattactttccacggatggaatggttagttgatacaagtctcattagagattactttctagtgatttcagcttgggataagaaatgagattactttctagtgatttcagcttcatataagaaacaaggacttagaggaatgtagtggaagaatagccttgtggatcagcttagtgctttaaagcaattaatataatctgatgatttttttcatcgtttctgtttaggatatgc

SEQ ID NO: 103000 - DNA, 526 bp, Oryza sativa
aaaaatctgtatcttaattagaaaagaacacgaattattttgaagccaggataatgaacttaaccaaactaccgatacgaacatttcaggacaaagcatccaaaaggcaaaaatatagcccaatatctgcattgatactgcagggttattagatgttatttcattaaacgaactaacaggttttagtttactatgtttgttggttagcttctcagatacaattgtgcggtcccatttggacaatgggattgggaaaaaaattcccacccactaaaggataacttttaatcctagcaactcattctgcctacctcatttcatcctcatccttcactttccctatcccaatcccacccctctcaaccaatcatccaaacaaggcctgggtggttagttcttgtttcttgacatgcaaacaaacatatcatactttgatttcaacaattggcaggatattactgtaatattaaaattaccaatcttgtgtatatgttagacctcagaatatgcggttggctttcatcaa

SEQ ID NO: 103001 - DNA, 662 bp, Oryza sativa
  unsure (1)..(662): unsure at all n locations
gggcggccgaatccanaactagtggatccccccttgcaatagacaggctatattttcatacgtctgattccaggcatgtcacggaatcatattaaagatgggacttcaggctgaaacagtgaaatgattgacacgcagaaccaaacaccttacttcaacaggtatatgccagcattaaaaatataagaaactctaagagagtaaataaaacaagatcataaaccatcacattctaaggtgagcagagatacagatgagatcaaaacagtagggaagttaacatccataccataacatgtaactaaccaccagtgactactattctgtcgaagttatgacaggagttcctaaaatagttcatcaagattactgcactagcttccaaagaaatggttgggtattcgaataggtacgtatccagcacaattcaagaaaacagtgccaaattgttcagatacactaggtgacataataagtgcacatcaggtgacggaacaatatcatgcatttaatgttcagaaacgcccttcaagcaaattgttcgaactttacacaaatggtcacacaactataatggtggtgcttctaaagagcattgacaaattaccccaaaaaaattcaaaataagaggatttcaaccaatccaacagaagaatacaatc

SEQ ID NO: 103002 - DNA, 980 bp, Oryza sativa
cgaaagatggtttctccaccagtggcatatgctacttccaattttccaaatacatgcatatttcaggaaaggacccatgcaacattttttgtcacggcacagcatgcatgcatgtatcagccaagcctaaggatagtcctaatacaaaggtagcatatacttctctataaaaatgatagtatatactaatacaaagtagtatatactttacttctctacgtaaaaaagtagtagaaaagaagtatgtggcagcatatacttctctaggtaaaaaaaaaacaagtactccgtccgtttcaaaatgtttgacatcgttgaatttttagtacgtgtttgaccattcgtcttattcaaaaattttaagtaattatttattcttttcatatctatatttgattcattgttaaatatactttcatgtacatatatagttttacatatttcacaaattattttaataagacgaacggtcaaacatgtgctaaaaagtcaatggtatcaaatattttgaaacggagggagtatgtggctgtggcagcatggcatatgtgcgtatctagctaattaaaagaagcagcacgatcctcttaaaaaggcagtatatgcttataatcctcgagattaactattaatattaatcatgaatatactagttggaaagaaaagaagtatgtactaacatactacttttaaaaagtacatacttatactacaatacaaaacaagtatatatacttctacaacaagtagctaagtatatatttttaatgagaaaaaaaggtatatacttccaacgagcttccattaaatttacgtacgcaccggccggtgcatgcagatatttgaaaaaaaatagaaatggtgttttcttttttttatctaattattcattatgaactaatggatatccattaagaagagggagtacatacacctgggagtacaaaagagagatcatatatatatatatatatatatat

SEQ ID NO: 103003 - DNA, 4520 bp, Oryza sativa
aaggtagattccatctccctgatgcagtggtcgtcgcccgcaaccgtcgcttctcaatgatcggagcggccggatctgaccctatgtgtcagccgacgacgtggagagtggaggggacctggtgtcgtctcttgtcaaccccgtgcagcggcgactgactgcaatcacggcgatcggcgcaagcagcaccttccaaaccaccatgatgtggattgagaggtggccgccgaagctggtggaagctcgaccgatggcatgggcagcgacatggaccacgagcggctccgttaccttccactcccggcaactacgagctcgaccgtgggaggcactctcggcggcgtgagggatctcgcacaagttgtcggttttgaggcgctgcagctgcaggagcgagccgctgcctgcgcaagtcatcggcatcacatatattttgttttttttccattgtttcttttttttgtctttattatttttgacaacgcagaggagaacggatgcctcgacgccgacggctccatcgtggtcaatccacatcgacggtggcctggaaggtgctgcttgccggtcgccgcacgcccccgggctgtccaatcagaccgatcgagagtggatgcaaaatgctctaggctgtagatcagcaaatataaccggcgacagatgcgtgctgctctttgccaatgccgatgagagctgccgatggccaatgttttctttttgtgtattctgtattttctttccaccaggaccgtgtgattattttatacatgtgattcactgtatgactggatgcaacagatgtattatttatatattatatatatatacccacaatctacaccctatatgtagcttgcacaaatcttagggcaagtatattaggtgctaacaaaatgtaccatgcatgatgtttacgttatactatattttttacaagtgtaaattaccttgtttatgtaatttttgtatttcttttatgcaaaacttgtatatgtagtttaccttgtttatataaattatcttgtttatgtagtttttgatggtaggatatatatcattttggaagtatcatttttgcaagatgacaatttggtgactaaatagcatgttataaacaaaataagggttagagaaatacaatgcactagttatataaatgtcatatatgattgttattggaaaaaaattatttggtaaaaaaggcaacatacatgttatacatattgtgaaccaacctaatcctaatcttttctctctatagtaagcattcatttggttaaggttaggtacattttgcagcatgaatcttggaacacatcaacggtgtaaattgtaggtacatgtgaaccccgagtgcaaatatacattttcatatatatagcaaaagtgcccgtgcgttgcaccaggtgtacagtgataaaaagtgttgtttggtttagtcaactaatctgctaaaaaaatgtttgttctatatttgtggaatatatatgatgtttagttgggatgatttgtagcatgggagaaaatggatgaacgaacaatgcgattttctttgtccaaaaggcgacggatgaaaatttgtatcacaaatggaaatatttattttttatgtaggtaagtctaataaaatatgagtggaatttttgtactaaatgtactttgagttgcgagaatatatactttttagaaacacgagcattgagattgacgaagttaccacaaacgccttgagcaaccgtcttaaatcaaagatttgaatctaggttgattggttcctccacaagaaacctatccagttaaattatacacactttgcaattgtgggaatatacctgtgtattgttacctgaataaaatgtgttgagtttaacaaatcgtaaaaattaatcttattatttttgtgagagtaagtattgttttttatttacaaattgtatttgaggtcaaatattaataagtagatataaaaaaaatgaaagaagattatacagggagggaaaaaaaataaaaaaagagcggatagggacaaagaaaaaaaaagagcagagggaacaggtcaagatatttttaattgtttaaacatttttaataatgagatgcccgtgcattgcagcggataaactaaaaatataataaatacaaaaatattatatgattaggatttagattttatgatatgagccccattagaccttagaaatagaaaaagttgtaagaaaaagtcccattagaccttatcggcctgctattgtgcgcccaacccatgaaatacgcgtggtgctacggcccgatatggacgctggctcgatttgagccatttgttttgatggacggctcggatcgattctaaatccatcaaaaccctagcccgaatcacaccttcccccgaccacaagctcctccttttgctcggctcctccccgaccggtggcacctcgtcccatcccctcccctctcccgaccagcggcaccactcctcctctgccgccccctctctgccactccctctcctcctcctcctcctccccctcccctcccctcttagcggcgtctctcagtgcggcggcttcccgcgggtagatccggtggcaccaatggcgccggtggcttcccacggtgaatccgatggcgacgacggtagcagttcccacggtggatccggcgaccccgacagctacacgcgtggtggcggcttcctgcgccggatccgacgactacgacggtggcggcggcttccggtgatgtcttattttttttcctctttcacttgattgtcttattggattttgcatctatgtttgtgatgaatttttgctgaatcactcgtgcatttggttgttgatctagactctagatgattttatttttgtcttggactctcatctcagacgttccggacgagggattttttttggaggggacggatgaaaaagtagcgtgttgacggacgaggtgacgatcggaaagttacgaatcttttagttagttaagaggtgttagtttttttaaaaagaccaactcttgtaaaatattataggtgtagggtaatataaaaccgacacctataacacccttttttttaaaaaaaaggcacctgcaaaagccaagcagagtcttatccatccatccacagcggagataaggctgagcagagccgagccagtggggccatcgaggagataaggccgagatctcgcattattttttctcggtctctcgttttcctctcctctctctcggtcttctctctcgctttcctctctcttagagccgaggcggcaggcggcggcgcaagaggggaggcggtgggcgctgggtggtggcggcgggtggagacggtgcggccagcggcaggaggcggcatcggtggcgatggccgcgccctcccctcctcgtcagcggcgagtggcggcatcggcggcgtgcagcgggaggagcggcggctgctcggaggcgccctccctccgccagatccggcgggaggaagggctccggagccgcgccgccttaccatcctccatgccaccacccaatgcgccggttaccttgacacccgacatgcctcctcctgcctttgttgttggatttatgataatacatgggtttcttgtgggggtcaaattcatgaggtcgaaagattaaatttggtattttcttgttgtttttggttgtctagttgattgattgatttggggatctagcttggggatgttttttgaagacagactcggactcaaatgaacgaacctaaattttgggagggacggatcgcacagtcgtatggatgaaaattaggtgatgaaaggaaaataggtgacgaaaggaaaattatgaataattagttaagataatggatttattttatatacggacgacggaaacttttttaattttttaagtagttagagattagagataaagattagatcttttccttttgtgattaggaatttatattgtttatttattttttagaaataaaaagaaaaaaagaaatagggaggggagctctttttttttgggagtacctatacagctggcgccacattttggcccaaaaatgtggcgattcctggaccacacaaactactgaggccacaaacaaaacgggcgtgcaaaaaatcaaaccatacccgttacagcaaaaaaaacccataaaacaagcgccacatttaggcctaaaaatgtggcgaatcctggacaacaaaaatcactccggccttcaaccaaaacgggcatgcaaaataacatcacaacaaacccatttaaaaaagcccacaatggcaagcatacaaaaaagcccatatgggctaaaactaaaacaagatgagcccacaactagaaataacaaaaaaaaaaaagcccatgagtgacagccagaaaaaaaaagggttcatcttcagctacaaagaaaggaaaaagacatgctaagtgaaaagcaacgccaattaagcactttagaaaagatcagagcaaaccacgtgacaagtgctcatctagctcgttctctccccccaacc

SEQ ID NO: 103004 - DNA, 847 bp, Oryza sativa
aaaagaaaatacattcaccagtaactaaaattacatttttaatttcaacatattaacaatgtaagaagtgaacaaattgctacaatgatgcaaacatcttcactgtaaattaaattcgattcatataaaaatatatatagaagttgaaaccaaaattacacagtaaagtactaacctagcgaaaaataaacttaaaaaggagaaaattacattggccatagatgaaaattacatttgtaatttcaatattaaatcaatgtaagttcaggaaaaatagtgtaaatctacaccaaacttgaatacaattataaaactacttcattccagagaaattatacttcaacaaaatttcaactaacaaatctacaccaaacttgaatacaattataaaactacttcattgcagagaaatcatacttcaacttcaaattaaattataaaactacttcattccagacaaagcacattgacacagcataacccgttgatgagacatagcaaattaaattttacctagaaataggacaacacaagatttacagtcaaatataataaaaattacatatgtaactaggatgtaagtagggtataactaggatgtaactagtgtgtaagtagggtgtaactaggatgtaactagtttgtaagtcgggtgtaagtatgataaaaaaatcatttacctattactaaaattacatttgtagtttcaatgtataactaatgtaagagaacaaactgcaagagcactgctctctatgttattttgggtgtagctatatttatggcgccatattttttacccaaaaaaaactcggcaggtatttacattgtaaattcctaaattaca

SEQ ID NO: 103005 - DNA, 635 bp, Oryza sativa
taacaaaaaaaaaacaaaaaaatctgacagttttaaggttgcaattttgtcagaattttatcttttttgttattctctatgtagaatgaatttgaagatgcaactttgcacgtagatgtaatactattgaaagtacatgtatgaattttcttagaattttttgtgataacttttagttggtgtacacggtgtgtacacgcgaaggcctgtgtgcataggatacgctcccgttggttgtatttgtaaagacaagtatatgtgtattagttgaatacccgtgctttgaattttactataatatttcctaatataaataaaaatacaattgtcatgaattatgttacctatctatttattgtaataattattcaccttaatttgatttaatttatatgagactattcatgtggatttgatcatttttaatatcaagaagctcaaggataattttcaaaattttcaatggaagtaaaatgggatgatagattcactgccgccacaactccatctattgtatactaatagtctattaaacttcatacaaacgctctcaaactgtcacgtggcttattacaaacgctcataagtcgtcatatggcgttttaataaattagaaaaattcctaaaaattctaa

SEQ ID NO: 103006 - DNA, 2167 bp, Oryza sativa
ggttcctcacgtctgcagctcgtgtttcattcgtgtgaggcccgctttgtcagccgcttgtttcgattgacacatagagtttcacttcattctctttgtggatcatctctgtgaacccggtccacggtgatctagccatctgactcgtgggtcctgcttgccagtcactcgatcatttctctcgagcgatattacatcacacataatttaacggtataataataattaaacaattcaaaaatatccatttaaattacacttaaaactcatatggtcatttcttgacatgcatgacccgtttaaattgtttaatttttgttataacttcaagaacccgtgattgttgtttttatgcatcgttatagtttcttttttagatttgtagccatgttttgtggttcgtgtagttgtcgtcgtgttagaagttcccgaagtcatcggaagaggccataccatattccttgaaaatattgaatcctattattgcaaaactatgttgtttcacttctatatgcatcgcttttgtaaattttatgatgctcactattgtttatttaatagttagtatttcctatgatctttgttatatagccatgttgttgaattgctacacatatgctcttgataaccttaagaaaatgataaaatgactagtatggctccctatatgatggacttaatagttgctctaggttaggcttatctatgcttagatccaacatagaaccactttttataaattagactgtgggcaacaactaaaatgtgtaagaatgatgatcagaactccctaaatctgttttggtggggcgcgaggtgtatggtttttgttagaagcacctcgtccactataaggaccggtcttcggacctctgttgcgaagcataacagtgcaaccacaagtctaatgggtaaggcctgactagaagtttagaaaagtctggggccagggaggtccactttgacctggagcacgagggggcatgtcttgtcccgagggattcggcaaactttaccttgtcggggtccagcgagcggcgaaaaccttagcaggtccttctattttgggttgagctacatagatagtcttgacacgatctttactttttgggtacctttgaggtatcacgatgcatggctgacatgaagtcaagtattgtgtcttgtgggtaaagatgtacacctttggttagagtaaaactattcgattagccgcgcccttggttatgggcaagcctaacaatatacccaagttatttcttctaagtgatgatggaattcatggaactttggacaggtggttaacctgggtttaaggccggtatgcgtgggtccgcaaccatgtaatattacttagaaataggaccgagtttaaactatgttttaaaaacatgaaaatattgcaactttggctttatgcaaaaataaaccctattatgcaaactcttttcccctttgcactataattcatttctcggcatggcttgctgagtacggtggttgtactcattctcgctcaatctttccccctctagtcagagaagcttttcgaagaagaagtcttaggtggagtcttggcttatccccagttgagcgcctgtgaagatggagccgtaggcccgctagtccgctgctgtttttcttttgttgtcaggtctaatgtgtctttgtaataatgtaaatactatcgtgttaattaataaagatgtgtctttgtatcaagtttattgtagtgtaccctggcttttcctgggacgggattaatacactagcgttcgggaaagatattttctaggcgtgacacatacgatgttttgagcattatattctgatccaatggttctacccacctccatcacccagtataagctccttccagcttttgtgttccccatattgtgttcacctactttcaggtgaccatattgttttccccatataattcaagttgtcattaatttcagtccttttttttttttgcttttgtaggatatagctagagagggagaacgttggaacgttagattggtagatagttcttctgatatgaatagaagatccccagccataacgtgaatgagcaaagcataatgacactagattatatttacagtgaattgtagaacacatggcattaagtaagaagtggctatgataatggtatatt

SEQ ID NO: 103007 - DNA, 817 bp, Oryza sativa
  unsure (1)..(817): unsure at all n locations
gccagttcagcaagccatggccggccactgcagtgaccacacccgtattgctgggcttcagctcctagcgaagagatagacaagcggaggtggcgaagccacggcctgcgccacccgccccctgcccgcgcgccactctgccgcttgcccgcgcgcagctcctccccccgccatctgcgcccgcttgctgccgcccgcccgcgcgccattccgccacccgccacccaagcgtggctcgaggaggaggagaaggaagaagaggcctgcgccgcgcgctgcccgcctcccgtgcagctcagagaggtggctcgcacgccacctgcacccgtgcagctgccacccgtgcagctgctcccccgccgacgcccgtgaagaagagaggagagaggaagagaggaggggaagaagaggctaacgcgtggggcccacgtgggtcccacgctgagttagttgccacaccggataaaaccggagtcaaaaccgccgagagacctagtttgcagtggttttataagttgggggacgtcggatatctggttttgtggttgggggacgattttgtaactcgattgacaagttgagggaccttcggtgtactttttcctctcccttctgtccctctacctctccctcccggcctctcttcctcttgggctgcagccgccctcgacccacccctctctttcctttctccccttggaccctaagtccgtttcnnttgtcctccgggcggcccagctggcccagcccccggtcgttttccacctccagccgagccgcctgttcatctctcaactcaagcaccgccggcatgccg

SEQ ID NO: 103008 - DNA, 699 bp, Oryza sativa
tatggcgtgtttcttcagcacagagtcacattggtcacactcaagaatactctccaaggtgccgattgctttgctgcttgttgatatttcatgccacagaatattgtttgattttgtagggccatacataaatcgcataaatcggcttagtatcttcaccccgagctctgccatacaggaccattcgttatgttgttttttgtgaagtgatcccttggacgttataagtgccacaatcttgttgatcaaggccggatcatctgtgttgctcatgaggaacaagttgttcttgtcgtaggagagctttaaaaggatctgcatgcctgtaagttgcatctgtttataatctttggggtaataatccttttctttgacagaaatctggtgatcatcctcttcttcaaaagaaagttggtcgccgtcgtcttcttggaaagaactatggtggtcattctgaaatcctttctgctcgagttcaagcaaggaagatacacatcgaatcccctgcaggattttgtctaaacggacctcaccagcaaagtgctcaacaatccttgcggctcgcaacctgatctctccatcatatgcacttttgaaatccagcatctgaactaagttgtggagtatgggactggaggatgcagatccaatcatattgtatatgggggagccactagtttcaaacggccgccacgcggt

SEQ ID NO: 103009 - DNA, 720 bp, Oryza sativa
cccccaaaaaaaaatcggaactgagacatttaaatattttatgaaacatgatgaagatacacgttgaaacatgtcgctgtcacgtatgaaacaacaagtattaacggattgaaacatgtgtttttttaacaaaatataatcatgcgatatcttgttgtaaagatttaattaaaacgaatacaatagtgtgatcggatcatggattggataaataatttaagagaaaaatcattttgaagcttgctaaaatacatgcatgcatgtgtgcatagatgaggtggagagagagtagtagcaggtagttttaggaattttatgaaataccctgaagacgcacattgaaacatatcactatcatgtatgaaacattttattttaacggtttgaaacatatgtttttcttttgacataacataatcatatgatatcttgttataaagatttaattggaatgaatacaacggtgtgatcggtttgtagatcggataagtaatttagaagaaaaaatatttaaagagaggaggaaaacatgaaaagaaatagttatgtatgtatgatgcagtgataggataggcgtccgatatttatgtttcttcggacgttcggtataaaggttttcccctccacctccctcctcccacacttaaccctctcactctctctctctcctttgtacgtacatacctgtcacttaccgtgtaaaaaagacctacgtacgta

SEQ ID NO: 103010 - DNA, 7559 bp, Oryza sativa
ctcataaacgaacttgagtttggagttaagatttggtgagaatttattttatatgtacacctatctctagtatttttttcataaatttacgaaacttttaggtataattttcacgagttttcaacacttagctcattttcaccggatatatcctcatactttttttcccatcctgtttgtttagtgtcgggttgacctatactccaaaaagttccttacgaaggttaatacttaagcatcacactttcttgcatgatgtgtgtcatccttgttttatttttttgttaatgatgttaggtttgactaaagtgtcaaacccatcacattaattagcaagtaggagtatcatcaacgaggaaagggttgtcctttggaatgaagaggttaagctaagcttggcacataaaggcagcacagatatgctactagctcaattatttgcatgtacaagatggtctagactatagatgattatatattaatacttaagctatgcaggggaggaggagaaagagggttagcttaccaaacaaaagcttcagccacaaaagattttacaaacaaatgggagaattattttgaatgccaaccaatctgatcttccccaaattaaacacacccatctacatctccaaatcctccatggtataagaaatacatggaaattctgaagagcatgggcaggtatactgtaagccacttcaaccttttttctaatctgaaataccttcttaattaatcaacaaaatacttaagtcaattcaatggagacgaggattgtagtagactagctaatccaggagtatgccttatattttcaataaattaaggttcgccctaactgaaatgaaatcatttttcaaaaatttaaaatggagaagccagttgcccactatgtgtacagttgcccactatgtgtacagtgcaattagttaattggcaaaaataaccttgctgaggtgatctgtatatttattttatatgattcaaaccacagtacgtaccaaaaagaattctgtaagggcgtcacatacgttgaatttctctgaccgtagtaagacttttgaggtactacaaaacaacactatcattattttacttaatcttcaagcatatatggatcattaaagaaaaccacaattggattagactttgacatgcttcaattatgcgaagacttgtgaccacaaaacaacaaatgacacgtacatagctagcaccacatgcacaattagtttaattatgacgacaaaatatgtaggaaagatccccttatctagctagtcctagttgagttgttgggtacatatataagctagaaccacacaataattcccatctaaattttaatccggtgagaattcctagctgcaaaaggaaaggacactctcatttggtggctcaactccattaacatcctaccagttgccattatttcagtgaagaaacattagcaacgcacgcaatatgccaatgtaaacgtgtcgccgacaggtgggcccatatgtcaaagagagtttgcaaactatttgtagccgtgcccaaaattggtttagcatgagaggtcaaaaactatagttgtcataaactatgcttatgcaagagaaccaagggaatattatgtatggccataagctatgaattatccgggattagggaataattgccgtcccattcttctgatccaaggggaccatctctttgctttagcaaataatttcaatactagctatcttctgcccgtgactgacaagctacacacaattacgggtatcgggcactgtaacagagaaacaaatcgagacccggtatgattttttaagataatgaaaaaaagggcatttttaaggacaaccacttattataaaatttatcaaggcaacaataagaactgaaataataaaaccaacacataaagaaaaataattattaaaatttatttatatatttttacctgtagttgacgaaaatctgtataattataacttctaagtttcgaaatgcagaatataagagctcatggttctcttcacacttttaagctaagccaaaaaaaagggaagtagcttttggtgaagaaagagagacgacggatcctggatgatgagatactaccgtgtttaattaaggagccaaaaaaaattgaccgcaaaaatttgtgatgatgagttttgcttttacctttttcctacttcagtcacagtagtgatcttttatcattctgtgatgataatgtttggcttcggcggtgcttttgctagcagcagtacgatgtatcctttttgccattcttccgaggctttagaaaaaggtgaaaacaagcaactttcgacatggtgccttccacctataggctacatgttccgtaaaatttgcacggttgtatttgtctagttatacacttgctggatttattacattagttgatcatggaaattttacatgcatcctactccctccgtcccatagtataagggatattgagtttttatttgtattgtttgaccactcgtcttattcaaaaaatttgtgcaaatataaaaactaaaaagttgtgcttaaagtattttggataataaagtaagttacggaaaaataaataataattctaatttttcttaataagacgagtggtcaaacaatacaagaaaaactcaaaatcacttatattatgggacggagggagtacgtatttattcaacatttcacgagtatgaatacaggtggcagtgttgtttcttctttctaaaaaaaataatacagacatatgttcatacacactcgcacaaacttataaatgcacatgcttatagcctacttttatgagcacattctaatattgggttagcatatattaagttcgatgaagttatcaccagcgtctttactgttgatgtgtgcgtcgtccacatctaaaaactaattaaagtaaatgcaagataaattttgctacatgagattgacttcggggttttagctgtagaacaccgtacaaatgaacctttggagaaagtcactcttgaaaattggatatttgttgataaacaccgtacatattaaaatatttatttccgattgaataggacatagaaatcgtgtgataagttagaaatatccttgggcccacatttcagctctcccatctctcttctctcctctctatcccttcgtcctctcccaatgatcactgccactaccttgtcatccctatccaaggcagcctccttgtatctctctgcccgtcaacctacgcggatccccttcctatgtagactgccactgtccaaagaccatcaacatccccgagaacctcctggccccctccccgtccaaatcgacgcctcccaatgaccaatgccaccaccctatcatctccatctcctctctctctctctctagatctggtgcttaggaaagctcatgtcatcatggactcctcgaccgccgccgcggcatgtggagggagaaggagaggtggtgccgtatcaacaacagtagtagtttcagggccggtcttggggttttggggccctagggcaaaaacttataaacacgtagcatttaatattcgatgtgataaaattatccatatctgacataggatgccttcccagcgacgtaaatctcgatagtgatctgaatgacgaccgacggatgatcgacacgagcgtggctactggcgagccgtgatttgctgacttgatgtttccgtttacgagacgccgagaagtcgagaagtcgtcgagagcgcaggagtagcgagcggcgtgacgtgatcgagacggcacaacgcgagtggtgtgatgtgatcaaggcgaagtgacgtaagtcaaatgaagatcgcttcagcttcgctgaaacaggcttgacgatggactaaaatttattttctgtattaggctattcaattgtctaacttaatatagacccatggcccatgaactagaattatacaatacgtagtatatatactatatgtgtataggggccccctagattttgaggggcctcgggcggccgcacggcctgaacccccccccccagggctggccttgagtagcttgaaatgtggctttgctcggggcccaacgtggcttgtgtggtcggcaagcatggtgtcgcatgatcgttagtgtggtgaagggtgaccgatagcgtggtgagggaggagaggggatatagtgaaagagagatgggatagctgacacgtcagcctaagggtatttatgacatttcacattatttctctcttctattcaactgaaaataaatattttaatgggtgtgatgtttagcagtaaatatccaacttttgatagtgttttccccaaaggttcacttaagcgatgtcctatagctaaaaatgcaaatgccatgtaataaattaagtttacctaaattcaaacacccatgctaaatcaaatcttgaacttgaatgtgggtgggcaagtttcacctggaagaaacctagccatctacacttaattcacatttgcgtaatattgctagttgacttagcctcttcatacattttcagactatgtttacggcggtcgctactactatcagtgttatcatcaatgcataaaatgacgaacatctgatttggtagtaatgattatttcaatacccctattaataaattcatatgaatagaccaggatcagaccagagagataactcaaaataaattaactcctgctaactttcttctaatatatatatatatatatatatatatatatatgaattgagtttggcctagttcaagacataacattttagcacatgattaattgagtattaattattacaaattttaaaataagtttttttaaaaaaacttttacataatatttttttttgaaaaaacacaacagttaaccgtttgaaaatggggttaaatcgagcattggagaacgtttatagacatgccaacagggtttacatgtacggtaaccttatctgtttttgaaaccacgatatacctcgtggtaatcgcgcggttatcatgggtggcggtaaccccacccaaaatagtttggtgaattctgcatgtcagtgtgacacgaacgccacacgctcgtactgcgttgaaccaacggcagagaaagtttttaggtagcccagtaagggcatctacaaccaaagacactctatggggcatctataaccaaagacactctatgggtgccctcactaaccgaagccactccgtgggacacctatctcccaatgaagcatactcgtacctgggttcttcaaaatctcaagcaaccaggtgaaggtactccaacccaatgggtaatcccaacccataaagctacaagtgttgtttttctcttttacccctctcttcaaactaaggaatttgaagacacgaagcattcagaatacatgaatatattcaacacaggaattttcaatcaagggtaacctcatatattataatccaattaagcaatagaatactatatattttctatctcactactctcaagtactactctctgctccctccgtcccataaaaaaccaacttaatattggatgtgacacatcctagtactacgaatctggatatacatatatccagattcatcgtactagaatatgtcacatccgatcctagattcgttttttatggacggagggagtagacaggaaagccttatcttatcctcctcattcatcgggtcattcaccgtatcatgtcccccccccccccaaaatcttccagaggcatcgagagcagcaaaccatcaaaatcaacagggatggctgagcgagcttgcgcgcgcggccgagctgggtaccgggcggagaaagcgaggcggcagtcagccgacgagctcgcatgggcgcacggtaggagcgagctgccaccatggccagcacaagctcgagctgcggggtttgcgactttgccccaccgcgccaccgccgattctgccacacagcgccgctcgtgagctccctccgctctctctccctctctctctctctcccgtcgcctctctctcgctgctgcccgtcgtcgccgccgacggagagcaggcgctgccggcagctggaggcgacagtccagcgccgtcgtgcgctgatctggccccctcgcggccagatcggatggaggggcgccggtgaaggttgtcgcgtaggtcgtcgccggcatcgtctccgccgctcgtctccctctccctctcgccgccgacgcttacctttctcccgccgctcgtcaatctctctccctctctctctcccgtcgcaagcggccgtgagggcgatgaggagggtcgccgccgccgccggagccatgccgttgctggtggaaggggacgagggtggaaggagaaaaaccggaggacagagcggtgtccttgggctactcccccacccaacgcgcctcctctatcaatctcccaatccaggcactcgtagagccgcgcccctctactaggggcgcgcgcttttgctggggccaggggcggagctaggtgtatcaagggggtgcccaggaacccggttcagaaatttttttagctatagtttatcaattttcaccatatatacacctcctcgattcaaacttaggcacccgtatcaagctaaactcaatctaaaatagactaaaatatatgagtggaaccccctcaatttcgttctacctccgcccctggctggggcacggcacggcgtgaaaaagggacgaggacggacgacgtgagccagggacacggcctggagagccgcgttgaacatgccctaactgtaaatacacatgacgatacagcgccccggaggaggagcagcaacacgagtacagtaaaaacgcgcatgtgcattgtgcacgcgagggggcgtggcggcgacgcacgggtacggtgcgtgcgggctccaccgcggcagcgacgggtcggaacctgacaacatgtgtgttgccccggaccacgcgcgacccccccttccaaacccgtcgcgtcaccctttttcccccggcctgtcggtgggacccacctgggcatcgcattgatcgatccttttttttttcttcttcccctacgacgtcgctcgcccaagtggaaagccgaggaaaccttgtcggtcacgagccccttttttacatgtttggactctgtaggctgtcggctgtgtagcagtagcttctttccgccgcgtatcgtatcgatgtccgaaagaacatcgaacggacgttttcagtgaacaaatcgatcgaatgctacgcctactcctagccgaatactccctccgcccaaaaaaaaaaaaaaaagaaaaccattcctatcatcgcaagataaatttagtgaggagtgaaaatgaccaaaatgacctttatcattgaaaaaagtagtaatggtaattggtagataaagggtatctaaggaataaaacatctcattttatatattgaagataggtaggataatagaagttgattttgtgtggaagaaaatttaaactctataagttaagttttttttttaaacggagagagtaggggtgtgtttagttcacgctaaaattgaaagtttgattgaa

SEQ ID NO: 103011 - DNA, 1642 bp, Oryza sativa
tccttcatgcgttgagtaatttactgaattaacccttaagataatcccaatgtgcctagcagctgatagctgagaagggaattaaacgaatattgtttggcgatgtgcgaaatgcgctgaaagggatagaagggtgtgggagatttctcatgaccaatataaggtggctcaatttgagagaggagatttttactgaataaaaaaagtaactagcctgtcatttgcctctagttatatattctattagcaacaaaacagctgctggacattttcgcagcgaagggtagctatgtatccaagcaagttactcagcgtcttccagtcaatcaaatcagccattccaatccctaaggcgagatttaaaaagtacagtactacatttagaaattaaggaacctagagaaaacagcagacaaaataacactgctgtaccccgactttatttgtttaaccatggctatatgaggcacaaagaaagagctggaaataagagggataaaaaatatccacagaaagaattaatatactccctccgtttcatattaaaagtcattcgatttttttttgtcaaaattatttaggtttaactaaatttatagaaaagattagcaacatataacaccaaattagtttcattaaatttaacattgaatatattttgctaatatatttattttgtattaaaaatattagtatatttttctataaatttaatcaaacttaaaaaagattgtgtaaaaaaaaagtcgaacgacttataatatgaataggatggagtagccatgaagctctgcaagaaacctcctacaataggcaactagttggatggaggaaactaagcggtacacttcaatcaatcgccagctaaataattctctaatcccctccttttaggtgagaaaattttgtgcagacaagtcgatttgtttactaaaccctaaaccggaattgtctctcgccatgattggggctgagagcgacgcatgcagaggacagaaatagccattcattcgaagaacatatggagtattgtcgaacactgcacagtgccatatgggttgggatatatatctcgatcaatcaattttcaatccagagtgcacgtccatgcatgcaaaggtgaaaacgtgtaggttttttgcgatcaattcatgtctgaaaagtgaaaagttccagtgacttggagaaggcaaccaattaggacatgttaacaaccttgaagtgaattgcagcgagctagctgctcgtcgttaattacttgtaccgagtaccgaccgatcgatggggatgcaaatctatgttgattaggaattaatacatttttatgggaagtgaaaaggagaggaccgatcgatcgaccaaggtgatccaccgacagtttaaattcttactagatctcaactctggtaattaagaatcttcataaaaaagataaattagtcacaaccttaccttactgttgcctgaactttaacctccaacagtattatttctacgtcagagaatccgtttcctcttatccactttgttatcatttttaactctaccaaattttaatattattaaattttggtaggacaataaaacagtttcctcatgttcactttgttactatttttaactgcaccaaactttaaattat

SEQ ID NO: 103012 - DNA, 1400 bp, Oryza sativa
aaacgaagttgagtttgaacttgagatttggtgagaatgtatttcatatctatacctatctctagtatttttttcatgaatttacaaaacttttaggtatgattttcacgagttttcaacacttagctcattttcaccggatatgtccccaaaaagtatatgttaattattgttgtgaaactaaatatatagaggcagaatggatagtacaaaaaccatgcatggatgcggttgcaccggctgtattatcaggttataacaaatgcacgttacctgtaacactcgagctcaatggaaaaaggttgccaatctaatctaacccaaagtatttttgttgtgtgaaatttaatcaagtaccttctgaccaacagctaaagttctaagcaactcgtctaattcccttaggaccaagctcagttttcagtacttattttttctatttctgaaaactatatatagactactggtacaatattgtgtatttgtactcacgtgagtctgattgaacaattatctcctcacccccaactctagagcagacaaataacaccaaaccatgttatacagtggttaattgacatggtagtgatttttgctgcaattattccttcgtagataacctccactggtgccaattaatcttactagctagctaaatgatatccaaatcatcatgcatagtgtgagtctaagttagtgaaactacagcatattaataaaaccacagtcgaatatattatcgtgttatttgtccgattttaaaagctaatggtgaatagaaattgtgccgaaaataagtggaaggcgagcaggaacttcgccttcctcctgaattaggatttttcaatataatgactgcagtttaaaaccaaaataagcatgaggaccttccttggacaattaattttagtatttccagctccactaaaaacaaccacaaatcgcaaaaccttctaattgatccttgctcccttttgatttggaggaaaaacataggaattttagagaatttcaatcctataggaaaatttcctattaaaccctttgatacaaaggatacaatcctttaacattcatatggaatggacaatcctataaagatttaggaggaaatttaggaagagtttcaaccttttggtaattttccttgagtctatctctctcatccagttcatgtgtttttcctgcggttcagtcaaacggtcattcctgtgttttttctgcgttttgcaatcctctgttttatacttgcattcctttcaaaatcctacatttttcctattcctatattttctcaatctcacgattcaaaggggccctaatagcacacatgaaattatcccaacccacaaaatttgacaatttgactctttgcaaaaactaattttacaaatgaatcg

SEQ ID NO: 103013 - DNA, 1142 bp, Oryza sativa
gtagctatttctagagttcaaatatgctcctacaccatcatggtgggattgcaccatggtgagtgtgtggagtgatcctgaactgttgctttcctttcttttacagtggtaagcctgaatgtaatcaaacaacttctgtcattttgataatgaaatgggggagcaatgcctctctttctcaaaacaagtttctagagttcaaatttgtcccaaaatgttgatattctccacctaccccccatcacaatcatctcccatttattttttcacctactttctcttctcaacaaatcacaaccttccaccattcaatttcacctacttatataattcccatgaaaacctctagaaatgcttacattttgggatggagggagtaatattcaacatggttgtgttgtcttgcatttattgataatgcttcttttgattcttgtcaacatggctctccaaggaaagatgctgtactttatgatttctcttatcattctaccaccatggctgtgtcttttttctaatgatatggattttggggaaaaattgctatattgcattttgcatttgaagagatgcgtgatcaatatgttcttataaaagattctgtagtaggaagggaacttcagtccttcaaaagatgaagaggatcatgcctttctcttgcaattgcttttctggtttaagcaatcattcaggtcattgaaacacttctgtgccttatttctcagtttttattttctgcatgtcatgtgtgtgcgcgcgctaccatctagtacctatatttctgttacatcagtactctacctaaccatttatattataaccaaagtactgttttcagttaagatacttcttttgtgcgtatgttttaattggcatatttttcaccatttatgtaatagtggtatagtgaggttgttcacagactactgatggacatgaaataccaatgatcttgaagatatgtcaaaccgtataaactaagtacaaacacatttgttctattcggactggaaaagaccactttgatatatatatagtcttgaatctagtttctgaaaattagctctatttgaaacattggagtcaaacaaagcagagcatgaatgataaatgacttgtgtgaatgtgtgatatttgcatgt

SEQ ID NO: 103014 - DNA, 1182 bp, Oryza sativa
agagattctagatccctatatgacgcacgaggagccccaagtgtatacagcagaatggttggaggcgtgtattaagccgttgttgcacttggcctgtcatgttccatggttcttggaaagacagacctggaatgcaagatgtctgtgcgaaactttgtgcagtcaaagaaatttttctgcagtttggcgatttcagtttgtgatagaagttctgtaattgcaggcatacatgaactttttaaccaggcagcatgtgagcttattcgtttaaattcataaataaattttcagggaggaacagtaagattttcttgaggcaaagttcactaaattcttatatattttctttgccatgaactagaggatgaatgcattcagtaacctgtaatcagtaccaagttcagttacagttggaaggtgctgtggtttccattagaatgtgctaaatttgggtcattggttagaagctgaaaagtcaggttttagaggaaaacccaaaatgtattagggggtcaatattgttctgggtttcagctcgccggctcctgcagaatcttcatgtcatatggattttgtgtcgtcactaattttaattgacgattttggtcgatgaaaacaaaggttgatcttaactagaaaatgctctgatcagtgatccaatttattttaacaacaacagactgacagagccaactgtcgttgtaacgtctgtttattcttgataatataatcatactcagtaacaaacaatctttcctaactgaactgtagcatgtatggaattatattgtttattgcatgacggtgtgattatcttttctaaattcttaacttcgcatgatcaaccattggaaatgagttgaactggtcagctggagatccagttctttgacgagtctaagctgcagaagttgtcgtactcacaagttctcgcatttttttctcacaagttctccaggacagtccaaacctgggtgctgagacattagagtatgtgttttgttccattcaaactttcaatttttccgtcacatcaaatgtttgatcacacgcatggagcattaaatttggacgaaaaaaaccaaatacgcagtttgcatgtaaattacgagacgaatcttttgagcctaattaagccatgatttgataatgtagtgctacagtaaatatttgctaataaca

SEQ ID NO: 103015 - DNA, 535 bp, Oryza sativa
atacaagtgtatacatatcaattcatgagaatcttggtgatatcattggcaattggatgtctttttcaaaatctttgatttcttcttgatttttgttcggggagaattgaggttattttgagggggagttagtgttttttcataaatccttttggcatgtgttgagggggagtttgtaccttatggttttatcaagcgataatatgacaatgagaaaaattgagaaaagagtgctttgttctatacatatggtattttcttatgcatgctagcaatactttgaaggtttatttgtctctagcatagcttatatgtattctagtctttttatgagatttagattttgcttttaagggagatgatgcatgacacttaaattctttcacttgaattaagaaaatatgcaatgttgatgctagcatatggtttgatctataaatgctctatatatatgctttattgacttgttattcctcaaatagctttaattgctcattgtgaaaaagagaataaaaaaaatgaaaaaaaatgaata

SEQ ID NO: 103016 - DNA, 1914 bp, Oryza sativa
tcttttatttaaactctgttatgttgttctgaatttttgtgtgtgtgtgttagagagcagtgtgccagtgattgctcctgatccttcacgatctaaattttctgtagacatgcatccaaactttcatgtaaagagagagcttatctagacttaaaagaaaagggagagaataaaggatattttttttagaaaactgtaaatttagtaaatttagtgactacaacattagctaactagtatttcaaattgttgtgattgcacacaaaattatcacgaaactgcaacttcgagatcaccctaacattggaatacacttactttcgcttagtcccatctctatcgttgctaatgttgctgacacattgggctcacatgtcatgacggaagttcctgacgtaggcgaaacaacgagacatgtcagtaatatatgaatcaaaaagaatcaaatctcatggccggtttagtaggtaaaaatttttgttttggggagtcacatcggatatacagatacacatttaaagtattaaacgttgtctaataataaaacaaattacagattctgcctggaaaccacgagacgaatttattaagcctaattaatccgtcattagtaaatgtttactgtagcactacattgtcaaatcatgacgcaattaggcttaaaagattcgtctcgtgatttctatgcaaactgtgcaattacggagtagttttttcttttgtctacatttaatgctccatgcatgtgtccgaacattcaatgtgatatttttaggaaaaaaaattttgggaactaaaccaggcctcagagggagtacgagagtgacaattgccactgtgatagctgtgttgggagtcatttcaggtattgcataccacactaagggcctgtttagattccaccctaaaattttacaccctatcacatcgaacactcaaacatctgcatgaagtattaaatataggctaaaaaaataactaattgcacagattgcgactaatttgcaagacgaatattttaagtataattgctccacgatttgacaatgtggtgttacagtaaacatctactaatgacagattaaatatgcttaataaattcgtctcgcggtttactggtggattctataattagtttttttattagtgcccaaacaccccatgcgacaccctatataatatccaatgtgacacgccaaaactttacattcctatctaaacaccccctaaactcaacgtgggcaacaaagccttgtgtatcgttggcctatttttcattgcttggtaatacttcgttgtatttttcacttgcttatcttaggcaggagaaaagaaaaaaaaatcaagacccaatagagcatatgtactagcatttcagaagacggtatggggtaagtagtagcacgagccaaccaccacatgacactgaatttagcaagagtaaataaatggtcgccatcttgcagctagtaatcactgtacaagcaacggcatggagagctaagtactttttgccccttaacaatcgaacattgcttagatgcaactgcaagtatccatcataactgcattacgttagcgaccatgttaccgaaacattctgtccctccaggggaaatataatatgaactagacaaaccgatattcatctgattcatattagggcccctttgaatcaaaggatttatgtaggaattttatatgattcaaatcttataggaaattttcatatttggccctttgattcaaaggattgaagctttccaaatcctatgaaattcctatggaatggcacattgcatgtggattttggaggaaatttagcaagagctccaacctcttgaaaaatttcctttgagtccatctctctcatccgattcctgcgttttcctgtactccaatcaaacgaccatt

SEQ ID NO: 103017 - DNA, 733 bp, Oryza sativa
catcagcttgaaaacttcaggtaagtgatcatcaaacatacttctcgtgattgaacacacacaaagagatctcttgggaaatttaccttggagttggatgactatgacactatgcagcactgatccttgaaggattcacccatcgtttgaaactcttgatgcgatactgaagctagccacgtaactacacactacaagctgactttgttttgacctttgctatccgttcctcatacgaagctgaaacaagaaggcgactcagtttcacttggaagcagataaacaaggaaagaatcaaaactaagcaccgcaccaacatatcatatgtgcacaactgatggcattttataggcaaggctattaacagttgcagcacaataaactaatgacagaaaactaacggtaggactgtcagaatgtcgaagagtaaaccaagaggctggcataaccaaataaaacatttgcttgtccttaggaaaacatattaacaaaaatgtgttggaagtaaagaactatataacaattacttacgttctgtttgtcgtgacattagaggaatatgattcctcttcttgtgacgaggttcaaatggatcaggctctgcaatgacatctcacttttagttcactaaaaatggcataaaactgagaaaggatcttagccttctggaaaaatggaaaaggtttacatgaatgtacctggagaacataaacaggacaatgcggggtgcagg

SEQ ID NO: 103018 - DNA, 575 bp, Oryza sativa
gcagcagaaacagtgcttcgtgtaagcaagtaagcaactgcggcagcatcactgtgttgtagcggctgcaccttgcagccgaacaagcccgatgtatgtgttacagagttcttacaacgagagaaactagagttctgctccagatcatttctttcaatgtctaatcctaagtcatcagactcctccttttatatcttaaggagagataacaattatattcttgcatggacgaggaatggagaggagggctgtgtcaaaggagtcttcctcggcgatatgctcctcccacactcgtgctggttggccagcggatgtcacattggtttttcttttcttttattctttggtggacggattgacttgacgaccagcatctctgttcgtctcccgctacactctattgtaaatgggctatcctcgctacgacgtggaacaaaagaagtagcagcaccatgcaatacgaaacatacgaaggagtgacgcgcgacttccctatgacgttgagagcgtgaccccagacgatctactccctctataagtctataccatgatattgcttagcctgggatggcaat

SEQ ID NO: 103019 - DNA, 655 bp, Oryza sativa
ttactgacaaaggagacctagggtctcgtgtcagaggaactatattctaacctcgagttaataaccaacctgttgatggaaaagaaaaccaattaaactgtgttgggttaaaaagccaatgagacagtagttggggataagagtttgggtacgccttttacatatcaagataaggattgttggatgaaacccataagggtacccgccatgcctctacattgataagttcggatatacctacaaacagttaagaagatccaggagacatcaacatttgaggacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccccgtcaaggtttcactgaaaggcagcaagccaaaggatctcatcgccaccagaagtgtccgcgacccaccttaaagagtaccacctgttagagatagcccgaaagatgattgatcaaggaggttggcaaagaggttctctagcaggaaagatgtaggccgaaaggtgattgata

SEQ ID NO: 103020 - DNA, 630 bp, Oryza sativa
aaatcttagcaccaagtcggcccgttagcatatgctcccatgcgtggacggcccacaattgtgagcaatgagatttgctgggccgaggaaacggcctaaccaacccctgggccatgacgtacacccagtgggttgggttgggttgggttgggtggcactagtaactgcgtgcatgcggcggacactcgtgtgatcgtgtcggtctcgactcagtaccacgccggcatatgctggtcccccgcgcgcgcggcgtacgtgtcccgggcgcgccgcacgccatccacgatcccatcgtcttccgctctctccacctccacgtactcgcgtttcacgtgcaaacgccccccgcgcgacgcgcgccttggagagggagggtcagcgacgtgtggggggggtctcgcctgcatgcgccgcgtcgcgggcgcacatgccgtcgcatgtgggagatcgccgcgccgcaccacgtaggggtgcgtaccggtgtcccaccctccatctgatccgtcgatgactcaaccgcattacgtgttactactaactaactacctcctcgactctcggatcatccaatcttctcgcgcaccaaccaactaaccaaacgccctcgctgcctctccctcatcagtcatc

SEQ ID NO: 103021 - DNA, 718 bp, Oryza sativa
ggggagttactaactttgccccaaaccgtgagccatatatatgtgtatatacagcggcccccaaattacgggctttgcttaacctgatcgcgacgcaaaattttttatccctgtgcagtacttctgggtggaaagatgttgcaacttgcaagcctaaagaacagtattttatgcggttgagtctggggagattaacgacttggtcgggtttgttaattgggtggacatttgaatattgctttaattagcttagcccacaaagaaaagctagagagagataccaggctactcctacataggagtactatagtttatcgtaccatccaagaattaatcaaagaggagatcgacagcaactgtactaacctggtgttgtttattttgatgattatgggttagctatgaccatcatatagttagaccatactacaggaggataaggaagaatctgcagggtgctacgcccagacagatacaaataattaaggtagctaaggtaaagctaaaataagctaggcaaagctcacatgccaaagccacacgtgcaggacacgcccaggatctcgaagtggaaagcaaaccaccaccactccaggcgaccgagacgaatggttaattaatttagtagtacacgatttagaaaaaaactactaatactagggtatttagctggtgtgatagtgctgaggctgctttgttgggtgtgtttaagcagaga

SEQ ID NO: 103022 - DNA, 614 bp, Oryza sativa
attcctgcagcccatcactaaaatgttgatgagctcatttacataaatgagctcatcaaggcgatttactcctccatttaatttaaagcctgcaccgactgttgtaaccctttctgaatatcctgaacatggcttagttcatgtgtttgttgatattgctctgttttagactcatcgttgtaaattcctcaacaatatccaagccttcgtctcctcccacctcaaaactggcattaccataaccttgtcgtgccacatgatctaacgcctcctgataaaaccctgcggccttactctgttcatccatctgtttggctgaactaatcgcatctttcaggtttgtgccatcacgtaaagttagatccacgtaatagatcggggtacgatagctctgagtggtacttttgcctcgcaaggtcaattgcaatggcaaacacgaaagcaagtcacctgaagctgcatggtagtaacttaatcgggctgccaaagtacggatgctattaaagcctgtggttctaaagatgaatgtgccaaattcatccgattcatccaaattcacatagagtctgccatagggtttacagagtcctccttgcgccaatggacataagtca

SEQ ID NO: 103023 - DNA, 1115 bp, Oryza sativa
gtgcccggctggtgccggccggcctctcatcccgccacctcgcgccgggccgccaccggccggcctccatcccaccgctgcttccgttgccgcccgctggaggggaggagaggggaggaggagaggatgagtgggggagaggagagaaggagaggatcctcggcgcgtaagatggcgaggagaaggggatcggaggagaggagaataatagatagggtgtgaggagaggaggagatatttatctcgatctgagtcacgcgtacgcctcgatttctctgcgcatgccgatcttttttcccggttggtgttaccaacctagtcccggttagtatattagaggggtctgacatcacctatccttttttgaaccgggactaaaattgatcacaccaaccgggactaaagatcaaaaagtagctctaaccttttcaaccgagactaaagataatctttagtcccggtttttattgcaaccgggactattgtggaatttggtcgaccgaccaaagatggtttctccaccagtgcgacaaaattcaatcatccgttttcatagaattaaaattctctcaaattaactatgttcttcctataaaataaaggggacctaaagttctcgtcttactctatccatctgcacttactctatccatctcttatttaatgggagacactagagtcttctctggtcgctctaacatcttaacatgcaacaacggaattgctaacattcatttgacaacaagcaatggtggatttctgttgaatcctccactgttagctcagctctgtaggatcaaataaaaaaaacaagtctatcagatgagggtgaatggtagaaacactaaaaaacctaaaagcttttagcggaaataaaagttaaccttaaatttgacgaaattgcaccggtcacaccgctagattgttgcaggtttgaccacagtactcccgtcggtctgagtgcttgcttgccaccggttcaaccaccgtcttgccgccaattggactacctccctgccatcggtgtgaccaccctggttagaccactcaatgaactccgctcaaatcatcaggacctagaaaaacatgtatcgacgaaacttttgaaagtagat

SEQ ID NO: 103024 - DNA, 1796 bp, Oryza sativa
ataggtgttggtttttagctaaccggcacctttgtggccggcacctgtgtaggtttttgtagtagtggttgctcatctgtaacacatagaaattggtggaagctcagggttagaaatgctgtttgacaggatagtatttgcgtaatggtgttttgatcagcggtgagttaggtgctacatttaggccggcacacttttcccaatctctctccctccgcacacacattttcaaactgcaaaactgtgttttttatgcaaaaactttgtatatgaaagttgcttaaaaaatcaaattaatccatttttgcaataaatttagctaatatttaattaatcacgcgctaatgaatcgttccgtttatgcgttgtgttccagttaggaacgaggaatggcgaacatagccttacactattcgttgtttttctgtttgatctttaagtttctgtatcttacaaaaaaagaagagtttacgatggtgtggaaggacttagctgcccaaacatgatagctttgatctgtattgttccaagagttgctaccgattgcaactaattcaggggccatttagcttatatgtatatctgtgctccaactcttcaccatatatggtcaatcagagcatctgagattggcaataacctattttcaaaattttgtttttgggttttctaaatttaatacatagaaagtgaaaatacttatctctctagaagagagcctaaaatgaatttctcaaaaactaaaaagtgggccctgtatcacattaccaacggaatcccgttatcctcctcacgcccaaggcccaacccctgaggtcgatctcccccatgcgctccattccccttccctcgatctgtccctgatgcttatctcatcaccacccccacccccacccaccacaccgtcaccacccgcatctccctctcatcccttggccgcagcaatcaacaatcagtagtaaacaattagcactatcagctcagcaatcaggacgaataatcaacatcagcaattcaagtagcagccataagcaccggttcagctgcatcagaaaacaacagcagcaccagcaacagcaacagaccatgatcaattatcaactccagcagcagaaatcaacatcaacagcagcagccttcaattattatggttaggttgagctcctcctgcttgtgcatgggggtcaggtgggcatgcacctgagctcctctcttgcttactgccaacatgcgcttcctgagccacacgagccgagatgcccactcgccagtgatctcctgccatatttgaggaagatgttgccgacggtggagcagcttgaggcggcggctgacgaggtcacgagaaactatgtggagggaaatatgtttgctaccgcgcaagaacgagtcacgagcagcaggaaagcagcggattgggagcgctctatttgtttagatgaatgaatgaattcagaaattgcatctattacacatagtcgagaaactatgtgtaacactaggtcagcatgcatctatttgtttagatgaatgaatgaattcagaaattacaactcatcttccgtgcagaaagctcatttcggtcattatcaaaaaaaaaaaagaaaaagaagaaagctcatttccgtacaattgtcatattaacctctctaaactctgtgggatagttgagaaattaccgcgccacgtcatcctgattttgcaaaaaaatgttatgtggatctacttgaaagaccagagacaacaaaccactaaactgaaatgcaataattggcccccatgcaaattcatttgat

SEQ ID NO: 103025 - DNA, 514 bp, Oryza sativa
ccccttggctggttaaaggcgcatagatatgcagacagggagtgcagttgcaattcatacctctcctttttacgacctcaaactggagaatcttctcaaaaatgtcagcttaatataaagtcattataattactctctccaatagtccaattccaagagtaaatcattttaaacttttcactcttctataaatattagtagctgcagtaatttgatgcacctgaccctcctcttgtatcccttgctaatttcatggtatcccccattaataaatgaagtatcattttcaaactacaggacaaggtcattcattttcttaattcatgtacccatatctaaaagattaggggattaatatttggcatgggtgtcttaagggaaaaaatagcaagtatactatcaacaaggttaaatatgataaaaggaaaagagagagcatacagcacgcaatttcacgtatatgggatccagattcgatgcttctaggttctttatagcactggtcaaccactca

SEQ ID NO: 103026 - DNA, 1092 bp, Oryza sativa
ttcatcctggtagccaagttgataccgttctatagcgaattggtgcggctgacaaacgcctgtgagatagggctcttcttgtgtgctagcattgatgaaacgcctgtgacagatgcatcgatagaatcctccacacctatatgattctctgttgagtaaattgcgcccgcggtacacaaacttgtaaggtgggtgcaatttagtgtaaaaacttgaaaaactctcttttcggtacacaaacttgcgtagtgcgtgcgaaccaaggccaagacatgacttcatcaccaattttattgagttggcttgtgattaggatgccacattggcgcatacacacgttatgggggcatgagttggctacacatatttgcaaataacccctcatacatcttccaattcctccgaatcttcttttgtgttgtagcccacgatgatgcccatgctagagatcagtttcacgatagcctaccgccaattgagtttgcaacaaaaggagataaatcaggagattgatatttggatcaaggtggaaggccgcgaattggatccaggcggtaggactttgctgggagaaaacacgccggccacgtttagggcagcggtggtaggacgttgccgccggcgctgaggcaacatggtgccagggctgcgaagtgaaggtgcacgatctcctgtatacagtgagtactttagtttatcatggtcaaaaatgagattgtctttctcaattccaatttttgtggagatttcttcctcttattgtcgatttattaggtattgcaaacgagaaggactatcagttgttttaatttatgccaggagctagttcatggtacacaaaagctgtaatttttgttgacatttatggtatagaagtgatcatggcaaatttgtatttttggagagcaatttgatcattaatgtactgctagcttctgttgttaactatgctttcttcctggatatacccttaaacatctgaacctaaagtaaactgttctgaagatgaataattatctgtacacaatatatgtagattccgaagatgaagaattcagcattgagatgcaccacggaggcttttttatggga

SEQ ID NO: 103027 - DNA, 768 bp, Oryza sativa
aaacacacagagagaaataatctataatacaattgcaggcgctcacaacacgcgcacactcacctctataaacatgcacacacacatcctacccctataaatatctcctaaagactgggccgacatatcttgtgatcgacgaaatcactacgagcgtctcgttgccaacggatatgtcagcattgatggaataattagccgtaaatgtgagctcccgtgtcaagtctaagacttgaatccgggtgggtatgttccatcataaggaacataaccagttaagctacactcacttcacaataatattggatattaaaacaaccataatttttaagctacatttttggaatactactatgccttttaaactggtggaaccattattatttctaaccgttatctatgttatataataaacaagcgtgtattcatgggacatcacgtttcaaaaatattactgcacaactatatttcgtcattatcgtattcatgttaggttgtgtgagcctctggcccattctaaatgaaaatgttcatggatggatcacctctcaaactacatcaatcatattaggttatataaacccatacatttagtgaagcctcatgtctcacccaattcatcctctaataaaccatgataatatatgcaattaaagaaaagaaaaacacattacttttactttcgttgacatattttctaaagaaaataagattatattcttttcaaaagatgaagaatattataaataattgcttatatatattatt

SEQ ID NO: 103028 - DNA, 785 bp, Oryza sativa
gactataataaagttaaatatctacttatttttatatattagactaaaaattatagttaaagatatattttgaagactataacgttgtctgaaacatcatagagccagagcgaatagtacctctgatatgggcactttattaaaaaatatgaagattggaagttatcctgaagtcgtgatatatcatagttgtcattgttaaaaaaaaagttaagaattgtagactgggtgaatagtatctcgtatatctgacactgccattgaaaagatgaatatttgaacttatcctgaagtcgtgatattatatcatagttcttcaacagattgatcgagtgattggtacctaaaacaatttccttttgttaaagcaatgccaacggctgacaaatctaccaaaatccgctggtaggaaatttgccgtatctgcataacatttaatttttaatatttaatacatccctataggcaattatttgtgcaaaagacatgtcaaacaaattaagcgtagattaaaagcaacgtattttcctaaaatatattaatgtaaatataaaatatatgatacatatataaagtagtttttatgataaatataatagtaattttgacttatgataatttcataatggagggagtaatttttttagaacatcacttatagttgggtttattttattttttatcatcatagatctaatttgattattatgaagtgatacactatggtaaaatctactactataccattattattttcatacttttttataattgcttgaatgtgt

SEQ ID NO: 103029 - DNA, 2891 bp, Oryza sativa
tccgcccgccggcgcgccgccgcgagtccgccggccgcccgatgggatgatggggagggaaggagaggagttagaggagaagttagagaggagaaagaggaagggatgatgggggagggaaggagaggagttagaggagaggaggaggaggaacaggaagagatgggatgaagagataaggtcagtggaggaagaggtgaagagataaggctgcccgtctcctcctccttgatctcgcagatggcaggtgcctcgtactctccgccacgatcttttgttttggttggtattaccaaccgggacttaaaaatagatctttagtcccggttggtgaaaccaaccgggactaaagatagtgggcatcttttttcccggttggtgttaccaaccgggactagaaatagatcacaccaactgggactaaagattaaaaagcagctctaaacttttaaaccgggactaaagataatctttaatcctggtttttattgcaaccgggactattgtggattttggctaaccgagtaaagatggtttctccaccagtgtcatgaatcctggaaggaatgcttgggatgaggagattgtcaaggtagcttacaacgatgatattgcaacagaagttttgctggttcctatatgccgtcatgggggagaggattttgtttcttggccacatgacaagaggggttgtttattgttcgctctgcttacaacttagtgacatcaaatttatttgtggtggcccagagctccaatgggagaggataacactgcagcgaatgtggactcgctgtttaggaaggcacgttggaaaatcaatgcaccgggtaaaatgttgatacatctatggaggtcagtacatgattgtcttcctacagggttccaactcaggagacgccatgttcctgctatggagggatgcatcttttgtggtcatgatgatagaattgagcatgtcttccttgtttgcccctatgctgcaactgtttggaaagccatcaaggagaagtttcagattaacttgtgcatacgagaattatgcaatacgaggcaatgggtgtttgatttcctaacccgtagctctctcattcagaagacagtcctggctgttactccgtgacacatatgggaagcgggaaatttttctaggaacaaccctgttacttcccacccgtgtcaagtgattcacaaaattgtgtcgtatgtagatatgaatgtgcagtactgctccaaggaaaggaatgcctctggtgtgatctctctcccttccagttacaaagtgcaaaccaccgccagcaagcatggtagtactacttaactcagatgctgcactcttccagcttctaatcagacgggtttggcctttgtaattcgagatcagagtgcctcctgcctgcttgctgcaaacaagaggataaccggattgctctctccagaactaactgaagctttggcgatccgtttcgccttggaacatgcaaaggcggaaggtttccagcaagtgttgatggcctccgattgcctttcagttatcaagagaataggcacgagatcgttcaagtgtcagcgttgttgtccgtgatatcaagaatttggagactgagttcctggaatgctcctttattcatgtcaatcatttaaccaatgttgcagctcataccgtagctcgttgttccgaatctgctacatgtaatatttttcgttctgtaatccaggatcatattcgggaggtacttaatgctgatgcaatttaatcgatgaggtgctgcctttgtctcaaaaaaaaattgctcaagaggctagccttttgcacggtgggcatgtacaagctactcctgtggttcctatgttaatttccaggtcacagcacaattctgatcgatatatcggtatatatacagctcctatgtaccaattgaatgcagataaggcaaattgaattgattgcagtgctcaccgtctgtaattgaaactcaatgttctgaaagatcatgccacttaggggtggacaaaaagtttgggctcgtgagctcggctcaagcttggttcgggctcacatagctcggctcggcacgaaagccaaacaagccaagccgaagcttcctagctcgtttccgaaacgagccaagaccgagctagctcacgagccattagcgagctcgtttggctcagtatattagggtcatatacaaaaattttgcaagttttctaactatttatttattgaaaaaacaattttgattatcatattatctatttatgtgttgtgatgatatattaaagaaaaatattactttattacacattctatgtagaaaattgttgatcgatttctcttacacctacttgagatttacttgataccaggctcgcgagccagctcgagcccattaacgagccgagccaagctgcatttttagctcattgtttgtagtgagccaagccaagccgagctttcttttcaccaagctttcacaagtcgagccaagtcggcttgtttccacccctaatgccacttaatatattacaaaaagtgatcttggaaaagcagcaactttaataactgaaacaatcaatcaatacaattacagtacttgatcaatggggtggatgtatatatgcatcgatcgtgcacgcactatttgttgcccaacaacgtagtgataactgatttctctatctgtcactagttttcttatcaagaggacaaagaaaataattagtgccacctacagcctacaacctttaagtttaatttttcacttaaatgatcgttgattattcattcctatgttcacatcattgattagttggccatcaaattaacagtttaaagaagaactagtagacgaggtgagctcaactggtgatatagaaggcgacactga

SEQ ID NO: 103030 - DNA, 1835 bp, Oryza sativa
gagggtgtttctgcggagctaccctctccagtgggactgggcgtcgccggcgccgggggagaaggagaagcagcagcagcagcagcaggtgcagggcgtcgtcgccggcggcgacggggaggaggatgacgatgagtacggcggaggaggaggagacgagcgcggcgggaggaggtggcggcggcaggtggcggtggcggtggtggagtggggggaggagaagctgctcctgctccggcgggtcaagaagaggctggcgctctacctcatcggctgccactacgccggccaccgcgccgcgctgccgttcaagtctcctccgctctcctgcaccgccgccatgctcgcccctcccgctgatcgatcgatcggccgcgccatggcggacatgcccatacccaccagctagctttgcaatcatcggtcggtcgatctacacaggttaatttcgccatagctttcgaatctccacgtacggtgctctgattatgtgcatcgaggatatgcatgaggattcatcggtaggccagtgaacatctcaacatggcctgtctgtacgtgtatgttagtacaggtaattaattaatgtaataagaagttcagagcttgtaatgggtgctggttgtgtacatgtaaattcttcaggacaaatctttaacatagggagttggggattttgtatgtatgatgttgaattgcaacaggaaacgttgcagacagattaataggtgaaaatctagctttagatacttttgtgttaagaaacgtgaaaagttctttttttgagttttgagcatggcctgtctgtttgtgtatgttactacaggtaattaatgtaacaagaagttcagagcttgtaatggtgctggttgtgtacatgtaaattcttcaggaaatgttgccatagaaagttggggattttgtatatggtagtattgaattgcaacaggaaatgttgcagacagattaataggtgaaaattaagctatagctttagatacttttgtgtaaagaaatgtcaaaagttcttttgagttttgagcatactctgtaagagagaaaaaaagtggttttgagcaacttttacataataataaagtcggggacgggacatgtattggagagtctttgtataaatcaagtacgttgctatttctttttccggttgactgctaggacacttgaatccgtgcggtaccatatggtggccgttgatctggcttcatcggagggctaggaacgtttagtaccgcctggcaccgcatgccctgactgaggaggtaccgtgggtgggagggtagcttcgtactttcgcgttcgcatctctttcgcactgcatgctgtctcgggagaagtttcactcggcaagaaccgtatatccccgtagcatggttaggattggatcccggtcgcctgaaatcgattgggagctcgctgcaattttacatagtgcttgtttagtttctaactttttcttcaaacttataacttttctatcacatcaaaacttccctacacacgtaaacttccaactttttttttcaaactttcaattttaatcaaacttccaattttaatgtggaactaaacacagccataggatgatctgggtatgcacagaaagagagttctagtggttcaaagtgacacaaagataatatctagtccaaagaaaaatattggttaaaagtggcacaaactaaaatttaagtaataaaagatggaccaaactattattgtcctagttcctacagtgtataactattgaactgcaagaaacaatgttgtggatattaattagtaggtgaaaagccagtataacatgctgttcttaa

SEQ ID NO: 103031 - DNA, 2280 bp, Oryza sativa
cttttaagagtgtcatcccaaaagttactctgtgtagtgtcctacagctaattaaaaccgtgaagtcacgatgtcctgtagcaaaatttgcctatttggttttgttacacagaggatctccttatcttcacaatgttcagctcatgttttatgaagggagcaatatttttcaactccaagcattttcttcacatatcaacgcacgggtatattcctatagttctctcatttttttaggcttatctacttagaaatatatatcccacaaatataaagaagattaatggacaagaacaacacgactttgatcaaacttcaaacacccactatcatccgtcatccgtgcaacgcacgggcattatgctagtataattaaaaaatacacaaggtttccgtaaaaaaaattcgtccgtctttttttttctttttcgctgtttttttccttttttttttggtcagttttccttttttttcactccgtcgtaaaaaaacggctgcgaaaaaaactgatcagacgggaaaaaccgcgtgaaaaaaaccggggaaaaaatccgcgtgcagaaaagacgaaaaaacaaatcggatggagaaaaccggtaaaaaaaccgcgtattgggcttttttttatttccgtccttttcaccctttttcttttttcttttttttctgtttttttgtccatctttttttctgctttttttcatctgcttttcacttttttttctgggccttttttccaggctctttcatatgttttttcttcgttgttgtttttaagttgcatttttccgcacgcagtaaggatttgtgccatgcttttttcatcgcgcggccgaacactagcgttgccgcaacgttgatctacctctccatgtgttccctcctccaattgattgccaaaaatcaattccccattactcctcaccattttccttacgattttcccttttaactccgctttaattcattgaatttaatcgccttttaaaaattatcatttttatcctgagtttttgtcgctcctattttaataaaaatgaaaaggggaactagtgtatcaaaaaccctcaaccaattttaaagattgagaaagatttgactggatttgatgcggaggatttgaccagatttgatggggaggatcgaggacctacagctccacttgaagaaggaatgaaatgagcttttggtccaaaaccaaaaagtaaatgtatagcattccaaaaatatttctactcgttgcaacgcatgggcattttttctatatatataaaaaattagtgggtaagtcacggattgattcactggttacttattaatttgacctataagtgaattcacgggttgactcacttacatcttacatccctaggtgcagcaagccgagccatgacgcgggaactcatcggttacttatttgacatataaatgaatttgcgggtcagcccacttgaattccttttactgtctctaacatcctgcaggccgcatggacttagcaaacttccacaaagagtatacttcacggcgcgatcaaagctcttctgtccacatttcttcacagtatgtgacgatgtggaatagaagctacccgtttaagaaatcctggtgcctccatctcctagcacagtgaactgctttaatttttgcctcatgacctacctctcggattatttttgcccattccctcatacctctatctcagatatatttggcgagttttgtacgtatcatggtttctcagatttcaaccgtacgttggcaatttgactttttatttcgttatctctcgttttttctttgagctacccctagagttcctggaactagcaactatctaggcttaatttggttgtagcctccatggagactacagaagaagatgcttgatatttatcaccaggacaacacggtaaggatatgagcgcgttgaacaatgaatagcgatctgaccgagccatccaccaactgtccttcagaagtagcttgcgtaggtaaagttgttgttactatgtactcctatagtaatgttagtacaaaattagaacatatttggatctagcatacataattcccaccataattaaaatataaaaatatcaagggggtttgaggtctggagttaatctccctccaaccacttttatatgggattaagcgaacaaacccttactaggatatacggagagagatattggacgaaagatatatggacgatcaatttttacatttaccaccaagattttgattgccatggtataaagtttatcatcctgtctg

SEQ ID NO: 103032 - DNA, 590 bp, Oryza sativa
ttggttgatttggcgaaagagataccgcaccatggctgggtagctatgtcctgcacggaagaagaattaacattcctccatatttctgctgacgggtggggcctatctagccagctacatgcatgcgattcgccgaaatgtgggtctcgctgttggcgctatcctctgacctctcctgccggcttaatattcaagtcgtgtatcatgaactgtattttcacattagacaatctatgtaatttgttgcattttctagccatcaacccatgcatctgaatgtgctatatattttaaacaattaatataactgggatatatatattaatacggatattataagtataaaaacatgaaaaagaatattatatttagggagaatagctaatatggtccctaaagtttcgctcctgggttattttagtccttaatctttcatattgtccaaacaagtcctttaaatttgtcatgtgggctaatatagtccttggtccaaccaaaatcatcacatgggcatgccatgtcaccttcctacgcaaaatctatatgatttgtccaatttacccttacgcataggaaaataaaaaacaaaa

SEQ ID NO: 103033 - DNA, 2306 bp, Oryza sativa
gtaataaccctaatccagtttatatagattcactactaagaaaaccatctttcgtggcggccgttttaggttttcgctggcggaatttggagccactacaaagcaaaggccaacgaagatcaagatcttgggataattcattttcgctggcggctgtgttaaatcgaccgccagcgaaaatcaaacccatgcagctgccctagccgttagcgaagaggaaatttgaaaagcaaaaatgaatatgcccacaggtgtgaagaggaaatttgaaaataaaatatgtccacagaccaaacatcatttacacagatcgaaacatgtgcatcatctagaataacatgcacaaaaaaaaattcacatctagcagcacggtcggagaggagggagccgggtagcacagtcgacagtgtcaagctcagtgccggcctccccgtggtctggcggcggcggatccgccctccccgcccatgcccgagctcgttgccgccttcgcgagcgcactgctctgtcgcccgcgcctgtggatttggagggagagagggtttggagggagaaagggagtggagggaggaggaggagataggataaggacgaagcggagagaacagggttttcgctggtgcgggggcggtgcttttatagcatcaaattttatttcgctgacggtgttgttaccgccagggaaaatcggatgccaatgaaaacccgattttttatggcggacctcttagaaccaccgccagcgaaaatagagcttttttttggcgggcctcttagcgtggccgccagcgaaaactgattttcgctagcggtccgtaacccctcacccttcgttacatttttagtggcgttttttttgcatatgaccgccagcaaaaattatagggcgacgccataaaaatcattttttatactaataatggatggaaatagcaaaaggagtacaatagaaaacaagaagattgaactaacccaccgactagaagttgtcgagaatggcctgacaagatttattcgacgaatatggctctagctccctccagattgcttctccttgcgattctggctacggcttgtaactcgatacccctacctgaactagggggccgtatttataacatatattatcttcctttccaagtagaacttaaagatataaaacaaggtacaaccccaaggagaccttatctttcctaaataggaatctaacaccttctattccgggaagatgatttctttatttatttactgtattttcttaagtaaagaataccttcttgtatacaatcggtatatggtattagcgtgttccatgaattcatgtataggaggtataccttattcttgacactgaccattagaaaacctataattgaggagtcgaactgagtataactatgttgtatttattagttgagtgaagtgcaccaacggtccctaaacttgtgcgggtgtgtcatctaggtccctgaactctcaaaatgcatttttgggtccccgaacttgtcttgtgtgtcatataggtccatccgatgacgtggcatgccacagtgacgcctacgtgtcggtgaggaccccacatgtcagtcatatgtataaaaataaaattaaaaaccatattttctcctctctacctccgcgtcgaactccaccgcctccgctcaccggcatgcgcgtggcggcctacatgcgtaggctccgccggctccgccacactggcctcctcgccgcgggcgaagccgcacccgcctcgcccggccgggcagcctcagccgctctccgcgtcgagctctgccgcctccgcctccgcgccgcaagcgatgccgcactcgcctcgcccgaggccgcttcctcggcaccctccgcgccgcaagcgacgtcgcggcttctgttcaattagcccacatagttatggttgcatgcacgggcggcatgcattggattcccatgctgtgtgcatatgtagcatgcatgggcgcatgctacgcgtatggcggctagctccgcctagcactccgctggcttcagccgagtaacccgcatgccgctccacgacctccactctcgcctctcgcgatggccaacgccgtttcgccttagcttgagctccggctcgccgcaagcgccgtggagggaccacctccgcgcgggccacggcgtcacctccgcgtcggcaagcggctccgtcgcctccgcggccacgcgcgactctgccaacgccgaggggctccggccatcgtggttgtccgtctcggcgttgagccacggctccgtcacctccgcggccacgcccaactcctatgctg

SEQ ID NO: 103034 - DNA, 1612 bp, Oryza sativa
atgcgtacggtgtgagccccgaaaaatggacgacaaaagttgaaatcaaagtgaagaatgtttctgaacatgcaaaccatccatcaaagatggagactttggtgtcatctttctgcgatccacaggcctataggtttgacgcggcgaaaaatgaacattatgtttgtggttttgcaaaaagcgttgaatcaatcccaaggtctatatatctgaaactaaagtatgaaacagtcgatgtagtttgcatgaaatcgtttctggtaaacctggaggctcgcttgtacacagaggcagagggtgatattggtgctgaaggtaagatcaatgttatgccggaaagctagtgtgtggctaggtgaggctcatttgtgttttcttgtgtttctaaaacttatggatgaatgctgcagaaccagatcctgagatgtatgaggatccagatgtggtaagggaagcatttgaaatgcaagctaggcttcaacgtatcgcaggtagtattggttattttctttggttagtcgatcaatacatgaacacagaaaaattctgaccgccataccatctattgtctatgcatgtataagatggtgatgaaagcagcagctcagcaggaagctctttaggcatgagcgttgattctgattggagcctgaaatacagcggtcgttgaagaggggaagcatgctggtggcaagaaggtgtaaacgtatgaaatgagcagggatgaatgtgttagtaaactgtagggattatatcgtatggtgtatgctcctagtgtgttagctctgcgttgaatggtgacctgtacgctgtaggaaccatgtagtaggttcttggactgggttgtattatgtgcatggatgcgctagacagctagaaaacacatctgaatattatgtgggtattgccagctagttatctttggctgagagcgttgatgagctagattgttgttatggctggtggtaacctctctgttgacgctgggagaaccaacatagctatagcgtgaaatgggggacaatgtagcagctattgcagcagcgctgagaatggcggagacgacgagcgtagcgtgcgctgctgcataatggatgcggcagttgtcataggctgcagaaacagagctaaggaagatggctctacggctatcataccaatccgagagagaaattaagcgcaacatgtggcgcaagatgacctgctgatgatcccaacatgtaaacacatcatatagcataggtgtgagtggtaggggaacattgcatattacacaagagtgccatgttctggagtaacagtggattttcaaggtccaaagatagatatagacgaacagaaaaacgactgcaggaaacaaagactacttatgcaaattgataaggaagaggtcttgaacaaaaggcctggctagcagaggagtacatccgctggtgcaaacgatattgtagggggaaacaaaagtagcagcatactttttctttgattcactgcaaaaagaacagaggaaagggtatgtcagctgcattgagcgaagcatgtatacttatctgtggggaagcgagatgactacccaagtaattaccttgttgtcgcccttgctggggctatc

SEQ ID NO: 103035 - DNA, 1260 bp, Oryza sativa
agtacggggcacaatgcagcaggaaaatggcttactgaatgaaaagtatgaacataaattcatatcatgccaaaagcatatattcaagcctagctttcattaaaatacaaaagtactttcctctagaaaaacacgaaagtccttggatataacaatacacgtgcggtgtgtgtgaattaacatggtagatgtcatatcaattaactcatgtgtaatgtgttgcgatttaaaaaagccacttctgcatggttgaagcttttgtgatcttatatgcaaagagaaaggtaaaatgaaaatatcaaccttgctcacattattcatgtttgtgttgatcctttttctgagtgtattttaatttgatctttgtgtcaggttataggaaacaccatacctcttatgaacagttatgctacagaagtcctttttgggaatttaggttcaatcacacttggaattaatatggaaatttattttgctataaaatatgaacattgcggccacaaagagtgttaattttcttccagttgattaaaggaaattctccatgaacccaagtttaaccactttgttcctttgctatagggtacaattctttaatttactaggtgaaaccccgcgcattgttgcggaaatttagtatgataacaataaaaaaataacgtgtaagatagctaaataacatcagattaagtaaattaatgtgatttatgataatttaaatttaaatagtatgcagaatggtgattcaaacgtaaaaggtaaggtggtatgactttatggaagaagaaaagtagggagatagtttggaccatagattaatcatctaaattgtaaaaacaattgatgtgatatgacttaattagaggaaaaactgaaaaatataattcgaaccatagattaatcatttaagcactaactaagtgaggatgagctatataagtttataggatatcataaaacataataaagatatacattggaacattatgtaaattatgttggataataatttaacatgtttgtatttgaaaagctcttaaattataaaaactataaagatatagcatgtttgcttgatgtttaaatgtgatgattgttagtggatgatgatgtaccatcttgttagtggatgataatgtggcatctttgcatgttaagcttaaggagttagttggggataactttatagtaagataggattagtgtacagtgaatgatactgtgtaaatgtttcatctttacatgagggctgcaggaatt

SEQ ID NO: 103036 - DNA, 1226 bp, Oryza sativa
atttttacaaattgaccataactagtggcgtctgcaaaaaatcgagctgcattttcacagacggctcctttaagacgcccatatggaaaaatcgattttcccatacgagcctcttaagaggtccgctcatttttgtcggacgaagaaatgatcaaacctaaactgtacgtgtgcgcggtgaagggccaccagctgactccacagctttttcaaaaacaatgttcaatttttttctcaaatttaaattagttgataattcgttcattagagggttattttcgttacacgcattttggacccatgtaaacttcatcttcattaaaaaaagtatgattgtactgtattacagtacttccaactattcaaattacactactacaaaagtgatttttctatacgaaaccccttgatttttacaaattgaccataactagtggcgtctgcaaaaaatcgagctgcattttcatagacggctcctttaagacgcccatatggaaaaatcgattttcccatacgagcctcttaagaggtccgctcatttttgcatacggctcacttaaacgcccgcatggaaaaatcgatttttccatgcgggcgtttcaaggagccgtatgagaaaataaaatacgaaaaatttcaagcagtgtgtctcactcatatgaacactaaattggatgattttttttcctaaatgtttctaaaatcatgctctatcatattattgtgttcttagtgctattattttgaccattttttcttgtgactttgttttatcaattaaaaatttgaatttctaaatttcaaataatattttgaagcagtaaatgatttcagttgaaaaagtcatcaacaacaaagttgtgtaactcatcaagatctataacttttactttggtcatttcttcatcagacaaagtgatagtaacatttttacaaaatttacatctcttttatagtttatgaaactatataagggatatgtacattttgtgaacaatcttacaaatcactttgtcggacgaagaaatgatcaaaatagaacttatagatcctgatgagttatataactttgttgttgatgacttttttaattaaaatcatttagtatttgaaaatattgttggaagttgtcataatttgaaattaaattcaaactgttcaaataaagtcatatagaaaatgaccaaaacaaaagttgaagatcttgataagttatacaactttgt

SEQ ID NO: 103037 - DNA, 1976 bp, Oryza sativa
catcatccgcggcctcctgcttgcggccgccggcgtcaagggagtggagagagaatctgctgccgccgtcgctgcttcggactgagattgctcccccagcggaagcgtcgccgcctgcgctcccggccggccacatacggcactgccgcctccgctccgcatctcccggccacatccgccggcgtcttcttccttctcggcgaggagcgaatcagccgtcgccaccctgtgtccgaggctgccatctgctattgacgtcatcgaggttgccgtcgctagccgtcgccaccccgtgcccccgcctgcgccgatttgccgccccgcgtccgccacccagttgacgctattttctctgcttgtgtcgtgtgtgtgtgtggctagtttggagtttggatcaatttaaggtggttacttgtttttgatcgttctttttgcgaaaatgctcacacccgaacgactggcggggcagagaaaaatcggacgttgttttttgcctgccactgcagcatgcaaagaatcttttcttttcttatttcttcaaaagattttttttatcgtaaactatttatctaatctacgatataattgcaccactaaattcgttacaattaaatctttacaataagaccacacatgattatatttcaacaaaaaatattttagtttttttattgtttttttaatgttgcatgtggtctcttttgatgtttcaaccagtagttttacaatgttgcagctagtgtactcatgatgtttcactatgtatggatcaaatattgcagtggaacacgctgttgcaacaaatcacccatatattttggaaaccctctattaagagaatttggtttattttttgttccaccaaaaatgtttcacctagtgtactcataatgttccactatgtatagatctaatgttgtagtgaactaaaatatttcattgcaacaaaaaacccacatattttggaaacctcctaagggaattcgtttcgttttttgtttcacctagtgtacttataatgtttcactatgtataaatctaatgttgcaatgaactgaaacattctttcgctatttgctgaatcattgtttttatataaggtgaaacaacacccgatttaaatgagtgaaacattttcgatctacttagcgaaacaattccgatatacctggtggaacatcgtgcaacatttaaaaataattcaataataagctattttttttcatcggaatatatccatgtgtggtcttgttttgaaggtttaattgcaacgaatttaatggtataatcggatcatgatttggataagtaatttaaaagaaaaattagtttaaaagtagttttgcacgtaaatcgggtgccgacgtcatgctaacgtcaacgtctgatttttcccagaagcatcggtcgtccgacgcgtaggcccttccttcttgttgtagttgattgctggaagattcaagatttttgtgtgtataaattgtagtgctcttatcgttcttgccatggagaagttggtacccattttttatgcttgtttttctcggcggccatggagaagcggagaggggattctgcttgtgttgtgtgtgtgttggcatgtggccatggagaagtgattgggaggaagaagaaagggaggaatgagtgagaagcggagaggggattctgcttgtattgtgtgtgtgttggcatgtggccatggagaagtgattgggaggaagaagaaagggaggaatgagtgagagactgacatgtgggtcccactatcatagacttttaacggagagtatagatggagaggctgttggaatgaataacgagtttgacttgctaaattagttggagagctagctatatggatatttggagagttgaatttggccattctattagaaatgctcttagtagatcaaacttaactgatgtagcacaaagtatgaaaagaaacataatatctcgacactcaagccttt

SEQ ID NO: 103038 - DNA, 3006 bp, Oryza sativa
gaatagtgtacacacttgcttatagaaaatggtatactctatataattctaactgaatcaagtagttttgagacaagatcagaagaaaatatactagagcatggactagcaatttgtacaaaaaaaaaagatgtatgtagccatgaatagcaggagttagaaaatgatggtacatttcagaccgtgtctacaatctgaaccaactaaccagacctaagcaagcaaacatttcagaacatttttcagtccaacaaatatgaagcttcacctagcgcaaatcagatctaggtgcactaacagatgcatttagcaatagttgtgcaagctagtacagatatttcagaacatattgatacttgtcactgtgtaccttattcaacgaatcaaacagcatatttctttctcctcactgccactatgcttgtgggtgtgtgaggcggacaactcccagtgtgtgcgacagcaggcgtcgctctcagactctgggctggtgttcttgtcaaagacctcgagggcgatgttagcaaccttcttcactagaatcaaacaacagtagttctcaatacaacttggaagtgtttgactagaacaaggtttaataagaatggggatacaagctaatagaagagactggattgtcctagtagctgtagtagaggtagtagcaagagaggtagtagaggaagagaggaagatcgacaaggttcagcctgaaccaagttgtcgccgccgccgccgtggccgaacccgccgatgcatgtttgatctctgtactgttcgatccttgaagtccttgtactgctgccttttgtattcctcatccattgcttgattgggccttggcatggatcagcaattgagtcagcccatgtgcagcccaatgggttcctgacaggcgacgaagccgccgccgcagggaggtgctgccactgtggctgcgcctgcgacgagaaagacgatgcacctagaagccccaagctaacagtgagaagctgcagctagtactagtctctcatcctcatcatcacgcacgccggcaagcaggtgcgccatcactcatgccggcgagcaggtgcgccatcactcacagagcttctcgcatcaaccttaggtttgggaggaatgggggaaccagggaatggggattttggattggagctatggaggggatggacagggaggagaaaggatgggaattttagcctacaagcggggtaacgtacaaaatgcactgcggaggcggggagtaaactgcaaaatatattggctaggaagaacgaatgatctggatcgaacatttcgaatcggacggcccacaatcgaggccttgttgtttcacttagacatggggttccccacccgacactttccccatatattgtgcggtagtagcacatcggcttcagtatggaccaccaccagaccagtgctttatactataacttagacttttaagataaaccctagcttacgaacctgacacgtatatgtacaggttcgtagttaggattggggttttttttttatggagggggcatctattatgaaaatatttctcatggtggtcataaaaagataaagcttgtaatggtaacatatatgaatatatagaaatttaacgtcatgggatgatttaagttaaagaaaatatattataatatgctatagaaaaaaataattttattattagtaactgatttgcttatttaatattcaatttgtttgaagcaaatattttactatcctataatatcaagaaatattaataaattaaaagcaatagtggagtgcaaatttactttcaccacactactgaagcattttggaggaccatagataagaaaatgaatgtgaagtattatttgtcctattaatcacttcttatattttatttctatcttactctcaaccacccacccacctctaacaccattcattatgtaatggcatcacgagagtccgcctaaaaccttaatctatattaacaatatatatagaacttattttgaaacgaagggagtattaaaaagcttaccgtactactttcatgttgcaacacaatagtgtaatatgagaaggggtcaaactagaaattgaaaagagagttttaaatctagaagatctaatctgacgcgcctcaaatcacctctccttgctttgcttccttacaacttgctatcggctaccattgttcgcttgtagcccagctcgaactaccttgctttgcaacgctgcttgctgtgatcagggtcacaatttcggaacaaaatttttaaaatttctgaaattttggttctatcggaccccccgatacgatattattttggcccaaatttttattttttttccattaatcatgaatttggtattattttgttcacatttgatcaaattttattcaattttttttcggaaatttcggtatttcgaccaccactggtacaaaacactaaacctggttgttgtcgatgttgtccgccaatagccgccgctggccgcatgcgcccctgcaggtttgccgtccgtcgccgatcgattgatcgcctgacgtttgagagagccaggtgaccagggagtgcagatcctctgcagtactactggtgcagtagcagtggttgatgtgtaggccctgcagaggatccttgttggtgaccaggaagtcaggaaccctaggcagttacgatcgcgagaggcggactgtggagagggagtggaaaggtgacgcgacccttccttttatgatttcaaggctaggatttatagttttttttcttcttttcttattcttaccgtacacgcctacttggtccttgggctgggaaatttttgggttctccgggcatcaattaggcctggtttagttccccaattttttttcaaaaaacatcacatggaatctttgacatatgcatggagcattaaaatatagtttaaaaaaattaattgcacagttgaggggaaatcgcgagacgaatcttttgagcctaattagtccatgattagcaa

SEQ ID NO: 103039 - DNA, 2664 bp, Oryza sativa
ccgttttctaattaacccgattttggcccatttattatttaaatttgattctttaattcccaaattttgcataaatgaagtatactcaatttttgtgccattccaatccatagattcattctagattaatttattccatgttttatatattattattgtaatttacttgaatttaattagagttaattctcattccattgtttttttttaaatttgatggatataaatatggtcataataataatattttactcatttctatcctcaccaaatcttattttaaattgcactttaattatttactttgtcaatttactttttagggtttattcctaactaattatccattattcgcgatttataaactccgaaatcaaaatccaataaaataatcgaataaaatcggcatgatgcaaaaagttttttgaaggcccatatttttggaaattttgatttttgttggtcgaattttcagggtgttacaccagtgcaggacgacctgctctcccgaacgccggtgagttgagacattgacgtgtaaccgaaccggacaaaccggacaagtcacaaaaaccttattgccgccttctcccagtgtaggacgacctgctctcccgatcgccggtgagttgagacattgacgtgtaaccgaaccggacaagtcgcgcgtaacttatccggactcctcggaatgtttccaaaacaaggcgaggcaagtgagcgcgtgcttgtgttccccctcttctctccatctcacatgattcaagtggctagaagggtatcctcccttttaaggaggtctccctctcctaaaataaacaaggtggtactaaactccccatgcatgccatcctatgaggttgtcttttgtgacttttcaaagaattaatcttcaaatgggctaaagcctatctattaattccaacacctacatcctaggctatgacccatgtgaaacctgtaatgttaacacataggcttattgccagaaagggaaaaacaaaaactttgatgaaaatttcttttattgtcagaaagggaggatattaatttggttcatatctctctctataacttgcactaattttgcaacactgttatatatatctctctatatattaattaatggaagttaatttgctcctgtctgatgatatgaactctttgaaattaatttttttaggcatgtatttaattagaataacagtgtcgaataatagataataacaaaatgtcagaacaaatatgttcataaaatcatgtgttttagaaaatttcagtgtggagtttagctttaaaactctttctttttttacggttaaaaactctttcgaaaacctttttcttgttgctgttaaaaaaaaaaggatatttgctgagtcaaccactgctgccaaactgcagaacaattgttgtgaattatgactccaaaggaaagaagattattcttggacaaaggaaggcacagcgggttttgtgaactgaccggcagcaattcaagggggaaggggtttcatgtaaaagtgttaatgttgacaaatttattcagctgcaaagcacatcaatctatactctaattatttgtgcattctactctatcttcctgatcacataaagatttagaatgattaacagtgggaaaaagcaataataatgaataacatatatacatgatgatcatttagatcaatcgaataatggccagcttcaccatgttcttcattcacttactggacttcttcagcctgactttgatcacctgttcttcggcatgcttgctatatagacttcttcatcttgcacagaagcttgctaaggtcaggtactcaggtacgacctcttcctctcagggttcaattttccgttttcagcatttactagcaaaatgcccgtgtgttgcaccgggtattagcggggtgactgaagtttgatattaatgatttaccaaaacaccatagtataattattagcatcggttatatgtacagtgataaaaaaaagccatgtttgttttttactattaatctcaatctctactacatcatccgtgtatgagtcagtttttctaagttcgttcgttttttaaaatacaacaaggactcctaattgcacgtcataattttctaaaaacgtccaataaacgaccaatgaaaccacacacaatcctaaaaaagtaaaacaaagcaacaatcaattcaaagtatatatgccattaattagatcttgatttcaaagagattatggaagttgaacggagtcaaacagagttatgcttcacaagatatggatttccgaagtttgaaggatttataaaccgaggggaagagtgtctcggtgaggagatgatttagacttccagaggggtctttgggttaaagagggatgtaacatggactttagcggacaaagaggacttcacacagactcctttagagggatccatctctcgggatcggccgaggcaaaaaaagggagccaacacagacttgtacaaggaatcgacctcatgggcttggacagagaagtagggggagatgatatagacttttagagtgagagagttcagagaggaagagtctagactgtgggtcccaccccctttctctttctcttttcctttcctagactgtgggtcccaccccctttctctttctcttttccttt

SEQ ID NO: 103040 - DNA, 870 bp, Oryza sativa
ttactaattaagctacctttgttaatattattttatattcctaaattaccctttaggaatcaatggtggatattaattggtttaggaggtacttggggtacctctcaagcaccgtaaaagatctcaatattgtatggggtccaatagaacagaagttttggaaatttagttttggaattttgaaccctgcttcctctacctcttcaagtactggaaaatttagatcgatatcatgttgtgatgattggcgatggcagatgtgtttcgtgattgcctcgtgatagaaaatgtgttgttgatctaaatgcgatggtaaatttgccttgttatggcagatgaagtaatgtttttttttcctcttcttttcagcagcagagcggtatatatagcctgccagtgcttcatttttttttctgctaattcaaaatcgaactggaggtaaaaaatttgggctaatgaaaaatttggaattatggatgcaagttcattccagccgatttgattgcttcggcttctgcttatagcgcagggagcaagcgatcgtgcgcggcgcgctggatagggacagttaatgaacggcattttaatcttttttatctcattccttagttgtcttgtgaagtctgtgaattgaaataattgagaaaatcccttctatatccttgaaattttagttaatcccttctatgcacatgaattttgcttacttctttatataccccaaaatttgattttgatcccttccatacctcttccgtcagttgaccgtaattggccatctaatttctataaaaatgaccattttactctttggatgaacatagaaattcgtgaattatattattaaaaatgtaaaagtttgtcgcataa

SEQ ID NO: 103041 - DNA, 922 bp, Oryza sativa
taaagacattgttatacctgccaaggttgaagatctgtctaaagagcacaaggcagagatggagcagaagatgcaacaactgaaggaagcatatcttaattctttttcagtgactcagcaaggaaaagtgattcaaaaatacaagttccaaatgctagaaggagaaggatcatctggtgccaaaggagagcagaaagaagatgatgataataaaaattagttgatgactttacaagatcgtcttgattcagctgtgcatcatgctttcatctactaatctggaatcttggtcaacacgttgtaaaatctgatcaagtaagtggttgatgggttaattgctgaggagaagacaagaggaccagtatatttaccaagtggtgtttttcccaaatatagagaaatcaagactagtcttgggagtggtcaacctcaaggaaatctcatgtcggcattaggatcagcacaaccaaagcaacagccaacgtcaggagctctgggatcaagcaccatgacacctgagtagctggctcaattattcaaaacaatgcaaatttctgaaagttcacagccatcggccacacagccaacggcaagccagctgccagtaattccttctcagttaactcagccatcttcaggacagccgattgagaatccatcaatcgaaccacaatattgcaaagtggaccctaatgttctacaatatcaacaaattccagggttcaactttaatcagtttcaacctccatcacctctacagtatcggcaggatacacctcttttgtccaagctccagacaaccaatgtacaatcaatatgaacaacaaaatcaagggggagttcaacaacaacctttagccgatataattgcagatgtggtgaggcaacagtttggaatcaaacctaaagacaatgggatcat

SEQ ID NO: 103042 - DNA, 507 bp, Oryza sativa
atagatcagtaatagtactagatagattaagattaaaaccatttgcagttccatggaaatcaagtatactacagaaaaaaaaatgcttttaatgaagatcaactattttatgctcctacaattatcaagaaaagcataaacacataaattccagtgacattattaatgtatatatatgttgtgacaacaatatgccatcagtgatacaaatatgataggtcactgataaagacagaaaagaaaaaggaaatcatggtataccaatgataggcataggctgatttgaaaataacacaaaaaattattaatcacataaaatgacaggtcaggatgttctgatcacaaccaacaggtaaacaaaataggtaacaagtgaattgttatactgacggacagaaattgcacaatttaacaggttcaacaaaacaaactactgcagcttgaaagcctttgtacctttctatgtcataaactcggattgtggcattatgtatctccccaatagca

SEQ ID NO: 103043 - DNA, 709 bp, Oryza sativa
ccagggttataccctgtgaaagtctctccaatggattgtgaggcagaactacctccattggtgtatcgatcggtgcaccagctcccgggcagacatgggtgatgcagacgaacaatcgaaaacgaacagaggacgaggagcagtcgtgcagaagcactccccaaaacccgcctacccggtacagatctcaggcgaaggtgtagttccggaggccctgctcgttccgatctcttgtgcgcgcaagcgatcagaaccggtgaagcagtagcagcacaggcagcggcgcgaggaggaggaagaaccagtgtttggaaagtaaccaacctcggcccggccggccagctcggctcggcgcgcgcgcgtggctttctgatccccacctcaaccggtaaacagggagcctccaataactccctatttaagttgagatactcctcttttaattcccagggtggtattattatccttaacatttattatggccccttgagatttaatagaaaaatcgggcctagcccatttattctaacaattattcactaaattatagctatggacaatctatttggatattgagataaattaaacattttgagaaacaaacttaatagatagtttgaatgatgtggccagaaaagagatgtatagacagtcccaaagacggaattgcttgagaaaccgttcttttgatagcatggagcaaataatc

SEQ ID NO: 103044 - DNA, 653 bp, Oryza sativa
ccgtgtagttaaggcttgtttagtttcctaaaactttttttcaaaaatatcacatcgaatatttggacacatatattgagtactaaaaatagataaaaagaaaaactaattgcacaattgggaggaaaattgcaagacgaatcttttgagcctaattagtccatggttagccataagtgctataataatccacatgtactaatgacggattaattaggctcaaaaattcgtctcgtggtttccaggcgagttatgaaattagttttttcatttgtgtccgaaaaccccttccgacatccagtcaaacgtccaatataacatccaaaaattttcatttcaccaactaaacagggcctaaattaaatggccgtgattattgtttgtgacagtttttaagaatctttaagaatgcaatactgagagagagggaaaatactctctcgccacacacatctcacaaatttttgttgttttccatgccattttacggggaaacgattccaaactcttgattgaatattttccattttttgcatgtcgtttatatatttataaatatataaaaaatttaacaaaatagattaatacgtgaaagatcgttccacaaatatgtagggtaaaatttaacttctaagtaaaaaaataaatttaat

SEQ ID NO: 103045 - DNA, 641 bp, Oryza sativa
ctcggcgagttcgcccgccgcctcgcctgcgtcgatctccatcgccgccggcgtctgctgcttccgccgcatcctcgctcgctggtgagcaatccatctgttacgcgcatcctctttctcatctctctctagccacacttttacttgcgttagccgttagccctaccttcacttcacttctagatccggaagcctttttgtcttaaccctagtaccagtaacagcttagtttgttcgcaagaaaatttggggggttcaactaagccctcatgcccccacgttaggtcctcccctggcttgattttttttttttagataatggataatctggattgtgcagagtgttgagaagttctgtggctctgatggtgaggctatgtgatatcgaatggttttgtattatttttgtcttttcaatgaaatttgttttataagcaagcagactgctcaagaatggccctcagtgtctatgcaccaccagcagctgcaatgcagaggcttgctctaggcatatagttatcatatttcgtgcttacaacccctaattgctttgttacattagcttttttaatcttttgctccaccctattgcttagtacataagaacatcctctaccacagattaaatagccaccttttcg

SEQ ID NO: 103046 - DNA, 1841 bp, Oryza sativa
tgctatagttgccatttttttgatattttgttcagatctgagtgctatatgttgtatgtctcaatatatgtgtgtatgaatgttcagatatactagtcattaagtcagcgcaatgagtagcgcatctatgattattttttttctatatctcatgatatatatctatttttttgttttatacaagtgaagtgtttgcaatttgattattacactcggtgtagcttggtcaaaattatacatagcttcaacttacccatatggatagaagtgaaaaactactgaaatatatctccactttttaatataaggaaaaaattatcacgattattgtttgcaagagttgatatcataagtagaaactgaaaattagatagtggaactataataaaacactggtaggtctggtgtcatcccatcccaatattgacaatataggctaagtacgcatagaagaaaaaacaaagacatccttctacatttttatattggcatttcttaaacaaattctgaaaccaattaaaaaatagaaggcacgtcacacctacagtttttcttgcattcagtaaatacattggataaaaacttttgcaggatcagtaattttgcctcatgaaagtatgtcctataattcaagaggctaacaataatttcctatggtgaaccgtgtcctatcatttacttagtaggagctgcagagagtgaccatgagtatccaccagtaaaaaattacttttgtataaacctgtactagccacctgtgattactctttttatcataatatacattgcattttatttataaatagaagattataaaacttgatggaagcgttaaccacagcaccaaagctggtctccaaagcatgcacagagaagctagcaaagctatttaggttgcaggtaaaatgacttgctttgattcttcagcatcattgatacttctagttaaaaaagtggtcattaatgcatcacctaattatgttctgaactcagaatttctttactatcttgttggaataaactactccctccatttttatttacatgacattaaaaaaacagaggtagtttttccaaacagccatactatcattgtcttcatcatatttcagacattcttagattgctattcatgaaaaaccagagcatgatagaaacacaaccattaaaatctagaaatgtgaaaggattacctttccaccttgttaaaatctggaaatgagaagggattacctttccaccgtgttcttcagttcaacacgcattcaagctatcctatatttcagttctcaatccacatggaacaacaaatatgtgcttcttatagatacagtataaccattttcgtaaaaaaaatcgatcttcaattgacatggttcataaatcatgtttgattactttattatttgcttcgtatatcctcacaattcattcttcagtcagtgaacacacccttttttaagtctattaggcaaagcaaccaccaaatcctagagaacttatggctcacagcaaagcagaggctaaatggctaattatagagtaaaatacatttgatctttagtattcaaattctattcccggttaagcaagttcctactcctctatgtgctgttattacacacatatacatctagaaatacattagtttggtctcttcaattgataatagtgtttaagggcactgataggtgtaatgctgaagttattcattggacatagaaaaggaagctattgattccttgctgtacaaaagatcgctgaatttatgatatgatcaacatataaaaatgaataatacagtacaaatacgtcagcataacaatatcaaatactatcat

SEQ ID NO: 103047 - DNA, 860 bp, Oryza sativa
tggtcattgaattatctgttaaaatcttttgtctgtactaagtgacaatgacattttgcatgctcactgtaatgcagaatacattgttcagaagtacaacccaacgcacacctttcagttgtattaagaggatcatcttgttcacttatattagtcctaatcatggaacagcggtaggaaaacttgcatgtcaaactgcagttaaggagtacaccgacatggttgtttccgtggagcccttttgagtggattccatgaactatttagaaatattgtttatgcttgtaattttttcagtcttcaaaatgatttatataaactatacatttttcttgatgaaatggatatttctgttatacaactatattttaaaactaaatattaaatattttggaattggagtatatatatgcctttttgggagcaagtccttttctatttacaaatcaatttcatatggtctctgaagtctgaacagaaatggcacctcaaacagtgtgaacgactgctaagtaacacctaatccatcaacctatatccatctatagtataatcaactcaagatcttgggtattaagcattaagaactaacttaagaaatatgtgaacacagacacttcacaacaactctaaatcaccttacatcattagaataacttaaatctgattcttccgagaataagaaatgtacaaaatattaatttgtttatctttgtttatgcttgtcgtttccttgtgtgaggtcagcactatgtcttttccatgctacttcccagagttgcaaccagctaaagtcaatcccagtgggacatctgctggtggactcccatatattcagggattcagggcagagagcagta

SEQ ID NO: 103048 - DNA, 886 bp, Oryza sativa
aggattgggttctctagctttttctctgcaggaactttgccaacgcatcacgataatcaaggttgattaaaatcacgatcaagatccccaatcggaatcggaggtctctaaagtaggatcgcaatcatataatcgtaaaaatcatagattctatacctactagaatcgtagaaccagacccccttaattaagatctcaaagttgtaaaatccgtacgatagaacagggttcactttctctgtttgggacttttgattgggggtcaccgaaatttcggaaatttcggtccgaaatttccgaaattttgagcaaaatttaattgaatttgaacaaatattatccaaattcatgaaaactttgaaaaattgaaaaaattcggccaaactaatatcatatcggtcggtccgaaatttcggtccgaaatttccaacactgcgatagaatcgagatttcatcgacacacccctaataattattcagtatggctctaccaccttgatgtgtaatcgtctgagttcaataaaagcttccgttatctaaaaacaatccctgataattgttctttatgggattcacagcactaaaagtctgaaactgaatcatctgggcactgaaaaaagaagaaaacttttttttggtttgcattgcaggtgtgtttgcagggacagtgaggacagaaggctgcggcgacaccttcttcagcaggacgtacaagtcgctgttctgcaggaaagggccgtgcagggagcactgcgacaacgagggcgccgatggtggctattgcatcttcttctacctcttcgtccgctgcatctgcaacgagaaatgcagctcaaaatagtggatcctcctcatcctcctcctgctgctgctggtgatgatgata

SEQ ID NO: 103049 - DNA, 2414 bp, Oryza sativa
ctaccatgagaagaaaacacaccagattctgaagctgatacaacactgtaaatagtactgagttcatctcgcagtgcggcaatcttagatatcttttccttccagtttttgttcaaggtactaatgcagttctgattctcccataactttgtctcgaactctcgacgcatgctagtaatgtagctctggatcatgatgttggagacctccttctgcagctcatactccaactggtgaaagattgcaaaaccatacaaattaaagttagtctaacttatgggattgttttccacaatgcaaactccaagagagtttttttttagataatgtcgaagagataattatagtgaagtcaaaatgttgccattcaacactccaaattccagaagaaaatgcgcataaaagtcaagaacttctcttagcacgtgcatcaaacctaatgcacgtgcatccaaactgtttaaagactgactaaaagatgagattttctcataaaactaggagaattggagaaatttgacgatgccaactgatattcaccagagattcagttgaccttttattctttgctttaagtaaattgcacgctaaaagtctacaaatttgtcgactatatatctacatatagtacatactcaacgaatttccccaagtttaaaaacttcatatctactgcataatctgctcaagaaaaagaaaaaaaaactgcacacgcatatctgcaagacaaccacctggcaggaagacaaactaagaactactacagctataaataactgaactgaatcgaatcaattacaccgtatcagactcagaactgaaccagaaattcaaaacttaaaccaaccaaccgacctgaaagaaccaagaaacgaataaagaagaaatgcacgatattcccaatgggttcacgaggaaggaacactcacggattcggccgcctccatggcggctcgccgccggcaagaacacggcaaaatctttccctcctccgcgcgcgggaaaccaaaacgcggagaggagaaagccacacgcacgaaattgaaatgggagcggaggaagaagcgaaaaaaggagcagctttttccactaaaggcgcctcctttttccacccccactactatctctcaatcaatcacttaatttctcacgctaaatttcgcacgctccctgcggttaattagcggaaaaccaagagagagagagagagagatagagaggaggttgcagtgacatctgtgtggagattggagagaagcggttgggaatggaagattggaagttggcaagaactgtagagagagagagagagagagagagagagaaacaatggaggtggttgctgcatagagagagagggtgataatgagaggaggcaggaagcgtgtttgcagggacagagagcgtattagcgaggggaggggggattagttgcattggggctgaaagggcttgtagaatagtggttacaatgacccgagtagtatcccaagattctgaattcaaatctcctatggagcgaattttagattgggttgtttgcagggctaagttctctacttcagtatatatccggttggatgtagaggccgggtaaaaaaatacccttctcttaaaaaataaaaaaaaaagttgcatttgggctttgtcggggatgtcacgggccacccgctccactgctttgagattcgtgctgcttccacttttttttctttttcttgctggaactcaactttttattatttatttttatttttctcgcttgtgttatttttgcgctcccagctcctcatgcaggatgtcatgtgaaaataatcgtactacgtcctttttaaaatgtatataggttattcgtcttatttaaaattttaatataaatatataaaagtataagttaagattatattttatttgatgataaaacaagtcataactaaataaatgatgtttatatcattttatgaaagaaaaaaaagaagagtaaagtccatcaccagtccctaaacttgtatcgctgtgtcatcccggtccctaaactcgcaaatcgaccgtttagatcctcaaacttgttcgactgtgtcatcccggtccctaaacttgcagatcactcgtttaagtcctccaacttattcagttgtgtcacccggttcctaaacaggacggtctaaaactttatatcaaaaaataattcataacttttcatgtgaactctaatgaacaaactttatatcaaaattgtagccctcgacgcgacctacaactttgtagttgtaaagtttttgaactaaaactgtttagggtcccaaaatattgttgcatgtttatagattttaaaattttaattttaaaattatattttgggacaaaaatgacttaaaataaaaaaaaaatcaactacaaagttgtagatcgcg

SEQ ID NO: 103050 - DNA, 726 bp, Oryza sativa
tcgtatacactcataaatgtgacttttagtatttcaccgtaaaaaggtacttcctgtggacaaaattaattgatgtttaggacaaccaagtcagtactcctggtacctagcactgtaaatctagagagagggtataatcttatacacccttcgtcccattttaaatgtaattgtagattttttttattcgtcttatttgattttttttattattaatatttttgttgctattagataataaaatatgaataatactttatacgtgacttattttttaaaaatatttttataaattttttaaataagacggacagtcaaacgttggacacgaaaactcacaactagtaagttactactccctccgttcaataatataaaggaataatatatgggattttggagggatgtgacatttccgacggagggagtacattttaagataaatggtgctaaattgcaaagaaaataagataaaacatgtgccggaaatgacaaataaaattgagtggactatatagtactgtcttttttccccttttcctgaattagatccaaaattggcctttttctcattttattctgaaaaaacatactagtgttcataagtatgtgtcattgactcattttctataataactcattaacatgtgtacttaacaaatgtttgctcatagatgctctaatggctatcaatctaaactcaagaatggtatcggggcgcaggaa

SEQ ID NO: 103051 - DNA, 590 bp, Oryza sativa
cctgggtgtttgagaggcagaggtggatttcgacatcggtggcagccctgtaggtggcggaggcataggaatccagtgaagtggaagcggatcctttagctcgcgtctggttggctagttctgattggatgatgacagatgaggtgggcttactagcggaacgtggcatcaactcacttgaagcggatgaagatgacaccagcggagttttgtagcgacaacgcacaagctacatgacctccactcatcgaatataatcgtttcaattgaggatgtcaagaaatagggatgtgtcaagatcgtctttttttttgtgtgtgttctcctctttaatgaggcatgagtctaagcgctcttgtatcattctggttatgtatatccctcgtgaatatagaggccggattaatgaaaatccattatctaaaaaaacaaaaataaattaagccaaagcatgcacagtccacttggcgatagccctggccgccggtgccattctcacccttcgcgttctgcacgcggggatttgcacattttgtgtcgctagaaaaaaaaaggcaacaaattattttttgtaaaaaaaatactaccat

SEQ ID NO: 103052 - DNA, 575 bp, Oryza sativa
ctaacggtgagtttcctttgctgtgcacacaagatgacgaaatctgccgctgcaagtcaagttcactttgtgttcgtcctttccagattgtttatgtcacttgtagcttaataatacgagtacaaaatgaaatataatatttttgtacgtacgagaatatgaagtactttagtactagtatcctaccaagtcctaccatataaaatgcgctatttcataccaatttaggtatgacttgtgatcttgctctgtcggacttgttttccagaatatttgagaaacccagatcatgaatcaaaataaaaatcaatgttatttaaaatcatgtttgttacattatgatgctactttaaatcacattaaattctaaacttcaaaattgattgagtacttgttcactattgtttgcaattttcttttaaacaaaacacacatatatcaaacatcaaaacatcaatagtagatgaagacataagaaacttgtctgttggattgtggatgatccaatcgttggcgttggctttagggtttaaagatttgtcaaagaactaaagatggtgtctaatactacatgt

SEQ ID NO: 103053 - DNA, 2319 bp, Oryza sativa
tctaccataagaaaacataatcgttcaatataaaagaaccttgttaaaagaagaatccaaatgtttttcctcaaaatgtagtactactaaggtgtgttcgggaaggctgggtctcaactccctccgcctcgttttctacgcgtacgctttccaaactgcttaacgatacgtttctttttaaaagtttttatacaaaagtgctgagaaaatcatattggttcattttgaaaaaaaatagctaatactccctccattcaataatataaagcacaaccacttttttatatctttcataatataaggcatgcatgcatgccattacctatgatatattctccattcaattactactttttaaatcctttactttcatattctctaactctattggatacatgcattgtatttattaggatgatccaaactacaagatgataataattatttcttgttttttggttaagagtggttgtgccttatactccttccatcccaaaataaatgcagccatgattttccgcgcccaactttaaccattcgtcttatttgaaaattttttgaaaaaaataaaacgtaagtcacgaataaagtattattcatgttttatcatctcataacaacaaaaatgttaaatactcccttcatctatttttgatagtcatattttatcttggcacacagaccaaggataagtaattctacttatcatccatttaaatatgctactagtcattcctcgtaaacaagcgttttattaatatttacatttctcgatgcacatgtagccaatcttgtgtggatgaatggagagtcacacattaaatccgagaaagtcattaagatgataagttgttggattgaaatatgcctatcaaaaataaattttttagatttggaaatatgactattaaaagtagatggagggagtacaaaaatttttttaataagacggacgatcaaagttggacacgaaaactcacagctgcgcttattttaggacggagatggtattttagaatagagagagtatttaattaatcatacggtaacgagtcgctatatttttcgtgagtgcggttggttggcaacactggctgccgaacatgttatctttacccattccctacgatttattacacacccccgcatgctcctctctctctctcataaactcgcatctcccgagtccccacctcaccgacctccaccacacctcgccatcctcctcccttgtcgcgcacacttccccactcgcctccgcctcgcccccccatggcgatcgccggcggcacgggctgccgccgcggcctcctcctcccgcccctcctcttcgcggcggccctcctgctctccgccgcctcccccgcccgcgccttctacctccccggcgtcgccccgcgcgacttccagaaggtgatccgattccgaacctaccctctctcctctctcctccccctcctcctcggatctagcgttaggaggcccctcccgcccgtcggtggcggcggatctggccgtacggggaggcgctggtcccagatctgggctcggctcgatgccttcgtccccccctgcatttctggaggattgttcgcgcgtggtttagggttttatgggagtggcgagtggaatggtgaatatccggacgaatggatgggtttaggttcgcgtgtttttttatttttctgggctacgatacgaggggttaagggagagcatttcgcgggaggcaatgcctatctcgccttcgattgcctgtgacttatactttggtgagatagcttgtattggtgttggaataatctgtcgtactgtatttttgctttttggtggtaggatcatctgtgtttagtttagtgtagactgtagagcgcacaaagaatccagagggagcaattttcatgtaggatgacctaacgtagagttttccattttgaattcatgtagaggcacggatacgttatgggcgttgtttggttggtgcttgatttttccattttgtcgtgttgggattttgtatttactggtcctataactacgtttgtgtttaggttgcggatacgacaaaatcaccagtaattgtttatgttggctgattgggtaatatagttattactgagtgtaatattaataaaatggaataacaaaaactggagaaacagacctgagctgaagcatattaaggagttaacttttggtagtgtgattgaagtgcccttgataatatctcaaaacatgtataatgtgagaaaagtgggtggtgatgggtagagttggtagggtcaaaggtgccaactattagtaaacgctgtaccttat

SEQ ID NO: 103054 - DNA, 627 bp, Oryza sativa
tctaacgaaagctaaaaacaattcacaggatggtatcacaaagcaaattattgtggtgccactcattgcaaaataaaagaaatactgaaggcaagacacaagtcattggtgtcctgtgaggctgtgacaccaatgtttgtacattggatccgctccaaattaaggaatactccttccggctaaaaaatttgatcctaaaaacacaaggcaaatttagaactagtagtaagagaataaaataaaatgccctttagttaaagtgcacctaatcattatcacttacccaattagccaataaagtaatacgtataagattcttatcggtattaattgcaccatatacaaaatacatagatatccaccaaggcgacaaattatttgaaacaagcaggagattgaactgctacttaattagcgccaaacaatacaaatctcatcatacaccagtacaccacgccctatagaactttgaaatgaaccagaacacaaatacactttccacttcatgagtctgcaacaagcacatccattgatcaattatggctctaaatataaatataccaccagatgggggagttgaagaggctttacctgagacctcaacaagtggctgaagaaaaaatgaaa

SEQ ID NO: 103055 - DNA, 1091 bp, Oryza sativa
taggtggtttttgtgttccgagaaataaattcttggtattcgtgtcggatatatttgatgattatttgcattagagataattcttatttgttttcatatccgacctattcggttttgtatctggaaaaaaaaatacaaagatgaatacggtatgacccttatctgcataaattataaaaatacaaaatcaaaattatcttcataaattatacaaaaaaatagaaaaatgtttgtagcaacaaaatcacaattatatgcatgtaaattcaaatataaattcaatgatattatttttgtcaaataagacataatttataataaagtattattggtcaaaatttaaagaactgaatcttaaattgagtgcacaacttactaagtgggacagagggagtactacactagcttacccccacggtgtaaatattttttcatcttcgtttttattaaactgacaacttaaaataatgcaccacttttgttatagaggctataaacttctatattaattgaagaaaaagaaaaataagttcaaatacagaaataacataaatttgaaattaaaacaagaaattttcaaagaaaagtctatctaaacataacatgagattaattaaaattgagaataaacaaataaaagagttcaaataaaaatataatttgggaataactaaaactcgtaaaaaagaagtactaaaaagaggagtcaacctgtaacacaacacgagattagttatattcaaaataaaaaaaatataataaactatattacaatactaattccaaataaaatttaaaagaatcatgaaaatttgggaaaaaaataaaaataagtaagacaacataccaagaggagtccatagaatatataataattaaatattcaaagtatgatttaaaaatatagaaataacacgtataaaataacatttgtggggaaaaagaaaaaagagagtccattcggaaatacattttatatataactaaaattggatgtaaaagttatggaatattgagagaagtgttggtctaaaacataacacgagattaattatggttcgagatgaaactatatttatctataatattat

SEQ ID NO: 103056 - DNA, 1096 bp, Oryza sativa
ctcctgaaccatgtaactaagtactagtcactgcagtatagtgcactgaatgaggcgaagtggtggtaacaagaagtgctcctgctcactgttgattcatgcggcggagcccgggcagctgcccatgctagccgggcgctggctccgccgctgcatctgctaattccttttcgagaaaagatgcgatgtttttgttaacatttgcaacgaaagatttgcctgagttttctttccacaattgaggaacaaaagggatgcatggtggtttacaaagagattttttgtttttagagcgtgacaaaaatttgccaaattccattgtcaatatttttgggtcaaagagaggacatatgggagggttcatgttttggactgagttttgggctgcttgaccctggcccagacattctttctgctataggctgggcctgaattcaatggctatcaggtctcaaactcttgaatcgatatcttgggcaaaattcattgaaataagaccacttttaactccctcaactttccatcgtgtttaaatctcatccctaaactgcaatagcaaaaatcttgaccccctcaacttaaaaaactggtgcaaaagaaatcctgatactaagaatccctaaacattatttttaaaaaatcaaaatgtttcactctataaattacttacacttatattgagttgcaccgtaaatttaaaacttacactgcaaatacattgtatgtttgaatatttatattgtaattttttttgttatacaatgtaataaagaactagaattaaggggttgttcaaattgtagacaaaataaaccttatcaaattttgacaatggcaaaattttagtaagttggcaatattacaaaattttgacatgatttcttatgcatttaccaatgtttggcaaaaaactaaatgtatgcatatctttggcaactttaccaaaaaatggtatgtaccaaaaaataatatgatttgaaatgacatcaatttaaacaggccgtaaaagtaatttattatgtatttggaagaagagatagtagagatataacttacatataaaagagagagaaatcacataaggaaaaaaatgaac

SEQ ID NO: 103057 - DNA, 813 bp, Oryza sativa
tacgcggaaaggagatcgtgtaggcgtcctgatatctctatataagctgagccgccgcctccacgcaaaaaaaaaaagaaatcaatctagggtctgcctcctctctgtactgcgtcgtcgcttataatctactccatcccactcatcggcgtgcactggcgatcaggagagcaggtctctggaatctctgcctttgatgtcctgtaccgggagaaggcggcagtaagtcttaagctcccccaaacagacccatagattgatttggaagcaaagatccagctgatggagcatttaggcctatgactgatggggccattgcatcccctgtaggtagctttgctgcagcataaacgattggttggccattttttctaacagttggaggaggctggctgatatcctaaaaggcaaaatgattgttgaatttatcagcacataataatttaatttattccataaataaatcatgatattgcagatgtaaactagcatgaaccatcattagatctatatatgtaaactagatagtaaagcatgaatagatcaaatatgtgtaacatgttgaacacataccgagggtaccagaagattggctgctcagcaggaattactggcggttgcgggcgttgacgatggcgcgcagcacacaagcgaactagaagacgagccattgtggtcgaataaggagcagtcgcgtgaagagcttcccaaaaaccttactgagaagcagctagttggtagccagcttctgagaatatggaaaagctgtgtttcccaactactggcttctagttcattttctggattctacaa

SEQ ID NO: 103058 - DNA, 527 bp, Oryza sativa
tggttgcaaatgtcttttatatacttgataatttaggtttgaatatacgcttgaaaacgattgaaaattttgtttgagtgcaaaatatgtgcattttatgaaattaatgagattaaataattagtgtagaaaattttgacataaattttgaaaataaaacagatgtaataatttaaattcttatttgaaattttaataggataatagaatggaagcattcataaaaaaatatcatgagcattagtagtctatctttgtatgaatgctcctcattttttatagctttttaaaaaataaaataaatacattttctatttcattatctaaaattattttttcataaataatgtatcgcacaacaaactcataactataatagtctcatgcgataaacttttacattttcaataatataattcataaatttctatgtttatccaaagggtaaaatggtcatttttatagaaattagacggtcaactagaaagaggggtatggaagggatccaaattaaattttaggggcat

SEQ ID NO: 103059 - DNA, 533 bp, Oryza sativa
tgactatcagagtgcagtgttggtttttactatttttgttcgtgtatggatagtaccgaaatttcagaaattacggtagttttgttcttaaatattttttttaaaaaaaaatagtttaaaattgaatattttttaccaaataaatccaaaattttgggtaaaataatttcttatcagggatctgatagacccaaaattcccaaattttcgctctgtagtttcaaaccatgctcatgatattggtaaaaaaacgtttgtttgactagctttggtgagccaaccagctgctggtattttcggaaaccatgctcaattacatcttctaacatgaaaacggagggagtatatcgatttatataattttcggaatccctgagatccgaaaattatgttaccttctttaaaaaaatagatataattttcggtggcgctaatacacgctgcgcgcggaatattagttcgagcgccgcacaatgctccctcctttcggttttacccttttttggcacccacctttcctctgcatgccacct

SEQ ID NO: 103060 - DNA, 1051 bp, Oryza sativa
attatattcaaaacaaaaaatataataaattagattgcaatactaattccaaataaaatttaaaaaaatcatgaaaatttggaataaaacataatataaataagacaacataccaagaggaatccatagagattaatgatgattcgaaatagaaactttttatctattatatacgataatcttgaaagaagataccatggttgctttggagaccagagtttaccacgtttgacaaaatctacaccgttagatcgtggtggacccatattataatgtattataatggttgagatatagttgaatctatgaacaaatttgactagttatctgctttccaatttgaatacaaggcatagtactaaactatctatatataccatctagtctagaatagaaaattcgtttgctatccacgtaagacaaagacaaaagtatatatgtctgtgttaataaagttagagtagaaataaattttgaatagaagaaacgctggttgcacaggaaagtgaccaggtctgcatcttgctcaatctggtatcaaataaggtgttgtttgaatctcttgaagatgaagataaaaattaagtgttttacataaaacgatgtggtaatcatatgtgattaattaagttttaattattacaaacttgaaaattggattaatctgatattttagaacaactttcatatataaagttttcacacaaaacatatagtttagcagtttgaaaagcgtgacactttaatccaaaattttatccacgatttttattggattcgaacggacctagtctgcatcttgctcaatcatccttgaatggagactagattgtaggaagtgagaatcaaataagagaaacttcggtagtgtgtgattgtgtaaatagatagaaatgcacattatcaactaggaaatagttacagaaatgtgcggggctaccctaacgaactataaatggaggtgtggttggtggtagctactagcttggacttttgtagactagaattcggaacagagacaattttttagtatgcagagggctgcaggaat

SEQ ID NO: 103061 - DNA, 729 bp, Oryza sativa
gccatatgccggtttctgtccatggcgtgaagaatatttgtccaaatttggagatgagtgtctagctatctaactgcacgatccggtggagtccaaatggccggcacatgtacagattgatctgttagtcataggctcataaccaccatgcacgtactccctgctggtgtattattgttcaaagttcaaaccatgtgtgttgctgctcgggacaaagttcagaaacatgtgtacatgtgcgctaaagcttgaatcatcttggattggaagttgaaattacgtacttctgtggaattttagaataatatagttgttttgtcatcaggtagtgttagcagttgagtttcatgagaagggtgtggaaaacataccaagcaaagtagaaaagttcctgactggctaggcacctgtgaggttgatattttggcattagcggtaagtcactagcacggatcctgacatctggccatctgttaaaggccaaagagagctgttacatatgaccgtatttataacgggtaatcttgacagccgttacagatagccaagtcgactaagagccattactgatacatatgtaacagctcattaaaaaaaaaaagcttttacatatcttcatttaatcatctgcaacggctcacaatttagaaccgtttcagatgatttggatatttgtaacgactcataatttagagccattaataagatgtctatctagtgatgtataat

SEQ ID NO: 103062 - DNA, 826 bp, Oryza sativa
agaaacaaaaaataatatcatattagctctagagttcatgttgtaggttaatttcatttctgatctgaattaattgtaattatgatattcacatttaatttatcaagagaaatgtccacttacaattctaaacttttgcacaagtaaaaaaatcaactgtaaactaagtaaccggataggatagcatttgaaattgtcaaaaccatgcaatttacatacacatcatactaaaagcacctctattttgcatgtgtaaggataatttgaaaagcgtaaaaacaatggtacaactgtaaccacgtgtgcttccttgtccttaactaccccttcattcgtgttttagcattttagagcaatttttttcgagttgatcaatctgaaaccttgcctatttattctaaatttcatcagtttgaattcatcttttttaaaaaaaaaaacatcacatatttgtactcttttgaattccttgctcttcagagttttatctgtttgaatagaaattcaaaagagtctaaagatagattaagtgaaaattttgaaaaaaaaggggaaaactaagattaaattttgaaccatataagtctatgtttgtttctattgaattagttattactttatttgttagagtttgtgtcgaatatgtgtataaagtcggttataatttaagacttggagttgtaatgtcggataggttgattttataacagtatgcggtcaccagagttacaattatgtaagaatacatgcattgcttgatgcaacagtcatgataattttattttatttcctaacaaagatggaccaccagcacccttagctcgag

SEQ ID NO: 103063 - DNA, 592 bp, Oryza sativa
aaaaaaaaaaaagataaaataaatggctcatctttattaatatagtctaattgattgacaacaaagtcctttaattaggaaatggatcctcatcattagaatgggttaagaggtgcacagttttcttaattcttttggaccaagtaaaacgattgattgagtttgctgtggtacttccgtggaatgttcttgtgctatgcctggaatccagtactttggtcacacctgcatgaaattgatcaattttcttttggtacctgcaagcaggggctactgtaaattttccccatggcattgacttgagtttgcttttgtgatttcaagttgcatgcaggcggattaaggaagaaatggttaattgctcctcttttcatagtttcagatatcctctctccggctcagttaatttttgatacacgtttgactattcgtcttatttaaaaattttgggtaagtgaataagatatgaattatgcttaaaatatttctaataataaaataactcaaaaaataaataataattatataaattctataaataagatggatgagtaaacatattttcaaatgttaagggcattatctattacaa

SEQ ID NO: 103064 - DNA, 610 bp, Oryza sativa
caatctatatagtagatgacagatacttcctttgcaaagtggcattgaataatgagatatgttctacatcatgtctaaagctaaattttgcatggccactcatttatcagtatattcgatctcatcttcccaagagggcaataaacatggcaccgataaatcccaaataatctaatgaaaattcctagcaaaaaaatggcttaacaaagtcataccgtgaaatccaacttgtaacgaaaagttcataagcatgtttaccaagggaaaaattcagtatgaaaggatggaccagtaacaaattccaaaacaatcatgtgcaagatgcttgcctgaaaaagataatagcagtcccacacatggcacatattgtgtaaaattgattaaatttgaggcagagatttgaaagaacagacatctcacatgccaaaagataccgaggtagaccaagcacaaaatataattatacaaataggtggacataaatggcaatttgtatttgagtaaaggaacgctacagtggaaaaccgttgtttgaaatcttgacatatcttatagaagaaaaatgcttttcccttgtaagaatccaacaacttttactatgcttcttttg

SEQ ID NO: 103065 - DNA, 878 bp, Oryza sativa
ttttgggataagtttttctaggggtctacttgcgaaataagtttttcaaaaggactaaaatgtgaaaaatccagatggtctctaatcattaatgtattcaaatactttttcttactcttctttccttcctttcaccaccatgcaacaaaatttactctaataaatgctaagagtcaactctgagcccgttgtcatgcataacaaccatacttctttctctttcttccatatcatcaaatttacttgtatgacaatagagagagaccactaataaataccattgtacatgctctagttgcctgggaagacagttaatcggtggattttaccgcatacaaatcgctgcgccttgatgggtcgagcgcttgacacccgggcagccgcgtgctgccccaggaggtaaatcctccactgatccctgctcgtattataagatgtttgatttttttttcctaatcaaactttcttaagtttcatcaaatttataaaaaaatttaacagcatacactagtggagaaatgctttgtagtcccggttggtaacatcctgtagtcccggttttttaaccgggactacgaatctgggactaaagatcgctatctttagtcccggttcaaatactcaggactaaaaatatggtcccagttgttgttaccgaccgggactttttttcttttcttttcatccggttggtatttttccttttttttttctttcgcccaaatcttcgcggatcgaacgaataaaatcaacaaaaagcctaaatcatagatcgaataaataaaatcaacaacaaagcatccatattcttttacacttattcacatctacaacaaagcatccatgttcttttacacttattcacagtacaacatctt

SEQ ID NO: 103066 - DNA, 521 bp, Oryza sativa
gtcaccacgtcatctgaaggatggaattgaaggacgacatgggacatgggcctgcatacaatcgatctggtcttgggcctacatgcaatagatccgggaactggaacgcgttgcatccgggaactggaacgcgtgggaaggaaatcgcacggaaaaaaaaatcaatcccgtaaaagaaatcgaacggccatatacacgcacacggggtaaaaaaaaaggacgagaaataactgcgggtggatagagtcggacaatgtacgaaaaaattttgacaaaaatactttaattttttataatagtagaaaatttttataatagtggatagagtcagacaatgtacggaaaaacttgttttttataaaaatattttaaatttttataatagtagagaatttttataatagtaaagatagagatagagatagagatttcattccttactcacttaccgagcccacgagcagacgagccatcaagccgagccagccaccaccacctggctcgatcccttttctcttcag

SEQ ID NO: 103067 - DNA, 1107 bp, Oryza sativa
ctcgctcagtcagtgagcgatagcgactgcctctgccgattgaataaggttaattagtgattaattaatcgctaattagaataattaatcactaattattgttaatgaatcattaattagggtaattaatgactaattaagtagctccgttggacatgacatttggtctcgctgattctttatacgagactgttcggtctcgatgcttcatcacacgataccgtgcggtcttgcgctcctaccacgcgacactggtatattttcgctaaaaagtatatatcacgaatatttctacgaaaaaccaaattaatagtatatttttaaatttaattcgagaactaagacccaaaactaaaaacggaaggcacaataggcttaatatctaaagctaaatcgattagaactaggtgtaatcatattctacgagtcgtcgtgattggccgtttgttcgtattctgctatccatcttctacagttctacgagtcatatcacgttgatcgtgataacatgttaagttttaaggccccattacaccttacgcaccataacctctaattccttctacggccctctaattccaccaaccacacctccatttatagttcgtttaaataaaatagtagggtggtccgcacatttgcaacttgattttttttaaagttttaatatctaacaatattactcaaaaacaaatattcacatatttgcatgttgataatgtgcatttttatctatttacacaatcacacactaccaaagtttctcttatattcaaccatcaataccagtctgcatcatgctcaatcacagttactatttgatactccctacaatctagtctctattctaggatgattgagcaagatgcagactaggtctgcttctcacttattcatacttaattatttgatagtaccagattgagcaggatgcagacctggtcactttcctgtgcgacaagtgttgtttctattcaaaatttctttctactctaattttaccaacacagacatacttttgtctttgtcttacgtggatagaaatggaattttctattctaggggtgtttagatccatcggtgtaaagttattatatagggtgttgc

SEQ ID NO: 103068 - DNA, 683 bp, Oryza sativa
gacatttgcatgagacatgttatatttgtaaacttggtttctactccctccgtcccaaaacagtaacttggtgcacaatatagtaatgtgaatttggatggaatgttcttcacatcccatatctagattcatagtattatgttgtgtctaatatatgactaggttttctatatttgggaaggaggaagtacattattcttcttactttctacccttgcattattcattgattttttatgccttctaaaaaaagacatggctatgcggcgtccttgtcacatactcccactgttcaccggcgtccttgtcacatacttccactgttcacgtttgatcgacgcctaagtaaaacgaaatagtcaaaattgatcagcacattatcctcggtggacgcatggttgtttggtttccatgctaatttgttggccattcaattcgcatgcaaagaggctggtttgaataaaaatgggatgctcacatacaatttttttcttactaaattgttattactaacaattatctcaaccgtttgatttaggtagatgggagttatgaaaaatctagatacactcgtagcataacacatcagtgttagtaaaaatttagtaaaaaaaagttagtacatatagtcttttcctttattttgcatgtaagaaactgcagcaaatacgggctgcaggaat

SEQ ID NO: 103069 - DNA, 617 bp, Oryza sativa
cagcctcagccacatcccgtccaccaagtgcgttgtcaagtgcaagaaatgcgtgcccacctgctagattttcctcccttgtaccgagattccattccgcgggttgccccggggcctcacctcacgatcgatacccattcctgttcctcgtcgtgatgttaactctccacaatttactttcctatatatatagattcagttgaataagcaggcaagtctcatgcacgaggtagataggcaggagttatagaatttgctaagtcggatataatttttcgccctcgtactatgtttcttccacgtgaatgatcgatgaactgcacgagctactactataccagtacttttagtactacccctatatgtactgatccgtcatccgtgtacttaatggtagtagtgcagttgtaggggatcgatggcactttcaggtttttgcgatagacgagagacaccatccaacaaactactgttaatctctacgtacagaatcatcacgtatgtggcttggatggtgaacttcaccgcaactatataggagtaagtacgccagtttggacctaacatcatcatatcacatcctagataggtggtactattaagctagctagtatggg

SEQ ID NO: 103070 - DNA, 617 bp, Oryza sativa
ccaaccacttatatcagatgcaaccctgcaagtggtagtccgacactccgactgataagaacgtgcgctgccatatgccgccatgtatatgtaaccgtgaacttaacttacgtgcctttagtgtgtacgtgcagggaaacacgcgagtctccgatcgaccaatcgacgacctcagagcatctccaacagtctccccatctcactctccaagctaaattttagctattctagcaaaaaaaaaaaaacgtgctccaacagcctctctaaccctaaaccctatccggctggccaaaacctcccctccactagccaaatttggctagccacaaatcacttgccaatcgtgggccccacacagattctccaccaccccccatctccttcgtctctccagcggtccagccacgactcgacgccgccgccgccgtgcacagccacgatctcaacgccaccgccggcgcagccacgacctcctcgatgcggcgcataagggcgggccggcggcggagagaacaacggcgcgcgtcttgaacccacgccaaagcgccaccatcgtcgtcgaggtcgccagccgctgtcgccgtcgtctgcaccgtcgccagtcgtcgccatccacc

SEQ ID NO: 103071 - DNA, 685 bp, Oryza sativa
gatctagatttgaaaacttcaagtcaaatttgaaaactttcaacacaagattgaaaactttcaacttgaaatttaaatttttcgaaatcaaattttgaaaactttccacttttcatctcaaatttgaaaaactttcaactcaaatttaaaactttcaatccatatttgaaaactttcaacccagatttgaaaactttcaagtcaaatttgaaaactttcaattctatatttgtaaagaggtatgcgaaagattgaaaaaaataggaagaaatgaaaaaacgcgtcgagaaaaattacaaaaaaagaaaaaaaaagggcgcgtgggggcccagctgacgcgcgcaccagctaaattgctggcgcgtacgcgcgcgctaggagccccccttctccagagtcctgaacctactccgttgcgtctgttgtctcgtccacgatttcgggggttcacgtgttgtcatcatcgtagaccactcgtgtaacaaatgtatccaaaatctgtctatactaacttataataaattagtagaaaaatgagcctccatgttcactctcacgatatagaaaatcccacattaatcgaaagaaaatatgaaaaaaaaatgacaatgaaagtgtattaggattaggttgtgtaaacggacaagaaaattttaagtggaaacggacaagggggctgcaggaa

SEQ ID NO: 103072 - DNA, 717 bp, Oryza sativa
ccataatacaaaccacttcaaaagtatatattttatgtttcggcctctggttatatatatgtgtcggtcgttatgtagtatatcttattattattattactattttagaccttataaaaagaacatagatagccctaaccttcacatggacccactatcagcctctccctatcttttttttctcttccctaccgcactctcccacgacgcctcctattccacacgagaccgaagcgtcgtgcgtcgcctctccccctccacttctctgtgaatgacggtggaggatttcatggcaacaacggatcccaacgggggtggtatatctccgcaagctcgccggcctctccccctcctcttctcggcgagcgccggcagcggatctccaacaacgatggatctagccggaagctcatcggcatgtccccctccccttccctgtgacgccagcgacggatcttgtcaggagctcatcagcttctcccctttcccttatccgcgagcggtagtggcggatttggccgtgagctcgccggcctctcccttccccttctcctcgagcgatagcggcgcccccactctcctctccccacttcgaaatggtcagcaagctccgcagaggctgatggtggtggtggggccctcccgacgacgagacgaggtacatcctctctcccactttctcttcagatggcaatcgattgggcttggtcacttgga

SEQ ID NO: 103073 - DNA, 609 bp, Oryza sativa
cgacaatgtggaccctgaaatagaagccgagcccaaaccggatgctaattttggcgtcgaagccgacgtcgacaaagggttatttttctttccctttcttgttttcacagcaacaacctcctcctcatcgtcttcttcatcatccagctccacctcctccgaatcattctctgccgcagcatcattcttccagtcctcgtcctcctcctcagcggaatccgcagtctcatccccacccccaccaccatccaccgcaccaggtgacttggccgttgcggcatccgacatccgccggagccgccgcagcttcctcgacggctgcggggtcacctcctcctcatcggcggcggcggcccactcgtacctctcgctcgcgaggtccaccacctcctcctcgccgtcgtcgtacctgacgcggtgccgcctggaccccacgtcgtagccctccaccctcccctcgtaccacgcgtcgtccagcggccagtacacccgcagccgcctccccaccgccgtctcctcctcctgcggcggggatggcgggttgggagggggaggggaggggacggcgagagggggcttcgtcgccctaaggttcagcggcgagggcga

SEQ ID NO: 103074 - DNA, 1368 bp, Oryza sativa
ccacagtctggtgcgatccaactccaacctgagtgatcgccatcgccatcagtttggtgttgctaccacgtggacggtggatctcctcgccgtcatcgtccgcacctcctcctactcgtcgattcgatgaggtgcggcgagcgaagccctcttggcatggacgaaggccacagcgccacccatcaactagagaacgaggctcccacgtacgcggcacgcgcgactgattcctcttctcgttttacttttttttattctccttttttttttcctgtattgattatcgtagcaaccaatcagaggcgagcaactgcaccagatggacgtggtaccttacagcgtccttgtctgagacgctcttttttacttagcgtccatcctattcttgtaattctactctatgattttactggatatttaattcatttgttaataattattatacaaaaaaaattcggtgaataatgtagaggcatgtgaaaaaatttgttaagcatgctgccagtagcagatggaatgtgaaaaaaatgctgtccgaaaaaaaaaaggaggaaatattacactatacaaattagtatcgatctacggtacgatttagtaacgggtgattgtttacctctgccagctcaaccatcggtgccctaggaagtaggaacatcataattacattatactaaggatagagttacgtgcaaggggttatccacatacccagcaaaacgaacatttagtcaaaaatcgttaattttccaattaactgaaagcaaagataaaatagtaagtttccgaggtaaaattcaacggcagcaacaataaagaaaactgtaataagctagcattggtcagcagcagcacatccacaaggaccacatcacagcaagcatgaagcagagcaaagcagtacagcacagagggaccgaggaggattattgcctcgaggcgaccgagttgtccatgaagtctgggatagcatccatgtagatttaatctgcctagcttaccaactatttttttttttaaagcagcttaccaactatttaattcaggcgccattgatctgcaggcaacggtagggtaagtaatgcattaagtcccccaagcaaatagacatcggaaatcgcttatatggctcgagatgagcgcacaaccattgtagcaggaatacagccaacaaaaaaaaaacagatgggaggagagagaactctaaacaaaataccaaaatgcaattaggatagcaaccttaggtggagaaaactctaaaccctaaacccttcgtagttctgatatgggagccaatacggctgccgccggtgtgaagcgcctctaccagcgccttgcacccacacaccatgcccggcggcggtggcc

SEQ ID NO: 103075 - DNA, 603 bp, Oryza sativa
attttaatcttttgtttaaatcttaaacagatgtgcacgcttgaagttcttttagtagatgtacaactaactatttatgcattatgaacgttatggatgtcctatttaaacattatttgtaggaatatggtcaaacgtatgttgttgtatgcatttacatcttaaaaaggcaaactattatcaactacatacatatgtttacataacgttaaatatgcgtcaaattctaataaatcatccgtattccgattaattgtttggcggtacccctccgtccgtcacccgtattccgtcttccacgacactggtgtcaactagcttggtattgagaagtttaatctcagcgcaataatggttggcgctgagttggcggtttattgttagttgtttttcttcttttttttttttgcacgatttagtttcgaaaaagaatcaatttgtaaaaaaaaaaaaaaagttggttgggtgggttagtagtggtctccattgggttcgtgacccccacctgtcagcgagccatgcctcgccgcctcgcctcttcccctttcccgccacatctccgcgccattttcccccatccctcgccgtcgccgcgaacaaatc

SEQ ID NO: 103076 - DNA, 564 bp, Oryza sativa
cgcgtgtaaacgggcgaagcgggcatgggtagtgactacccatgcccgtgcccgtgtgcccgttgggtatatgttttgacccaaaaaaatacccatgggtactaaatgaagaacaaacccagctctattagggtttttacccgcgggtaaacgggtaaatgggcaaaactgccatctctacttcctcttctcctatgggcgtgcgtggcgcacgcacgcgcaatcgccgccgtcgttgtgatttgcgccgccgtcgcccacagttttgtgcgccgtcgccgctgccttgccgtcgccgccaagtcgcgccgccaccgtagccgtgccgtgttcatctaccgccgccgcccaaccataccgcggccaccacgtgtaagcgccgccgtcgccgaccaatgagagaacaaagccggcgccgtcttctcttgctccacgccattgccgccgtgaccgagtcgacgaccacctctgcaaccgccttacgctaccgcccctcgccgtctatataaaggaacgaacccctctattttttccccacatccgagctctctgagctcttcttct

SEQ ID NO: 103077 - DNA, 1431 bp, Oryza sativa
aatattggcaccagtttctagtgttagtatagatctacaaacaagactataatagattagcaacaactcaaattagtcggcacaaatttgcatcaagtagattaaagccgcatcaactaccacagctaaccgcaacacggctaaccgcgagcagaagccaacgctgcaacagcgagagaactaactccaattcttttcggcttattcaccgaaatattaaaacaaaacaaattatttgctctatgcttcagaaaaatatatttttcacacaaaaaaaactttatactggtgtgttgtttggatcactgattttattttaagctatttgtttagtttatttcttaaaatacttaatctatcactataatcaattagataatctacaacaataattcattcgcttgtggtagaatcagtccacctagtttaaattctagacttgacatgggtgtttatttttacggctaattattttttttaaaggtaagtcggtctagtctttcaagtgtgctcataaggatagggtatttgtaggggtgctcattcttaggatagggtgtaattgtgtgcatttgtatggatgctcattctttcggatacgtccgtccagtttttttagaggtgctcataagaatacaatgtacttatgtgcatttgtaaggtgagtatgtacgttatggatgcctacatttatactgtttttctaaataataataataataataataattcgctcaataatctaaagcaaattgggctggttcagctcgctcaataatctaaagcaaattattagcagtgttcacagaagactatattcacgcaagccgggctgctcaggatgttgcagcaaaagccagaacccagaagctctattactagcacagtgttcacagaagactatattgaaattgcattttacatatcataattcagaggtttgtgcccaagatataagagtctacttctgagatcctgctgggactataagaatttatgctactgtggttcgaacatgagttgcaaaatttgcaatcctatgctcataagcagctactgttctatattaggcactatgcaaaaacaatgtcaatttccaaaatgatgcgagcctaacaccaatagtttgttagcatccagtatgttgttcatccatcgaaagcattgcctgttgcaggatcaatgccaattcgaaaataaaatcagtcatcatctgaaatatcaattatgccagaagtaatggttggatcatcagttaaaccgggtggatctgctgactgaagtggaaccatatcatgagcagcgtcgaaaggaacgatcgccaagtatggagctggtgactgggactggcatccgggggattgatttaccacctgctcagaaggggtgctaacaacaatctccaagcatggagctgcagcttttgcttga

SEQ ID NO: 103078 - DNA, 707 bp, Oryza sativa
acgacttataatatgaaatgaatgggtcctttcaaaaaaaatatgaaacgaatggggtagaaaagagagaaatatatgaagcacaggagctgatcttggcttccatactcttcaacggttagttcactgctgataaacagaaggagataccatgtaaatttgaaaattaccttgaacattgttttgaacttctgccgatgttgatgtgcccatctttgtgtatgtgccaccacagttcatcttgtggctgcagaaaatagcatattgagtcaataacagatctttgcaatcaactgctgcaaacatttgctgaaaataaaagttatttagaatgctcaagcatagatgatttgttatatttagaatgctcaaacatagatgattttgatatattcacaataacacgcatcaggtatgtgcatttagtgatcagttttgagttgaaatttccaaaatcaaatatgcatccagtttccccagttttattgatctgcttttcacttgtgatttcttaagagagaacaaaacgaagaatgaacagtgcacatatatttttcaaacgagactcaaatagattgagctcatacttttgtctgtgcattgttttggtactattctatattctaaaactattgagtcttacttatgccagtggcaaagcatgttgccacaggttgagcagttgtcaacattctcaatgcagcagg

SEQ ID NO: 103079 - DNA, 1996 bp, Oryza sativa
ttcctgcagccctgccagtttcacacaaaataacaaaaaatagtgggacccacgtgggacccacatgtcatccttacatgtctcttctctctatctccccactgcactgcagtctgcaaggagaaggcgggagtggcggtgcgcgaaaccaacgccgaagcggcagaaatctgccgccgacaccgatctccacagcggaggtgtgcatcctcctcaaacccgtcaccatcagcggtggtggggaagggggggggggggagcaagtggggaaccaggagctcgccctccgccacccatggcgaggtcgccgtcgaggtcggagggtggcgcagaggacggtggaaccgggggcgggggccgcggtggtgaggtgcgcgccctcctcctcgaacccgtcgccgtcgccgtcgtcttcgatgacggagacgacggcgggagaggaagcaaagggagccgggcggaaaggacacgcgagcggcggcaagccggagagcaacaggcgattgtggtggcgcttatcccacgcttgtcccatagccctcgctcgttgcacgagttcctctcgcagatgcggtacacggcaaggacaaggagatcgacgacgcgcgtcagagtccgttagatcagattcgcacgaggccattgatccatcctttgctttgctccttgtgcgttgcttagcagtaacacagggcaagcggaaaacgtagtactactatcctaaggtggctcgcaaggctttggagactgaggaagagctgggcaacggccgagcgcgacctctgcgccaccgccccgccagctttgcgcgccatcgctccggccttctccttgcagactacagtgcaggggggagagaaatgagatagagagaagagagaggagtaaggatgacatgtggagcccacatgggtctgaccatttttttttattattttgtgtgtgaaactgacatctgggttccacgggttttatttttttaatcaaatttccacgtccatgccccgtgggacaaagacctagtcaaaggagcgcgccacgtcagccaaaaccaggcacaatactgccgagggatctcgtttgcacggttttataagttgaaggatgtgttgtactcggttttgtactcagcgacaaatttcggactcggcgacaaattgagagacctaagatgaacttattccctctcacttctctctttttctctatgtgtggccggactgccggaggcacggcgaggcggagggtgcgcgaccgctcgccgctagggtttggggcaagttgggcgatagggatgaggaggaaggaggaagggatgagggagtgattctcaggttgcttgtttcttcaccgattctcaggtatgggtcgtttgtgggattggatcccttgctggtatgatgagataattgaaatgtttcagtttgtggagagtttgtggtagttgtatgtcctcaattagtcttagatgtacaaaagaaaaaatattctaatttctagattgtgcaagtttaagcaatatctcgtgcaacttcacttatttagttgtaagttttttgggactaaaaatttgatgttctttgtcacgctatcagcatgaaaggcggtagcccggccaacttagatttaaggttttgatcttatctttgcattttcgctgttgattaatgttttatgtaaaaactccaatccatgtcttgtggggagtgtgggctaattgaaaccatgggaacatgccttttcttcctttttttttttggacttttaagtctgtgtgaattagtctgtactctgtgaagttgtgcacggttttgaaacctatcagtctgaactttaagcgctctgtatctctaacacagtccagtgcttttgaaatctctgtgtgcgtgcactttttttgttatgctatgagatgaatacaaagttgttttgacggggataaagttgtgtttggtagactgtacatatactagcaatttttactgggaatgaacac

SEQ ID NO: 103080 - DNA, 1333 bp, Oryza sativa
cataaatttgcctcctgcgcgaggacttaaataagaaccactacacagaggtaccacctttgctagataacttaatcagctaggtctatgcccatacaagattgcggtcgtactcgtatgttcttcacatgtacttggcagtcttatatcggttggaacagtactagccacccggaaatcaaccatttctaccgtactgttccaatctaagttcattatattttatgcagtctaactaagcatggctaaacaaaatctagcatatatctggtttgctatatattcaggttatgcattcaaaatcatatatggctaatgcataagatactagagatatagaatataggattattatgctcaaaggggaggaataataacttgccttgctccaacgcaaataaatccaagatagacaacctgattatccgatcctcgaaataccacaggttgtcatccaaaatacaatagactctacttgaagaagagaaagaactaaattcaataaaagccatgaaatgtcaaaagaacaataaacggctagaagggctagggtttagggtataaatatctcctttataaggtatataggttatcgggcttatattagttatatgatttctaaagggtttgaggctaaggtgaagggaggatcaagcaactaatgttgcttatattttatgtgaaagctttgattggttggaaggatgggaagtagctagtttggatagttgtcttggttaggcgggtatgtggctagctaggatttggtggtggtaggttcaggtagtatcatatctagggtttggttatatgggagttaattgtggtgtaagacaatatatcggctaggttctatattttatgtatgggttctggtgggtgtagagtaggtggctgagagtatggtggataggcgatactggtgggtgtgggacttatcagacggttggaatttaactaacaaggtgtccgctagagtttggttgtatactagtcgatgctagagcataacgactagatttggtgtcttctatagccggtgtcagcagacagcatatcggctagagggaataggaggtgggtgcaggtttagtagggcggaagtgttactccgacaaccgtgagtggcggcggagcggctaggatcacacagagctcgagagctaactgtgcggcgtgctgtggaggtcgatgggatagtgaagctccgaccgctatacgcatcgaggcgtggggtgccaggagcagcacttcgaccttgggtttggtttatgccggactttacaaccaacggttcgacgtcggggatagaaaagcgcgaacgtccccatga

SEQ ID NO: 103081 - DNA, 3571 bp, Oryza sativa
ataagagtggggggaggagacggagataggggtggtgggggcgctgggagtagacagggactagagaggtgagagggaaatgatggtcacgtcggcagggcgggggtagtgttggctggcgcgggtgcccggccgccaaccgacacgtggcagggggtacggcaggggccctgcgaaagcaaccgccacgtgatgcccagcagggcggtgtcagacccccgaaagggactctcacactcacgcacccaaatgcccaacccatggcctcctctctcatctgcgcttcggagtacagtacagtacgtacccaagtgcgtgcgaagtttccaaccgacaccccccgcgcccggcacgcccgcgacgacacgctacgcacgccgcccactctctctctcgcgagatcacctcagtaccacgtacgtacgcacccgacccgcgtacccggcaacaagcgggggtgcacgtagaaaatggtaggagtggctccacacaggctggcgcgcgtatttggatcagttaactaatccccgccccctcgtgggcgctgctgcagcgcgcgattagttagtgtatagttttagttaatcacggcgtactcggctactgctgctacggcgacgaggaaacggagtcacgtgtatggaggtgcggggggcgcagcgcaactgcgtaagcacgagtgggcacgtgccgcggggattccggggaccccccacgctctctcttctcgcctcgggatcctcgtcgctgtcacgtgattcgatgccgttgccacacacccgcgccaccttccgcttccgcttccgtcgtcgcacgcatatcgctcggttaattctccccccgttgcaacgacacacatgacgggcggtgagcgggccggagtagtatacagtagctcgcgagatatatgtacgtacaggttggcatgatcagacagatgatatatactgtatcatcgcgacttctgctgcagaatataacaagtgaattatgacaagtggccggccggcaggccggtgctagcttcacccggttctcggataccgtgccatgtactgtaggagtactgctttgcatgcctgctgtcagacattcagttatgcgtgaggtgtgacgtccgagttttacagtaatccagtactactagctagtacatccagcttccctccaaaactttataaccaggcatgcaagtactactaggcatgcaggatgaagggaaactggagtagctatctgcctcattccatcttgctctcctacggacactagatacctctgcacatacaatatgatcgagtacgtttgatcccgatcagggagtgagggatgacacattctcatttctgtcgcgaatgttggatattctttttcaccgatttattagagcccattttgctttcaccttaccatgagtctcaatcaaataaaaacaaattaacagcatgctatatactgtacatttattgtatgaacaaattactgcggttttacatgtgttgggagaaatacgacccaacaagttagtagtagttgtcaagaagctagatgtaccaccggtcacataattatagccaataataaacatatattccagtgttaactctggtaaattccttgtcaactgagaatacgtcaatagcccaaaaccttgtgtaatagcctccttggcttgagcctagattttgtacggaggaagatgcatgctgctaattagtactatatgcctctgatattaactgtctcattatgtgcactctcacgcaaaaacaaaaaatgatcgtcacatcaactagattctttgtttgtgagagctaagaagacagaaacgagcatatatagatgcgcaaaacaaacagaatttacaagttgcggccgagagcacagataatgctacctagaagcaaaggattaagggcgccggtgtttgcaaatgggaccaatggttgtcaacaccttgatcaataacatactgaccgaaaattgtataatttcaatgccacctaagcaagtactgtcgagccctggcgacaaacatacagaacccccacatctcacagtaaattatgccattataggtgttctccttgggttacagtaaatgagtgttggcagtagaaaaggaaggacgcaaaatggtggtcctctggtcgtacacaggtgaaggggaggtgtacagctagcaaacgatatcgtacatttccgtgtccctgacaagacaacagcgcgctgctccacctccaacctgtggtccttcatgtggtcacaaaatggcaaccatcccatccatcatcaatttagctatatgaccatatccaccgtttattatgcaaatgtctcatgtttttgggcccattacatcattgggattctcattggcttgcaatggatggttctaatcatgactaatgagaaaacagctagaaataaacagccttttgaaaatcgtcgatattcatcagtgtatagacaaaatcaaattttatcattaagggcagtggtcctttggttatactagtgcagattagttgagaaaaaaaagccatattccgacatgtcacccttatacatgtgttattaattggagtggcaatagttgcttctcttgtcacaaagcaagttggaaaaggaccccctcggcaagctcaactgctctaataggccatgacagacccttgatcacccccaattaagcaaacgaaaaaaatatatatattgctctaaaagatgtcatcagtaatttactgtttaaccaacgggtcaattttggatggtgatgtttgctacagtgtaatgtgcaagcgcacacacctgaatatctggctctaaagctccgtgtaaccacgacgacgtcaaactccatttcaaatgtctagttcatccaacagttgtggctccttcacagagagaaaaaaagaagagaaaaggaaacaaaaatgctatggatggagatactagctcagataggtgcaagtcgttcgaaaatgaggtgatgaggggcaagcgagagagtacggaagggtgtaaggaacggccgaagaggcatccacgtctcggaccggaggctggggggcagcgtgcatgattgcggtggcgccggcgcgcggctttctttcccctccacgacgttaattttcaccgcgcgcgatcgcatgcggagtacggtagccggccgcgctccctgccgcacgccgaactggcgcggccgtcgtacgtggaggtgcggccacagacagtggcactgttgatgtcttgcaaaaatagcatacgactataggagcgccactgtacgtaccaccactgcatgggcactctatgcaccaccatgccttgtgtggataacgtgcatgcatgatcaaaccagcgtccccctctatctctctctctaatttttgcaatctgcttgctatagctccctctctcctgggagctagtactagtagtgaaggtgcgttccttcatgggggattgggtgagaaagcccattatattccgcgcgcacgctttctaaactactaaatggtatattttttaatatgtagaaagttactttaaaaaatcatattattta

SEQ ID NO: 103082 - DNA, 643 bp, Oryza sativa
caagctaatgttcaaaagccttatttataactacttagtatctacttttgttttgaatgcagggagctatcaattttcaattgcatggtttcaaatttgttcgaggagtacaaattcttcccaaagtatccagatacacaacttaagttagcagctgtgctcatgggtatgtgctcattttttttatttgttttctttcctgaagaattctgtattcagatacactgatttttatctggcgctaatttactcatattgcaatgtttctaatttggtgatccgatactcatgatttaataggatatttggatgcattttttttaaactaggtgttggtgctccacatctgattattttagtattttatgttgtatttgggaagttaaaatcgctgttatgaccataacaaaatgaaactattttttcctctctctctctctctctctgcttcattgcaggcatactcttcacaaaaaaaaaaatctgtagtttgctttgatgcatggcctgttgtggacttgtggttaatataatctgatcaacaatttgcaacatcattcgcaaggctcttgcatagaaatttattaggctgtgtgatgttcttttttttacgattgcatcatttgtaattttacatgtcagg

SEQ ID NO: 103083 - DNA, 540 bp, Oryza sativa
tgttgctgctctctgcaaacctgctcgctcccccggcgctgctgctgcacggctgctcctccttgcgggcagcgcgctcccgcggctcagccggcctgctgcactgatgctatcgcggccgctccgtcacggctgcgctccgatgctccgttgcccgcctacttgccggttgccgcagagccactctcgatcgcctcgcggcctcgcgccaacgcaccatcgcccgctggcgttgcacgccgcggtgccgccactcaaagggggactcagggggaacaatgggtccggtggatgtaggggggctcaagtcctcatgtacccacgttgaatttgcccctgactagtatataacttgcatgtgagatgttaggtaaattttgctataggacatcgcgacttcgtggttttagttgtaggacaccgcgtgaagtgacttttaggaagacactctcaaatgtgctataggacatcgcgacttcgtggttttagttgtaggataccgcgtaaagtgacttttgagaggacactctcaaacgttgg

SEQ ID NO: 103084 - DNA, 601 bp, Oryza sativa
gcattaatcctttacaaaacccaaccaagcaagcatcaggcaagaatctagaagcagctattatcaagaagaacaacagaacagtgaggattggaagcaactcttccagtgtttgatttaatttccactgaatatctatttcaacctaattagataatcccccgtatcatacttcccattctccaaattgagcactaccaacaggccatctcaatttccaccgaaacccaaatgatgtaacagtcaaaccatagccataaacactcaaatcacaaccgagaaagaataggcaatgcggagctgaattctcattgcaaggcggaagatggtcaggcgcttccagcagccgacagcaaggaggccccggcggtcatcccaggcgaagaggttggcgccattggtcttcccgatgatggcgacggtctcgagcccggggaggcgatggaggttgacgtggaggcacggagtagatgggtgatgcgggcggcggcaccggtcggggtagatcggcgatgcaggccacgatagggcgcgatggagaatcggcgatgctggtggcggcgccggtcggcggcggttggcatgaggggcgaggcggcgt

SEQ ID NO: 103085 - DNA, 1138 bp, Oryza sativa
cacattgcaaacaaaacaacttcaaaaataccaccgttgaaatttcatatttaaaaaataccaccgcaatcagccaaaataagttcttgaaaatgctgtcgctgtgatgttctgtacagatatgctttttgaacctttttggggcagaagattctgtaaatattaacaatatccttttttctcctcttcattgcactctttgagattacctttagttatatttgtttctacaagtaacttgcatgatgggtgctttatgtggcaaggaaatgccacctttgccaaagttatcttgcacctgatcagtttggtccttctagcttttcaagtcaattagctaaaatctcttggtatcattcaagagccatggaacagatttaagtcatttagatcaatgatccattttaccaggaccatccttttgctgttcttttaccatcacatgcacactatgaaatatgtaaaaatagaaaaatgataggactgtttccatgcatatagatcttttggccaagttaattcaatcatgggtaattagttatcaagaagtctgttccaaatagttttggcaatatgactgtttttctctgtacaagtgaatccgttgatcttaaaagtcatgacttgtttctggatcaagctcttttgagtgacttaacattttgtgcaggtaatatattctgacgaagataagaagtttaacatcgacataattattggactaattcggtctgaactgattaatcttggggattacaatgttcatttggcgaagattattgatggcggaagaaacagtaagttgagaaagtacttgaaaagctagttcttgtttaagttgggtattgttgtatgtttggcattcaggcatagatatacctgtgttattctagcatgtagcaagtgaaaagttttcatgcattccgtttattggtttgtcagttaaaacagcttgcatgtcctgtattgatgaaacaaatagggatgtgatgaaacttatccataatttggcatactgcatccaatgttcaggttgatgaagtacttgatttagattattgaatttgaaatgttgctgagccaacttgttattgattttcttttctaacatagtttcactaatcgaactatttggtta

SEQ ID NO: 103086 - DNA, 2046 bp, Oryza sativa
ccaccccccgcgcacgtgcactagcaatgaatattgcaaacctgctgttgttttacacacacagagagaaatctttaagcatgatccgaacaaaaaaaggaatttatattgacaagagcttacttttttacatgcctgaaagaattcctggctctgatagccagatcccagacttccacactccttagtgaaatcaatgataacaatatcctcggcagtccgcactatcctccacaatgatgtgccccacaagtatatgttcatatttttgctgagccacgagggcgggagatcagatccatggttcaagagactgtctgcacattctagatcaaattaagtcccataaattaagtacaaaattacatataatactcacacgtgttaaacaattggcaatctcatcaatctgacttgtgcaaagcatgtccatatcacaaatccttggtttgccagaaataacggtatcaacctgaaaccaaagatgaacttaattattgtacttatattttttccggagcaataaagtaacgccgaccaaaattatttagattaaaggactggttaaaggtacaaggacaaaggacaacaaccatttttgctgcaaaaaggggcacacttgcaaaaggtgttcaggccttcagccttagcttgtagtaccaccgattaacagtgccaaactggatctaacacgttgcctttgttacagagcacaccaggaacaccactttacaaacaaacaaacccaagcagctcatagtaaaatcaagatatactactatccacaagattaaaaaaaggatactcctgcaagttttttcccctctgagaagctaaggggcaattatggatttagcgctgcaaccgtacaaaacgtattatagcttcactaatgatcaaccctgcgcattattcctagttttcctaaatcagaaacgggtaatttcataatgtgccagagaaagcgaagaagtagagcagcgggagcagaatcacacctccaaggccccgacgcgcacggactgaggggtactagcagccgtcgatggggctcgccgtggagccacctctggcactgtcaagatcaaggatcagaaatgctaagtctgtaggagttttagaagaagttcagagttagtcccagctcagtccagaatcaagtctgaagaagaacaagttgagggttatgaagatcctatggctgagattactcgcgaaggggtattaggagtatctgaccgttaatagttgtcggggtccactgttctctttattttgtcatttgctttcgtcagctgaatgagctgtaacttatctgtaatgggagttgtggtcctcaccgatgtaatctcctttaaaactctatgtgagatgaagagaaaaggcatcgagaatcataattactgtctaggagtagcttagttagaaccctagttctgttccttgcggcggccacttaaactgaagaattgggttccgatcgaatttggactttctccatttctactcctaggatctgacaagggtatcagagcatagttgatttcttggctcttggatcgatctggtgagggttggtggaaggcggtggtggaatccaccgtaaaattccttaagccggcgagatccaaaccggaggggagagttagggcagggattgagcaagggttggtgagccatcctgcaaaggtgtgctcctgtaaaatctccgaagctcatctctgttcttggcggcggtagatcgatctgtgaggcaaaaggggaggaattctttccgaaccgcccttgcagaaagctggatggttactaagactcattccaacgagtcgatagttgatatggaggagatgaatgaatttagattggatgttgccagcttgaagaaagatgtgcggatctgaaatcactgaagactgagatgagggaaatcaagggattgctgagggagctatgcaagcagaagaatattgaaggaacggaaggggaaaaagggctagcctcgactcaactacctcaggacaggacagtggcgcaagctgctgatgg

SEQ ID NO: 103087 - DNA, 573 bp, Oryza sativa
tcagaagtagtaagctcactaagcaaatttatgaacaaccgaaaatacggccgaggattgaaagaaactttcttttcttcagcatctctttgaataatcctaactataacagaaagaatctgcaaagaagtgaagaaatacttaatggcaatgccaatataaagtctcaaagagtcattaacaacgtaaaatgctgaccttattaaaaaggcttcctttactcggtccaatatccacagaagagtactgaagaaatcaacagaataatatggtaagtactgtccataacagagaggtagggaacataaaaaaattagttcagatatttcatgttaaataaattttatcatggttcaagatagcttttcaccgcagcatcaactttagaacaactttatatatgtatagtaacatcactcaacagaaaagaatgcaacatgttagtcaaagctattttagaaataggaaaaatccatgctaaagaaatcaagcagctatatacacaccacccaatacagatgtttcaggaaggcactttggttatagcttcttcaaaagaaatgttatgcaatc

SEQ ID NO: 103088 - DNA, 542 bp, Oryza sativa
ggattgggttttttttgggatggagggagtatatgtgtagtggatcttgctttatacagtccatggtttcagcatcaatttgttctctttgactgctttagttcaattgaggggttcactgttcacatatgatatgcaatgcctgagttaaaggttccagaaaaggctgaatgaccaaaaaaaaaaatcaacaaagagcatactttttttttttgccgaatgtagttatatattatatcaatcaaacatgtgatgggaagatatatggagcgttatctgttcgcgcataaattctacatgtttagttcgaagttcgaactgaagttgtattatcatatagtttattcttcaaggcatcaatgtttatttccattttttgtttcaggtgtttgcatcataacttgatcaagaacatgttgttcctgatatatggtacaagactcaaaatatcaggtaaatcatcattgtaatacaggattgtttcacctctaagcagcagatctcatggacagcccccaagcaggttcatgtcagtatctcag

SEQ ID NO: 103089 - DNA, 678 bp, Oryza sativa
ttgatattaaaaataattattaagtatcacgtatataaaatacagtatgaatattacatatttgtagtttggtaaagttagtataaaatttaaaattatattgaatatattttaataataaattgggaaaaaatatatatgctattatattagatagaatatattagatagaatataatgatcctagccgcgcaatttacgcggaccaccatactagtttatatgtaaacaatatttttaaatacttttcatattcctggtgaatagtacggacgcacacggatatttattgggttttttctccgttgaacagtagtacatatttatacaaacacgtgaatttttttttcagttttttccgatgaatagtatacatgcgtagttttctctcgtagcgcacgggagataagatgggacgactaatcatcttttttttaatcatttttgttcgaaaaggacatcgtattccgcgcgcacgcttcccaaactactaaacgatgtattttttgtaaaaattttctataggaaagttgctttaaaaaatcatattaatccatttctaaaatttaaaatagttaatactcaattaatcatacgctaatggctcacctcgttttgcgtatcttcccaatcttctcaatccccctctcctcaaactcacccctaagtactatttac

SEQ ID NO: 103090 - DNA, 814 bp, Oryza sativa
  unsure (1)..(814): unsure at all n locations
tcatcagtattaactatctattgatccccaagctatctaaacattcaccaggctcttaggtttgtttgttaattttggctgcaaacgaagaactcacggctaatttggatcatttcacgtgtcatcttgtttctgactttgcagggtccagagagatcatggaactggatgtgacaattagtgaaaaagaaacatcttgttgtcaggaggacgtgaagaaatgtacacagattgctttggcttcagttttccctgcctttatcacggacttcctgggagcttatggcttgcaggaagcctaactcagagatctggtcgacctcgtgtccaatgctttcttgtaatttcttcacatgcatctacttgatcactttgtttcgtgtgtcgccttcagctcggctagcttgtgatcccgagttctagaaaagcatctggaaatgaattgagttctactttcaggaagggataagcttgattctgtgctccgatcgattaggtcactaatgcgaaattgtttcatccatgctgttgaccagtcatgtctaaattctgaattctggccaaattgaaatattcatgactaaaaaaaattccgtacattgcaacaagatctaataacattagataatctaattaagactaaacaatcactctcaaactccaattaacaatgacaggattnnnnnnnnnnnnnnnnnnnnnnnnnnncaacatgttgtgcatgaagcaaatagggatttaaacatagtgctactgctgcatggccggtgccacattggtcaacaaagatggagctcatagaaagagggttggg

SEQ ID NO: 103091 - DNA, 688 bp, Oryza sativa
ctagtttgggccacttgtggtcaatggaactgactatagattaaacagttaaacattgagattatacggtttgtttgaaagctttttagaatattagggttttttttgtttgcgagaagaactataggaacttttactactgtgtcgaattcttgtgtcatgaataagttgctaaagtctagcttggcatgctgagtcatgagattaggaagatgtgcacaaaaatttaatacactgcagaaaatcagacaaaatttcttttaaacattaaagcatgttaaactttaaaaatgtacatagacatgattaatttatactccctccttcccaaattgatcatcatataatgtaattcaaaatttctcaaattgatcatcatataaccgcatggatacggatttcatcacaatacaattaatgtagcatgggagaatgtgtgcatgctaaggtgtaattggcatggtgttttaattgatgcatacattatgggagattgtgtgcatggtgtcttgattgatgtgatttaaataatccttggtcttggtgcataaatatatatgatgatcaatttgggaaggagggagtattgttttctgagttgtatgatggcatatgttgctggtttctgttgtacataagatattatctgaaattattaatatgatgcattattgaattattacattct

SEQ ID NO: 103092 - DNA, 914 bp, Oryza sativa
atactaaatctcacgaggagtgagctatactaactctgttcttgaatatacgacgttgtttactactgttagaataaatttataaaaaagatatttaaggtacttcctccgttgggctgtgtacatttattgtggatgtagaggttggattttaatctattttctaaaaaaaaagtacttcctccgttgtttggcttttttttcttaattaaagttctttagatttgtttaaatttataggaaaaaatagtaatatatatctacaacaccaacttagtttaattaaatttaacattaaatatattttgatcaaacatatttgttttgtattgaaaataatagtatataaaatttggtcaaattttaagaagtttgactaagaaaaaagtcaaacgacttataatatcaaatgattgaattattaaataatgcgataatcaaatatagaatgaaacaagtgtagtgttcttttttttatcttactgacagctcattaatcatattactgatgactgatgcgtctgtattaataatggacaggcaccagtaacaagccatctagctcatagtaatatcatataaatatagctattaaaattgtcaaatgaaaatgaagcatattcagaagatcctgcctctgaattaatacccagagaaaaacaaaaaagagagaaagaactcataagccataagccaaagattattactggctagctatatatatatacacagaatcacaggtcaaaaaggagagagagatagtagtatagtagtactacatgttccacaggagcgcgccgaagccggacgccacgacgccgtccgcccagacatggtccagctcgaacccgagcgcgtcgtgcacggcaatgccgccgccgccgccgtcctgcagacacgccgccggctggtcg

SEQ ID NO: 103093 - DNA, 1667 bp, Oryza sativa
caattacatggtttcaatacaataacctcccagaccttacctcctttcattcaataatggaactaatggtggtcagcagaggcaatgaaaaattcagggtttgtttggtttaataccctaccaaaatattggtagtgccaaaagccaagtctcggcactaccaatattttggtagggtagagttgtatttggttggagaccaatttagaacaagctttgagtagagtatagaaaatatcaaactagacattggcaataccaatgatttggattcaaaccaaaactaccatatgcactgttcaaactaccataatattggtagggcaccgttttggcactaatccaaaacggccctcagaacaaaggagaagctttggctaactaaaatctttcatctattgtggaacatctggaaagagagagagagaatgaaggatctttcaaaacttctccactcatccactccaggttgcgttgtcatccgcgagagtggttcttcacttgaaactagctgtctagctcaaagaaattaactgatcatctttctgtttttctttttggcttgctcattcaacaatccttgcactgtcatgatacgcagtcccttgcctcatcactcgagttgtatattaatgtttcgacataaaacccacaccattgtttttggtgcatatcccggcaacatatttcgatggaccaaaatatagatattgggctccattcggcattgttacagtttttcaaaaacagttactgattttctattttgagattaattaaggaactagtagttggaagcatttttttttgtaagtttcagattagattttcttaggcaacatatatatttcaaggaatgctactagcattgagaagatgagtgtaagttcgataacactatgcctttgtaatccgtcgaagaagtccaagtcgagccgcaagcagggacaatggtgctctatctatccttacaggagaatagaaatgaagttggtagtggcggcgagatagagattattctgttacgatagatatatagaattagaattaggtcacagtcgcacagacatataatcaagagatgctgagataaaattgcatggcgtaatgcctttaaagcattatgcatgcatgatgatatacacaccttgcttgcttttatgctctgtcgtctccaagaataatatatgttaccacttttttttacacatatggcgttaacattggcctgttacatgcatgcatatatggatcatttgcttgggaacaaattaaactgtggactatgtgttcattcagttaacgtggtcaattaggcttaaggcttttggtctcagggtggggattgtattgcaactgggcaaatttaaagtggtatcatggaagtagctagctagctatatgtgcacgtctgcatggtttgctgtctgggggctgtggctatcaaagttgctttagcaactaggggctactgaataaacataaagtacaacgtgattaaaggagaaccaatcatggagaggcttccattgttccttttcggcgaggtcatgtcaatttcaacagtaagagggaaagcatccaaatttacaatgtgaagcgaactttgctactgtttttttcatcagaactttttcaaataagctagcaagttgaagggctgcagg

SEQ ID NO: 103094 - DNA, 636 bp, Oryza sativa
cccctcctccctccccccccccaaaaaaaataaaccctatataagtagggcaaggagtccctcaagggcataaaccacaacaagatcatcggatcagtacaatatctgacagatacaattcctaaaatagaaatagggtattacttctcatcgagaagacttgaatctgtctaaatctttatcactttactcatctactttagatcttatgtggtatcccttatattattgccgattttccaaattgacacatattttccatatctatactttctatataattggtacccactaacaattattggaaactaaatttcaacatgcaagcatgccacatcatcacccactaacaattactattctagcctatttaaaatcgcatgcaaacatgccacatcttcactcactagcaattactctctccgtcccaaaataagtgcaattttgcactatttatattcaatgtttgaccgttcgtcttatttgaaatttttttatgattagtatttttattgctattagatgataaaacatgaatagtactgtatgtgtgactaaatatttttaaatttttcaaataagacggacggtcaaacgttgggcacggatatccacggctgcacttattttaggacg

SEQ ID NO: 103095 - DNA, 1473 bp, Oryza sativa
ccctcactggccactgtcgttgctcatatcctattctctcaactttatctgttgctattgtattcttggtgaccaacagtggcagagccaactagaggccacgtctagagctcaactctattttgtcacctagctaaattctttacaaattcatacatttttctgaattttatataaaatctacatggagtttggatcttagacctagggtttagggtttagctaggctttaggagtttgagccctagtcgtcctaggcctggttccaccccgggtggccaatgcgttcatgctgtcctccccaatcccgtttgccatgtcatggaatcatctcggatcttgcagccttagaggtagagtggctcagggtggtgcgcaccttcaacgattgagtgacatggaagtcgtagaggagcaccagatttactaagttgcggagtggcttgggtcagtgtctttaacgataaatgatggtgaagttgttagatctacttgttgctgggttaggccatatcgacatattgacatcggagtggctaggctccagagtctaatctcaacggcaaagagaaacataagatagaggtgactcatcgaacaaacattcctagttttgcttggtgggacaacatgttcacacaattcagcttcctaagcgatggcttcatatgttggagttacttttagctaggatatatacctatgtcatttgcagattatggagatggcacgaggttacccgttaactagggtttagttctaacgtgagcctaaatcgttataaatgctctattataatctattggtatagcatctcaaccactattcacgcggcatctattagccctattcggtaggcaggtgtaacatctggctgcagccagccactattttttttatttgttatgcttgcttcactgttcctgcgggtacagcagcactgcaacccttgtagccgaacatacccattgttagtgtagctcaaccactgtgtataggataacctccaatgatccttctggaacgggaatatcaaccaaaccaggtgagattagaattaattttcttaaccgattctcttttttttaaaaagaaatctggatcaggatcgatcaatcaagcggtttctagaaaacaaaccggtttatcgtcacattttcagtccctgttcgaacccacaaaagctgacatgcacgccagtgtcgccgatccagtaggaccaacaagcaatttgcatcaacggatggtcaacctccgcttttcctcccctttccatgcggttacagctgccgaaggccgtagaaaccaccaccacagccacatccgccaaatcgcataccagccgaacaaaagcaccccgtccttctttcgcgtgcccgagcacaccgcttttatcaccacccccgctgtcagcatcccgaactatcttatatatactccatccctcccaataatataagaggttttagataa

SEQ ID NO: 103096 - DNA, 1869 bp, Oryza sativa
tggttccaataaaaccaggactaaaaagcatctttagtcccagtttaaaagcttaggggtactttttgatctttagtaccggttcgatcattaccaaccgggactaaagatcatttttagtccccgttgaagaagttgtcagatcgtcaggccccaattatctttagtccatgttggtataaacaaccgggactaaaaataaatctttagtcccgattgcttataccaactgggtccaaaattcaccccaagccacgtgcatatctcggtcgatctttatctctttgcgcatctgtctgtccttcctcccttggtcttatcccttcttccccaccactcattctcctcctcctcctctctcctcgctcctcttcctcctcctccccttcccctctcccccgtcttctcggtggtggcaagcggcggccggcgcggaggcctggcagcggcggctgcccgcgcggagggcccacggtgatatgcggcggaggtacggagggctgccctggtggcgggcaagcggcggccggtggcccagagcggagggccgcgaggcggcatgggatttttttttcctttttttcttttttccttcttaatgtgatgtgaatgattgtgatttgtgcgatctgtgatttgtgatgcgatctgtgatctgtgatttgtgaatgatattgagagatatgtgatatgtgaactatctgttatttgtgatttgtgatgcgtatgtgatttgttagtttttaatgatttggagatattggacgtgagaaaagaaaaaaaaaccttagtcccagttggtgggactaaagatttagtctcaattggtgttactaaccaggactaaatatccatctttagtcccaaattgttataccggttaaaaaaccaggactacaggggttaccaaccaggagtacaaaccgtttctccggtagtgtacaatcctataaaatattattttaagtaaggttgattgcaaataatataaataaatatgcttaagtttacgtaaaaaccaattacatttatcaaaatcaatttatatgctttaatttatacaacatattattattgtatataaaatttgtacttttaaaatatagagtatcatgatcctatggtactatctcaatacttattaccttttctttgtcgtattttaagtgcagtcgtggatttttatgtataacgtttaaccacttattttatttagaatttttttgatgattaatatatttttattactccctctgtttcaggttataagacgttttgactttggccaaagtcaaactattttaagttaaactaagtttatagaaaaatatagtaatatttataataataaattagttttatcaaatcaataattaacatatattttcataataaatttgtcttgggttaaaaatgagtctatttttttttacatactttaccaaacttaaagcaaacttaaagcagttaactttgagtaaagccaaaatttgttataacctaaaacgacggagtagatgataaaacgttactcgctctatccaaaagactaaattcttggtttccatgtccaacgtttgatcatccatcttatatgaaatttttttatgattagtattttcattattgttagatgataaaacataaataatactttatgtgtgacttatatttttatatttttttataatttttttaaataagatgaacggttaaacgttagagacaaacattccggaattgagtttttttagacgtagggaaaactgttcggctgccattgtctacagccgcgggtccctcttgcccgcaccgcgacataccgggacaccgggtggggttccccggagcgggggggggggggggggc

SEQ ID NO: 103097 - DNA, 656 bp, Oryza sativa
aataattttcatactaaaatgttagacacacaaagtggtatgcagaaaagcacaacaatatgaactggaaatatatgggagtatcacttgatattgttggcaatgaagatgacagtgaaaaagggaaatatggggaggtaatggtgtcaactttgctgccctaaactttgccatctgaatggatgaatcatgattaccctcgccttagatataggtagaaggacagtaaagcgagagccgattcaaaatggtaagatgtggtcggcaaaactcaaatagagaaactagacgaaacagacagcgatcatccattatgatttggaatagctggaggattgatttggtcaatagctgacactccattgtccaattcatcatcctcggattcactctcaataagctatccattgcatgggcgctttgttgtgaggcagtgtgtctagctgcaataacagggtgtggcactggaattgtacgtaattctccggcagcagctcgtttaaagttgttcctccttgatgctacataaacaagggaagccaaatggagaattatgagtcgtttggcaaccaactaatctaaacatcttatgatagggagtaacttgcagcatcatacgagattagacaaatatagtaaagatattaaaattgagt

SEQ ID NO: 103098 - DNA, 1046 bp, Oryza sativa
gagaggccgcgaccggattaattaatcgcgactggacagggagtgtgttagttcattttgggctaaagaatgggtggttaattggttgaaccaactggacggtttactttaaagggcaactgttccctatcacccggctatgatcggccgatggatgcttctatgaaacagggtatgaaaagatggtgtagctaatggaggaattttaacttgttaaaagtggcaccaacgacctacctgctgtctgtgttggggtgtataaaaaggcggcacgcccatgtgagtgttggtggcgagaggtaatacataaacatgcatggtgatataagaatgttgctttgttacatattcttctctcatctctttaataaaccggtctttctagcttgggcgtcgaagaggtgacgggtaaggatcgatcggttaaatgggataattagcttggggacccaagcatgtacttgcgtgcaaccgtgcatggtcatatacaggcgtgcacctacgtagtattcagagtgctcagctcagctcgcgcgaaatcacatagcacgacgattttttttttattttgaagacgacaatactttgcaatatcgtttggatggaaggttggcagcacagctgcacaggcgtatatattggcatacatgcgttggcatattgtgacgtgaaaaaggggcctgcatattttcctgcgccgccacgcagagcattagggaagaaattggtggatcacgggccacgcagtgcatgcatagcagtcgcactcgcgtagcacgtacgggatcgggtaaccgactactcctacacacgtacgcagcgctcctagctagcctacgttcacgtacgtacgcgcgcatcacatcacatgcagtgctagacttgcaggaagccggcgctcgcacgccgtccgctgcgacccgcgcggagagcatggagcgaggcgtgcgtacgtgctcccaactttttcacctcggattcgagcgagccgacccggacccgtgcccgcacgcggagcggtcgttgccgcgctggtgctgctgcta

SEQ ID NO: 103099 - DNA, 1790 bp, Oryza sativa
cgctggaggcgccatgcgaatgcgacaagaggagcactacgcggacgatggagccatcgccgtagcggatttggtcgtcggccgagttcgtccaggacgacgaggtgttcgctgccggcaacgtgggatcgagacactgtgctagtagtgagccgccgacgaggaggatgatggctccagggacggcagacaacagcatcatcgcgtgggggtgctgcaattttttttctttttagtgagcaaggctaacaagatcgaagagtccgtttttgaaagttgtgacttagggtgcggttagttcgcgaaaagaaaatttttaagtgtcacatcagatatttttttagagagtcacataggatgtttgaccggatgccggaagagattttcggacacgaataaaaaaaactaatttcataactcacctggaaaccgcgagatgaatcttttgacctaattaaaccatcattagcacatgtgaattactgtagcacttatggctaattatggactaattaggctcaaaagattcgtctcgcgctttccatgcaaactgtataattagtttttgtttttatctatatttaatgctctatgcatgtgtccaaaaatttgatgtgatgtttttggaaaaataaattaggaactaaacaggccttagcaataacacataatatttcgctggggcggcgaaccatagattcagaagtctgaactttttaccaggtaataacccagggtcactcactcctaccatttataatactgtcactgaccagttgacacttcgatgtttcgttgacgtttaccaatccaactgcttcagcgaactacgaacgcactgtttgtgtcccgctcatggttttcttcggttccgtatggcgaagatgaagccaagtttacatgatttggtataattttacgaatatatatacaaagtcgattacaaattaaaacttaaagttataataacgagacactaccaattatagtcgcatagtgacaatagtataggtgtggccacgactagcaacgacatagccagccgagagttgtgatatctggatacaatgtaatatgctaaattagggaggagcgcatgtaatcaatttctccgaaattagctgaaaggtgtattgtgttgggagagttagctctaaaaaggtgtttttatagaactcaactatacgggaactcagttcctcctggtcagaaattattactccatcatgctatatggagtgaatttggcattttcctcttctccatcagttgaagcttgattgcttcaacatacggatcgacaaaccaaaagttcatactagaggtaattaataggtttcatgcatttaaactgatctactaataaccctagcttgattaattggactgtgcggggatgcgattccttattcgacttggtgttgtgcatgatctggtgcatgcagcgggagacggatgcggcgatcttggcgcatggagccgggcggggacgaacgtcaattacagagaggccgcgccggtgtaaaaacgctggcttcctagcttcgctaccataacagattgtgcgacgaacagactcgtcaaaatctgaaacgggatgggaaaagtggcgacagacgaagtactagggaatcactatcaattttgttagtaggtaaagatatgtagagaaattttaccgtccttgaaaatatatctcaaagtaccacgattttatattaaaaattttagcacctcaagataccaagtttttacgctagaaaatatggtatcttcccgtactttgccaa

SEQ ID NO: 103100 - DNA, 2818 bp, Oryza sativa
tgtagtagtggtaccaaggaattgcatggtcaaagctttagatgtataattaattaataactgccctgtaacaaatttgaagtgttagtttcatcggtcatgaaaaaaatatagtactagatatattacttccatatatgttactaaatttccttcctatttggacaaagactacgcaattacccaaatcttccctagcatactgtttatagcattatattcaaacatacatactccctccgtttcacaatataaatcattctagtattttccacattcatattgatgttaatgaatctaaataactagacatatatctatctagatacattaacattaatataaatgatagaataactaattacattgtgagacgaaggaagtactatagaactctatagacgagccccagctaactaattcagagttaatttcgagtcctgatgagatcaggctgtccccttcacgtcaactcaacatgttaataagtgtatcatcacatcctgtttatagctagtatttatgcgccgccactaaatccgagtgctgttagaagttgccttaattaattcatcaatttgtgattattttaagaaaaaaagatgaatttgttctgttatctccataatttagtaatgcatatatgaaagtaggtgaaattggtagagcaaataaatgcccctctgaaaaaaaaaatccctctggtttaaatgatttagttattgaataaattaatactcctataaggttaattgtcccatttcattaatcctttgtgttcggtcaaaatgcatccatttctttaaaaaaagttcatgattattatatttattctgaaatatatattatgtcaattgcatggactactggtccgattgaaccaaaaattttaaattgataaaaatgcgggaaatcctttaattaattgcatcagctaagatttgaattcgagaccaccaattcacttatgctatctaagtcactttacttctaaggtttgtaagttggattgagtttaaagaaaaatataatatatagcaacttttctaatacaaaacaaacatattatcaaaatatattagatgatagttttaatgaaattaatttggtgttattgatgttattaactaatttcttttataaacttatcaatcttttaagaaaatttattagtaaaatagtcaaaatgatttataatatgaaatcgatgagtagtcaaactctccatctcagatgaaaactcccttgagccttaaatatcgaattaatagaggtgggctgtactgtttttaattgcgtgtcagcaagtattctaacttgatattgagctgcaagtaccattcaaatccgaaagtaaaagtaactaggaaaaatggtcaattcacctgtactctatacactgtatattgtactgatgttcttgtgagcttattatttggatatctttattgttaagttcatagaagtgaaagcattagtactttctctttcctcaaaacaaaaatggcggcgggttccattctgccattaatttgcaactcgaaatgtagcagtgacatgcagcttaatttgcaggcagcacctagtggcaggaaacctgcaggattttgctggtagcagctagtataatgtttgccattactaacatggattgatggatgtatacataggtaccagaacatcttacatatgcaaaatgcaacaactagtagaaaactaccagaacattttacatatgcaaatgcaacaacaactagtagtactagagaagtgccattttttgaaggatttttatggtacaatatgctggtagtatatattaccagtataaaatgaggtgttgggaatctaccgcaaaaatagaaaatgatcaatagttattcatgctatattttcactccgatggtaatcataattgtccatgcatcagatcggattactgaccggatacggtcgaatagatggcacaatcatatgctcttgatagaatcgatagattcatcaaacacataaaaacattaacccagataactagagaaacacataaaacatggatcatttacccttttaattttatactcattcgatttaagcgggtagaaaaatcaatctacaactcttggattgtttataatggcaatatatactaccagtatagtgtacctgtaaaaagcaccaaattaaaataggagtacataaaccaaaaccaatgctggattaaacataatagaatcaaagtcactggattagccaaaaaaatggcagacaacatcgatcgatcatgtaatgccattttcagttgagaaacataattaattaactggtctagaaaaccctaaaagaaatcaatgatagatatatatttcaattatgagtaacattctacaatatttacctagaaccaattgcaatacacgtacgtatgcgacgtcgcaacttccattttggcaaattaaagggccatatctaattaagggcatagtccgatctgattaagtagatagcgagtaggtggcaagcgccgaatccaatttaatcccctccgtcgggtacaccattttagtgctgatagtgccatgccatgcatgtcccttgtcataggaaataagccatcagcagttttgtactactggcctgcacaaggaagctatatcagtggttttgtagaaacatgtgctttatatcttagtgatcatcaccaaagccagcctccaactacctagctatataaggattttcatactgtaaacttgagtgtaattatgaatgcaaatttcactatatataggagcctcaaaatttgtgtaatttactactg

SEQ ID NO: 103101 - DNA, 696 bp, Oryza sativa
tgccccttatcctttttgtaggtggacctcttaagttatcgcctgtgaaaatcagacagaccacttaagaggtctgtcttgtcccacggttgtcattttcagaggcggctttttagctccgattgagaagcctacttgcctagaaaaaaaatatcattgcttggaaaaatatttttttactatgtttgccactattttaaaactttttttgaaaccgcgcccaaatgccaagttacataccagggtattctattcagatatttgggcaaaaaatagtcagatttctagcctttggattacacagatcaacaatttatcagcatgttagcgttgatgatatttctttgaaagttggagtctgccatcctgatacatctggaaaagatatatgatcaattcatataaacatatttcactcaaatttcatttttttacggtcaacatctaatcacggtgtaattataccaaagttataatgtacgcataaaaggcaggccaatgctagattagcatacatgcatggagcacaaatttagctgcccgtttcagtcggatttgcaagacttcagaggttagcatatttaattttgctcatttgctgcatccatggctcttcacgaggaaaaagtcggatggaagcgcccatctcaaaacagatcaaacggttagaaaactgactataaattttaaaaaaaa

SEQ ID NO: 103102 - DNA, 1661 bp, Oryza sativa
ttttttctgcaaaagttgacagcaacagcgtggggtgtacagtaaaggcagggataaaagaactgcacaatcataagctctctctctccttttggattgtcttctagtttagagtcattattattatttgtatgaattttgtcttttatagcagaaaagatattaatacaaacaaatgcatggacattagatcaagacccaaaggacagaaaaaagtgaccaaaagatgacagaagcttgagtcaccttaccagcaggcacccacatggtatacttcgcgacagtgtagtatggtctgtgtacttgtttcacattttcagcttggtagtcatgaaatgaacttagaattaaactttctagtttatccttacagaagaactacatgtaccgaaagtgaacctatatgagttaagagtggctttagtttggtgggctggtgtggtgaccatgggttggacctatcctgtgctggaaacatcatttctagaaagaacaacgtgttgctgggcgcagccacaagtatgaaagtcggtgacgatggtggccagggtacttattcataagaatgaagaaaagagtagtgaaaccgaccccgacagaagtcggcacagccagacaaacactctctctctctctctctctctctctctctctctctctctctctctctctccatccatcccctgatcccctaagtgaagacgtgacatctcttgatgttgtcccagaaagcaatcaaggaaaggagataacctgtgggaggagctcgtccggagagaacaccgtccacctcctacacattccgtcgaacaggtggcgggcgcccacgcgacgggactgtagagaagcgagagacaccaaattacaccactgaaacacagagaagaaacaagagggcctccacgcatcggcgccgcctcacctcactcgccgtcgccggagaagatacgctccccgcaccgccgccgctggcacaccaccgtcgcgcgctgcggtgcgctgatctgatcgctgggctagagggtggatgtgactgaattaaattaactgggcttaaaatgaagcaactaactgaattgggcctggttacaaagcccgcacccacctgagcccatcctatttaggaataagttcaccgaaggtccctcaacttaacagcgagattttttgaagtccttaaccacaaaaccagaaatgtttacccctaaacttactaaaaccgttcactcaaggtcctacggcagtatatataggtggtttcgctgacgtggcatcctagtcagcaattttttttaaaaaaaaagtacatgggacccacatgacaactgcacattttttttcttctcttttcttctccttctcttctcttctctattcctcttcttcagtgaaagaggccggcggcaggcggagcggtgcgcgcggatgcgggtggcatagcagagggcgagcgcggcagcggagtgacggcgggccgagaagtggagcgcgagcgcggccacgggcaaagaagcggagggcgagcgcggcggcggagcgggcggagggcgagcgtggcaatggcacacgattaactgcatgatgcatgcacactgtgcagtatatatgaacatgaccgattgattctatctggtacgtgctgctgctgtcggtacgtgctg

SEQ ID NO: 103103 - DNA, 1707 bp, Oryza sativa
ttatacttccagatcaaattctaatcatctcattccatttccaaattcttaacattgcaatgtaagtttacatgaaattaagggctcaccccaccattacaattcatgcatatgcttatgtacacagcagttagaggccattgccaccacatccccgcccacagcaaaacaaattccattacacaactagcagcacatgttattccgcattacatgctcgcacggtgagagttccttcatgctggaggaggcgccgttgtcgcccccatcaacaaggcaatgcagcctgtcaagacagtttgtctagctacaggaacaaggagtggcactggagttgtagcatcaagcagctcactaggaattgatgccacagtttttggttggctcatatgcagcaggtgcctggtggcacctcatcttgtgaggtttgcacgccattctccagcagcaacagctcatctaaagttgttcctccttcatgctgcataaacaagggaaacccaatggaaaattatgagttgtttagcaaccaactgaactaaacatcttatgataggtagtaatttacaacatcatatgagattagacaaagtagtaaagatactaaaattgagtccattaagcaagattaaaattgagtcaatcttaccaaatatagggaacacaaaaattcctttgttaaaaaaaccaaatttcatatatatttgtaagaaaacaaatactttatcaaaattgcatcataccaaaattttagtaatacatatagcacctagcagtaacacaattcgggtaccaatccaaacgtatattttgcatttcacccaaccaaaatttgtgatggcatcaaaccaaaccaatctacacttaataaaattgagttgtggaatatagattgtttaaggaaacaactaagataggtcctaaagatgatgttacatacaaacaattaatcatgctatccatcatttttaaaaattcgtcggcaagagatctgtcagatatattaagaaggggtgatagagtaaaaaaacaagttattagagttattacatcagacaacagaaacaacatgagagaactaatgggaagaatacatcaagaggaaggaaaggctaacatgcgttgatttatgtccgtagtggttaggttagcatccatggtttcatctgaataagtgtttttgaaaactcttttattcatctctagccatatgttccaccataagtgtttttgaaaactctttgtttctggttgtgtcgtcgctagtttatttcaccatggttgaatcaaggcttatgtcccagcttggttaaaaaatttacaatcgtaaaccagataccaaaccttctttgtgaaatcacagttcctgaaaaggtggtaggtattttcaaaaggctatgaacatagggagcatatccagttacacgaccaatgccttatgtgcaagttctccgcggtaaattctctttgatgtagtacaagcacaccgaagaaacgatccttcggctctgcctgtgctttccacaacatagggaagttttcatccatttttgatccatataattgcaaaaggtgatttgctattaaactacttgaggttgataacttacagaatagttattccctaatcaagtatttcatagcaatggacccaactctaatggagtcaaagagtctgagaaggcctatcgaggatacttggaccat

SEQ ID NO: 103104 - DNA, 657 bp, Oryza sativa
ttgaaatataaatttctcgaaaaccattcgaaatttcattcggcatatgctttcgccccatatagaaaccttcgaatttctcggttttcaaccagttactgttgagtgctacaaatcttgttgtaaagataataaagtactaattggataacaaatcaaaagcaacccagacactctgatatcagtggtgttgcgatgtggtaggaaagaaaccaagtgcagacaatgagcttctataattagggaacgatacacaacatgtgtaggacaatgacagcaactcagcaagacaacgtaaacatcaacttggacaaaggtatcctaaaaagggagcatgaactttgtaatactagcgacttcaatcataaaagacataacagaatccaatcaatgatccacgtacaatgtacacacctccgacagaagtacagagacaacagtcatagcaaggacagctaaaacttgttacgggagcacatggaaaataaaaataaaaaaaattaaagaactcctttcctgcaagcactcctttcccttcccatattttcttatcaattctaaagaaaaaatataaaaagaaagaataaaaccaaagtaaataaaagaaaaaagttaataagttgcataagctaacacaagttcagatccctgaaagag

SEQ ID NO: 103105 - DNA, 629 bp, Oryza sativa
atcttataaatctctgatagggggactactagtacctgcttactagcaccaaaacagagacattagatgtgagatgtctcctgatcagctttactgttcctgctttgcagcgcagtaattcaaaaggcgaacccaccacccccaccactgtaacaatcacgggggagggagtcgcgttgcgtgcagtgccgttgggtcggcggtccaaacagtacagacattctacatgcagtgagtgggtgaccgcatgcatgaaaagacgttcaccccaacatgcgcgacggcaacatctcgctgccgcagccagccagtgacagtcacagggcgaatcgaggaaagaagaaaagaaaaaaaggaagttagcagtcgtgcaaagcgaatagacaggacaggcagtaaacgccgagtcgtacatggcctgtgctctcccctccgagaaagatcccccacccccaatcccgaggcgtccagactccagactccagaccatccatccatctcctgcggtcacgcaggtcgtctcgtctcgttgcttttttttcctcggtggcccggtgcgatcatggatcggtggcggtagtccgtgaatttgcgcgtgtgtggccgtgggctgctttttcccttcccgt

SEQ ID NO: 103106 - DNA, 595 bp, Oryza sativa
aagctgaagctacccaactctgcaaaagcttctatctaattaagctagaaaagatgcagcaaaaaaacacacacaccccaaaaatcaagtgtgtaaaacatgctccctttctagcctaaaaattaagaagaaaacattaagcaaagcttaatttatgcttgtagccaagccaaaagctaagtgaaattaaaaaaaccaagaaactctctagttgatgttgacgcgctggctgaactcgtcggtgatgaacggcaagcagctggagctgcgtgcgatgccgccgccgccggcggcgccggcttggcgggcctctcgggggttgatgctggagcgggagcgggggccgagcttggagcgcttgcggaggatctcgcgcatggcctccgcctggaagagcaccgggtgcgtgcgcccgaagccgttgaagcgcttgcacacggcggtgtgggcgcggagcgccgcctcgacgccgccggcgccgccgcgcctcgccgcctcctccgccaccgcctccgcgcacagcccgcacaccagccgccccgcgaaacgggcgcgcacgccgcggatgtactccggcgtgcactcctccgacatg

SEQ ID NO: 103107 - DNA, 735 bp, Oryza sativa
gacgagaaaacttgtgatcttcaattgcctgtaattgtatttgaggtgccgcgtcgtcgaggaagagctatgcaatctatattttcttgtgcgcatctattatttctattgtctgtatgtaattgaatttgtgtatcatgtattttagcctgcaaaaaaatctggcaatcacgttagtggagtgcgctaaaaatagctaaaagaaaaccaggatagaatctgactcggggcgctaaaaatagaatcctggacaaattagaattggtgtgtatgggcttatagaatttggtgtgtgtgggcttatagaattgtgggcttaatcctggacaaatcagaaccggtagaattctagacaaattagattagatagattagattggaattggtgtgagtatgggcttgtagatggacctagaatactgaaatcagtttgggcttgtattgtacttccatatggaccgaaccaaaacagaatcgggcggatgaatcggatcggatgagtttagcgcgattaatgatggacgaaaatccgtgattactgcgatgtgacgaccggaaaaatccaaatatttatattagttatatatgtgtgcctagattcattaccatctatatgaatgtgggtaatactagaaagttttataacctgaaacggaggtagtagcaatgtaatacactaactctaagtaaaattattttttataaggatctagttggctaattaatttctttgaa

SEQ ID NO: 103108 - DNA, 1402 bp, Oryza sativa
tgcatccatttctcataatatctacagttcgcgtggctacagccgagacgcgacgtcggtttcagatacaggaaacgaaacctgacgaaactgtaaatatgatacgaccgatcgggtggctggatgagttcagcatgtgaagctccaggctttacgcagttactgcgcatccaagttgataagctataatgattaagattggtcaatttattactactttttttttctgatcaagagaaaatgacatgaagctgaaaaaaagctgataagggtcaaggcctatgcatgtatttggtatgataagttgatgcctttttttttgtgaaaagcagatgagagagttcaaatgatagcttatcacttacttatcgcttgccctttttccccccttgaactctgaatatttctgacaaattaaaatttgttggatgtgtagagctttgttctgggctgccaatggaagttgcaatatatatgggatctgtactgaagaaacagggactaattatattggttcagtcaatgacaacaagtagctaaatcctcattttgtttggtcttagacagtactgttttacatttgcacttaacagtgtccaaattgcaaacaagcaaattgactttcccatcagagatgcatgagaactgatgaaaccataacagccacaagatgcaacctgaacggtatgtggttaatccctggccagtgctaatatctggcaaaaaggtacctaatacaatctaaatctcttctctcagggtgacacagtagctagctagcatcgatatctgatctcggaatccttctggatttcgttaatctgaatcttgattattaagctactgagaacagcaaccactaatcagtagttcagtactggtcgtagtacaactaacagtgatcagcagcggagggagtctggacagctaccttccagagatgtctcttggcgagctcctcgtgaactacttgactcttctcttcatgcgttttcttcagattgaaccctggccatgcatgcttacaattaatgattaccttttcataaagattattatttttagaaattattcgttgtccattattgttttttaattagcatcatcggccactgtttatataacttttgtttttttaatggaattacagaacttctgttgaaaatcaatcagttgaattaatcagtcatgccaagagtctcaaacatggtaggaaattagtttcagaaaattcaaaccatgacaaaaagaagaaaagaaagaaaacagatccccgacaaagaagaaaacatactcctgaaaatgcaaagtcggatcaaaattactagcaatatctaaaccgcaaccacaattggctacatttcacaatcacctttttggccattttgcaccttaattaatt

SEQ ID NO: 103109 - DNA, 605 bp, Oryza sativa
aatttacatagatttaattaccttaggaaatctccaaagcagcgtgtgtttttttggccgaacgaagccacgaataattggtagccatatgtacacagttgcagcagaagttctcacatccacatttgcctagatgtagttcactagtgaactttgttgcctgttctctgctatagttgccgcgctggagaagatccctataggtcaaatttaagcaataacaaacgtgtggtatcctatgccaaattgccggcacaacacaactgttgctcagcctggccagatatggtgatgaacaaggtaaaatattcagtgtccccgcaaaaaaaaaggtaaaatattcagtgatgatgctgactgaacatctctgtatactattatcggactgcgccagcatgtactttcacaatgtttcttgacgggctctcagaatgaagtgcaaatactacacctgaaaaaaatttcagagctgtaaagagtgctagctagatgcttagatgctgtcgcagtaaagaatcactaagtagaatcagccggtatcatgaactatctatctgtgatagagaccagcggcgcgtcacctgtaatacggttatcgtggttac

SEQ ID NO: 103110 - DNA, 923 bp, Oryza sativa
cgtccgccagctcaacacctatgtcagtctcgtcactcccagttctatttcatcgtctcatcatactccccccctctctgcacttcacatcatgctgccatggattctcagtggtacccaactcaaagtgagttctgaggggcttcggccatggcccatggatctgagctacatggttcttgagttcgtgtgtgcgtgtgttttgggagattctttggaagatgagataaaaaattgttgtggtggttggcatgttgattttgtagacttggagagacaggaggtgagaggtgaggacaacagagtttgggacccatcatttattgttgtagccttaaattgtacatatgcgctgttgtaaattcagctagctgtacatcttggtgtactaaaatctgtagaacaaagcaaagaatagaattcattcatgttctgatgttcttttttcccttttgagtgtgctgcatacttttttaagtgatttttgctcaaatcatggacgtccggaacatattcattttttgcgtcactcagctgtacttcggggaaaaaataacgcaatttggaaaattaatgctggccttgccaacggaagacgatttcgatctctgcacctgaagaaatcggtagtgagtatagtttcatgtttgtgattcgaggttgttcacaaatttcatccgggaatacccaagagatccaattttgtctagctctttcaatttccatcacattgaactttcctacacacaaacttttaatttttctatcacatccttaaactaagggtaagggtgtgtttagttcacaccaaaattggaagtttggttaaaattgaaataatgtgatggaaaagttaaaagtttgtgtgtatagaaaaatttgatgtgatggaaaagttggaagtttgaagaaaatctttgtat

SEQ ID NO: 103111 - DNA, 1463 bp, Oryza sativa
cccgaagctacccaaaccgaccaaactgattcgtatttcagaatgatgtattgttctgttcagatttgtttgatttgattccttgttttggtttctgggagtagttgggatgctcgtcttatacagtattttctaggatgcaaaatacgtagaccaaaatacattggttatgtgcaaatgggggatgaaaaaggggatcagaaatgaaggaaaaggttacacggtttaaagattctgctaggacgtgtgtgtgtaatatagaggattggttgcgatgtgtagaagaaatggtcacgggccacggcagcgcatcttgtaccgaataatgcagctttcggacaaactaggtgttagctgccacgttatccctaaagagcttaattgtccaggcataccaagacccgtctctgaaattctgtatcaactatctactgatgtttagcacgtgtaaatggagtttatactaaggaaaatagtttacagtagttaaaatggaagtactttgtttttataaaaatgttaccaaccctgttaagcttaggcccagtaggagtaagcggcccaatccacgcgtcagtgggcagagtgggtggcgtgagtgttcagcctgtgtatataaaggctatgctgtaatcgagctagttatcgaattgaaaatagaaaaactaatccccaacaacctctgcttcttccctctctccctctgttcatctctcttcctccccaagtgctcggtcaaattcctgagagaggttgtgacaaaattggtatcagagcaatcggccctggagtatcttgagaagccacgctaccactgtcgtgctcaactcaaggtccaggagatggagcagcagttgggagatctcatggcagccatggaggcgattcaaaaacataatgttgcaatccagacttcggtgggatcaatagaagaaatcaagcccatggttgctgagttggtgggatggaagccaacggtggagaagacggtggcagagttacgcgacgagatgggagaactgcgctcacaagtccagcagctcgcgaagaaccccatgctgttggtcaagccggcggatctacctcctctgcttccgactccgcaaggtcccaagttgaaggaggcgaaggaggaggagcgcactcctgcgtcttctacaggtgatgggatccgcaagccatttggtaaccacgagacaactttgaaccgggggaaggctgcatggggggaatccccttctctgtctctcccggacaagggtgcattcaatgcttctccccattctaattctgtttttgattcgggagggagttcgcggggatttggtgtgtttggtcatggctatgcgtcgcatgtggattgccctggttttgaaggggagagtccgaaggcttggaaactgaagtgtgagacgtattttgggttgtctggtacgcatcctgaacactgggttaggttagcg

SEQ ID NO: 103112 - DNA, 3056 bp, Oryza sativa
attcctgcagcccgccattatatggcgccggcgaggttaggggagaggtttccaaacgaatccgagggagagagggagggaaaattggggggaaagggggaggggatcccggggaataattccccccactttgttgcgcgcggggacggcgggaggcggcgggattcgcggcggcggcggcgctagggtgcgggcgaggcggcgggagcggcgggaggaaggggatgacgggtgggccccacccgtcagcgagggtggcgggcgggcccgcccgtcagcggcgcgcgcgcggggagaggccggatgggctgcggggagaggagagggagggggaggtagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgctggaggctttcacacagattttaattattctaggcataatttagaggatgtattttagagtcgttttgggacgtgacagagcgttttcctgtagtctcggcttggggacaagccagttgcgaagaaggggagaatgttaccaaccctgttaagcttaggcccagtaggagtaagcggtccaatccacgcgtcagtgggccagagtgggtggcgtgagtgttcagcctgtgtatataaaggctatgctgtaatcgtgctggttatcgaattgaaaatagaaaaagctaatccccaacaacctctgcttcttccctctctccctctgttcatctctcttcctccccaagtgctcggtcaaattcttgacagaggttgtgacaaaaaacccctttgttttttaatttgttaagagatgcgctcatagcatagtggcaggggttgctgcatgcaccctatcggtccaggtttgattctcgtcgagtacacacaccaggttcgattctcgtcgactacgcacaccaggaatcgtcgagtacgcacaccagaaatatttacttttctttcttcttaaaaccattgacaccaaatcctttcttggtgtctaacctttttttaattgtttaaatccatcagttgatccaatgaacttggttattatacaacaatcagtagtcggcctcaccaaattggcgatttctcagtttcgatagaacatttttaacaatgaatcagcgagcataacagatgctgtcaacataacagagtagtttgacttgtttctggcatacttcacgtacagataattaagtagaaaaatatctctatactattcaaaatgttggtagctagcagtggtgttcattttcacaccacctctattactagcatttaggcttacaatctatactattacaccacattcaacaattcctctcttttattattggcttcaccatatttcaaaatcacaaatttgttcaataagaaaaattgtagtattacttagaataaatatatatttattacttgatttaataagctagaaactcaatttggttttcgtgacaacacaatcaattagtcctgaacaaacaaaattccaagagtatctacgttttgatgactagctgattggtcatcctacgagagtctcgaaccaaactgtatcgaacgtccttttgtttacgaggattgctatagcacgggatttcattccaacgcgatactttatgaatctaatcctgcacctcccgtttttcccatgttcaagctcccacattacaaagaaacaagtagcgtagctccttgctcccaccggtcacagcaacaacagaggaaggagggagctatcgttgagaggaaaagaaaagagaagatgagacaatgataggtgacttgccggtaagttagacgatgacaacgcgctcttttcccctacgccttgacccggtacttgataccattggtatcagacccgatatctaatacctgataccaggcatgataccccgagatatcagaccttggtatcaaccctctgatacctaaggtatcaactgtgacatacttgtacacacatcagtgagtacaagtgatgggttggcaagaagcagaagaaacccaattccaaggtcgccatctacgtcgagactagtcgcttccacccagcctcttcctatcgacgcctaggacctcatccccctcctccgccgcctccctttccttctggttgcacatgacaacccccaatctcacagccatagttggctcgctccttgactataacccccctgcccatgccaacctctactctttcacattcttcggatccagtgtagctagaaagggagaaaagatgataaggaatgtcgtcggtgttggagacgatggtgaaggagtcgaggagagtgaggaggaggatggccactggggtagaggagtggatggagggaggagaaaaacgaagcgctgctacttggtgggggagaaaaacgagtcagtggggaaacagatcttgaagatatgtaccgttcacacctattttatcacgtgtccttgtgcccccgatgggattccgtgtattagttttttctgtttgtttgtgggagtttagaattttaaggaataattggttggtagctagattctaataatcaagagaagttggatttcctattttttgacttttaattatttttgtagattttacacagcttctcagattttagactttgtattgtttacgagagcttctaattctgaaagaaactacagtcgctagaaacttccaaaacaagccctttgattggatgaaccagccgggattcgtttgtgcacggcccaacgtgtcacggagcccattcagtgacccggcccaggtaaccatgggccattgcccatgaggccacgcttagtcgcctggtcgtcgcagccgttgcatatgccatgcatgcgcgcgagcgaaactgcaacaaccgccacgccagagtccaccgcacgcca

SEQ ID NO: 103113 - DNA, 631 bp, Oryza sativa
gccgccatagccgcctccccttccactggatctagcggaggggaggtcgctgccgccgctgggtggagcagtggagagagagggggaccgagagagagagcagtggatagaggaggagatagagggaggagataaggaggagagagagagaggtgggtgggtgcgttgacgagataattaaggccgaggggagagcgcgcgggtcaggctatgcttgatttttcaggtgtcgtttttttaaaaaaaatcgacacctatataattggtggcggtttttctttacaaccggcacctataattacttaaaggcatcagttctatatattttcagatcgtagaggtaggaaaaaaaatctataggtactggttttaatacttccggcaactatagtgttgacttctatgtgtattttttttgtagtagtgtatgattagttccgatgattatgttgttattaagcgctaaaataaccataaaggggcctagatgcttgcacccagtagaaatagtgtatcgagcattccagtcgatcgacgcactcctccaatcggccaatcccacaaccccgatccatgggaaaggaaagagccaaattaccatgacactatggaacatgatgcattaaagatg

SEQ ID NO: 103114 - DNA, 737 bp, Oryza sativa
gcataaattatttttgtagcgtttcctcgtctccatatatgcatgcatgcatggccaaggatattgtacgttggcgctttgtaacatacaccttccgtttaaaaaaaaatcaaatcctaactatgcatctagacaagtgctagtccaaatttatagataggatttgagttgtttggccacggagaggtatgctctaatataaatacatatttttagaataaatatttttactatccttaattatggaataacatgtaacagttgagggaaataatgattcatattttctacctatcagccactagtttctatgctctttcttcaccagcggaacttgcattccctcgtcggtccttcttcacctctgatatggatctgaccaagtgcgactgacgaaacagttgatttaccaaatttgtccaatttttgcataagttcaattcgaaatttagggactaaatgagaaatatttaggtgagcgataaataataaaacttactaagaatacattttggagagcatgatttgtattttgtaggtgaagttgcaatcttagacagtactagcatatatgcctgcatgtggcacaaacaaagattttatggcgccctaggattttgtaaaacctcaaatttatggatatttagatctcagctatttaccatatttgacacagtattatgcttcaaacaatgatgaattaaatcgaacatcgatcactgatggaaccgacagtg

SEQ ID NO: 103115 - DNA, 638 bp, Oryza sativa
caatccatgaaatgcaagatctgctagctgctcatcatttaggctcaaaccataatataggctgcagacattatgaaatctctgaatatattccatagccgattctccttcttgctgctcaaccgatattatgtctgaaagattcaactcattgattccagtaaagaagtaatcatgaaattacttctcaagattggcctatcctctgatagaatttgatgataatgatgaaaaccatgtgaaagccgatccagtcaaagacaatggaaaaaaaaaatctaactttcagagcttcttcagtcgatgcctcccccattgtgctaagaatcggctaatgtgttccattgtagatgtattatcctgccctgaaaacttagactaaaaataggtttttagtcccggttggtgttactaaccgggactaaagatcatagggccctgacacagcctgacatggaatcaaccgggactaaaaataaactttagtcccggttggagttaccaaccgggactaaagatgatttttagtcccggttggtaacaacaaccgggactaaagatcttcctcttattaaccggaactaaaaatcattttgtctcgatttttaatggaaccggcactattgtggatataggtc

SEQ ID NO: 103116 - DNA, 669 bp, Oryza sativa
tatccaaattatgattcgagtacaccactaaattcattgcaattaaatctttaaaataggaccacatatggatatattccgacgaaaaaaatagcttattcatgaattatttttaaatgttgcacgatgttccaccaagtatatcggaattattcactaggtagatcgaaaatgtttcaatcgtttaaatcgggcgttgtttcaccttatataaaaacaatatttaagcaaatagcgaaagaatgattcagttcactgcaacattagatctatacatagtgaaacattgtcagcacactaggtgaaacattttttgtggaacaaaaaatgaaacgaattctctcaatagagggttttcaaaatatgtgggtgatttgttgtaaaagaatgtttcaatttactgcaacattagatttatacatagtgaaacattataaatatactagctgaaacatttttggtggaacaaaaaataaaacgaattcccttaatagagggtttccacagtatgtgactgatttgttgcaaaaaaatatttcaattcactgcaatattagatctatatatagtgaaacactgtgagtgctctaggtgaaacattttttgtggaaaaaaaataaaacgaatttccttaacaatgggtttccaaaatatgtgggtgatttgttg

SEQ ID NO: 103117 - DNA, 921 bp, Oryza sativa
aggttggatctcctttgatgtggggcaaagaatcctaggatgtatgacccagcgatggagacgctcgaggtcatctatctcctctgtagccattcaggaagcccggagatcatccctacgtcgctctgccctattcatcttcatccttcctctatgaccttgaatcattgttggtggtgcattgtcgccaactcgttgtgtcaaagagaagttgaagaaaggtgtctctatgtgagagggaggaggaggaagatgaatggtaggacggttattttacactagatttatactataattatatttgatatatttttttacttaaaaatctattgtcatatttttagatagatcctttctaaataaaccaacaccgatgtcccagatattttttttataaacgaacactggtactttttttatggctttttaataaactgacactgatcaatagttacatgttataattttagccccacatggatgcttggaagagtgggaaatgtatattagatgagccgtacatgtgaggcgtaaccgctaaaaccaaaggagtaatgcttttactagagttaggcttagtttgaaaccgatgtttggatggaggttttcagcagatgcaaaatgagataagatattagggtatgattaattaaattttaattactataaaattgtaaatgaatttatttgattttttcgagcaatttttatatagaattttttcacacaaaatatactgttgaagtgttgagccgtttgaatatgctaacgaaaacaaacggaaatcttccccttcatcccaaatgaacggactctttgtttggtacggaggaaatggaaaagaaagtgcgttcactacgtacacatacatcgcactggcagcgaaaagtagaagtattgactagatcaaactacgagcaa

SEQ ID NO: 103118 - DNA, 2423 bp, Oryza sativa
gatgatcagcagctgggtaatgatttttttaacactttctcaatttgaaaatataaataagattagttgattcaagggagtttcagtagagagtgcattaggtcacagtgaactttgctagtttttttttcacttccttcattttagatcacttgttattctaacaaatctcaaatataaataagaaaatgtgacgatttatatattaccttcttaggtactagctattaactatgatcaacaattgtgtgtgactgagttgatgaaggataggaaaatcacctctaaaaactctttggaatttagagtaaaaaaagttttggaattaatgtgagaatgacaagtatttaacaaaatgaatgctacaatgataaaataacttataatagatggagtaatctcatagtgtaggtaattatgaactgtataaaatattggtctgtcttaacattggacacatcaagtccaatttgctgctcttccctactttatttgatctgaaacattatagatttgttatggctgttaaggaaacgaggcggcaatttgaggtgatttattagtgacaaaaggcactttgcaaaaacaaacaaagaaaaaggcaaaaggaagagaggaagaaaaggatgcatacttaggagggacgcggaaagcggtctcgatctttttatgcgacgatgttttgccatctcttagcttttcttttattcccctttcttcttcccatttagcgcgcactaacaatcccgatagcgacggcccagaaaatctaagctttaaagtgccaagtgcgcagataaattttctttccatctcaactgcgcataatccctgatcaagtgatcatttaatgatatctctaaccattttgggcaaaatcgacctacctatccccatctttccgacccatgaacacgttactcaattcactacgatgtgttgtttgcaggtagctagctaagcacacacggagatatgatatagtagtgtagaagtagtttgttttagttggtttctatcttctggttgttattgttgccagcactaccggcatagttggtaatgtttttttgtttcttcttttaaccaagcgtatcagagaaaataatttacagcagaaagcttgaggagatgctgtccaatgaaaagttagtatgccccaacttgtgttttttaaaattgttgtttcagttgaccatctttcttgttagtgtactgctgcagcacttggctggaacagcagtaatcagtacgtgcatcttgaaatcggagatatttgacagttgctaattaacgtgggagaaactgaaactgtaccttgaatatcagacgacactgaagaatattagtatgaggggaagctgaggcacgcaaataagatcaacagccaaaactttttcaggtgtactgtccagaaattgcaaccaaatgaggccctttaatttctctcgaacggacttgaaaccaaatgtccaacaaccagaaaaaggtctgggactactctgtgtttcgtcctattggtagaatagcagaacagcaatgcaagagtagttctgctcatgatagccatcaattatcggaacagaattaactactccaaactacagtgccctgtacaaaattctatgcatgatacactctccattctttttggaaagatgtccaggttcagtgaatttagtgtccttggtagtgcccaagcactgttccattctgcagtactgacattgtgtagcataaggtggtattagagtaaggttgtctcagctcacagctggaattttacgattaacctaaaaggttacagttttacaatcataaacctttcaaggttcacgcttaacgtttggtcgatgtgcagttcgatctttacttagcgtggttggtttgataccttattttaagcccttgtggggtcttttggccttttggccttttggccggcgctctgatagtcacatcacatgtttttagttaacgaagtagatgactcatcaattattcattagctccatcttggtaatatcttaaaaggaaaggttaatgtagtggtaaaatttagataaaatttgcaaaatgccatcgtggagatttttatgatggttctaagcatattgtccataaggaaaaatatgaaggcagtttcagtcctccaggggtcaagattaaggttttaatttttaggaatattgaggttataagatgttgcgtttcgtatttcttcaggtttgaattttacacaaattattgatacggagtttacttaattaacatgataaattaatattttcagaagcaaacgtcataaatagcttagaaccattgtgatctaaacaatatagtggaagccttttacaagtgtagagcaaataatctgtgataataacaaatctgaaaagaaaattctaaaaataacatggcca

SEQ ID NO: 103119 - DNA, 645 bp, Oryza sativa
agataaatcttttaagcctaattatgtcatgaattgataatgtgatgctacagtaaatatttgctaatgacggattaactaggcttaataaattcgtctcgcactttacaggcggaatctataatttgttttgttattattctacatttaataattcaaatgtgtgtctatatacttcaaaatttttacacctaaacaactaaacacggccataatagttatatagttatataattttttttgcggaagcttaaagaaactacaggaatcggagtaaaaaaaagctttgagatggaaatgaccaaacaaaccacatgcacaaagtttatttctaatttaaccaattggactaagaactaatgcattaacttatttaagtaataagggcatgtttagatctgctgacaagttttttcaccctgtcacatcgaatgttttaacacctgtatgaaatattaaatataggcaaaaaaataactaattgcacagattgcgactaatttgcgagacaaatcttttaaacctaattgacaatgtggtgctagagtaaacatttgctaatgacggattatttaggcttaataaattcgtctcgcattttacagacggattctgtaatttgttttgttattagactacgtttaa

SEQ ID NO: 103120 - DNA, 629 bp, Oryza sativa
tgtgcccaacacaacacaacactcaatctctgcataggcccctgggaggccaccgccgccacttgagttggtcgatgtcgtcgtccgaggttactggaaaaagaatcataagctattactggaacaagaatcataagcatcatccagatctagaagagaagctaggtttaacacaagaacattccagacaaaaatgggtgggaaatagagagataaatgagaaagcggatgtgtatgctcactgggatgcagcaggacgacggcgcccctcccctcgtctgctctgttcatgagatcggagcaaaggcaacgatgtgggcaacgacggcgcccctctcctctcctgctctgctcgcgactcgcgagatggggatcggagcggaggcggcaacgggggtttgggcggatatcgcgccgcgcgaggggatggggatgcgcagtgccgacagcggtgtagggtttggggattggggttggcggtgatgggcgatgggtaggggcgagaaacacggcggcgacgggcgaggggcaggggagagaatcacgacgcgagagagacaagggggcgcgtgagcgaggaggaggatgcgcgcagagtcatcgcgctggcggaaagcgcggtggagagg

SEQ ID NO: 103121 - DNA, 700 bp, Oryza sativa
catgtcaaatgccatgtaagtttaaaataggcttgtagttggatatgggggtaaatagattggttcgaagagttgagaggggagaaagtgctgtattataatttaggggaataaatcggactcacacgatagtggtaattcagactttttctttttttatgagctaaatgtatggatctttcttgaactgttatatttatgtacatacgcatactggtctttgtcttgtgataaaatggtgcttgggcactgtgattgaattgatttttgagatacatgaggtgtcgaaatagatgtatttacataaactctacttgttttgaggaggcatgggtactatttgtacaagctagcctaaaaagactcaaactacataagcagtattcgctagatttagcggcaccctccccacacagggttcataatcaagatatattattactagttgatatcctcatgctttgctgcaaggatttgtgaatacatgtcatacattatataaatggtagatgtatatgtttaaataatgtgaaaataatgtgaagataacggtttcacattgcttgcatattgagttctaaaaatataacaaaattgtaaataatatgtcatatttgcatcatattaaaaatactctataaagtaattactagtgggtgatgatgtgatatacttacatgccatttaaaatactctatat

SEQ ID NO: 103122 - DNA, 673 bp, Oryza sativa
ctgtgcatggatgtcatgtaagcaatatggcttagcaattggtggatagtgatctgtatatagaacctatatacatagggattaattagtggaacattcggttgatctattaggataatcttgattaacaaattatatattttatactatatattaagtgttttcgtacataagtaataaatttatggttaagttctaaaatgcttatttgattggctactcacttagttatcgtgactatgtttaccgaattgctaaatggtccgtatttgaaaaatattttccatataaaagttttataaaaatcaaataaatttacttttgagtttgtaatatttaatacttaattaattttgcactattgaactgcatcgtttcatgtgacctggacaagctcaatgaatgagctagatggaatgaagggtaagtaggagataaagaacatcaatatggtggcaaaagaatatatttgatctttaattttccaataatatatgaatagagaaaacacaaaatacgtgaaaaatacatttatgacaaatttagatgtgatcattttgatatatgagtattttttaggttgaagttatttttattttcgaaaatataagtctaatttaactattatataatctacattttcaattcatttatgtttttcatggatttttcg

SEQ ID NO: 103123 - DNA, 942 bp, Oryza sativa
aacttgatctctgttcaacttgtactcaccctaaaaaaaagttgcttggattcagagcatgacaatgtcaagccatcttgatggtgaccagatgaccgaattctgatggcgtatttgcctctttggtttaaataagtgaattgcaaatttcctttcatcagtcataaacagttgtctactactgaacaattctatttgtctaaaaataatttttaaaatttcatattaacaaaattttgtttataatgatctgtgcatgtgagtgagactgattttgcttggcactattatggagtatcaatcaagtggaagtcgcggcctcttgaccttatcttaatatatatggtatttgatttataacaaattaatccacagaaaacagtcaccgctacaaagtttggtgtacattaaatatatgaacagaattaaacttgctcaaaacaatacttgcatgagtccaattcagaatcaattaagttgatggaaccattttaatcacaataattgataagcattcatgcttgaagaaaagatcagagttcagttgctctcctgaataaatcttctgtatcttagaaggagaacacacaggacaacgaacttaatcgattgcaatgacatctgagtattcaagcagaatggcctgatcttaaccaattgccgtcttctccttcacatatgcaaggagatacaaaagagatgatgaccgcctcgctagggacaacatgagaagcagcgccgctgccattgccataggcccatggcccatagccatagctctctttccccacctctgtatgctgatcggccagcgcgaggccatgaccataatacccaaaatttaccttaaaacgccaccaataacagccatggccaccgtttcagccacttgactctttactaacacccaagatgcctgaaaagcaaggcaatgttatgctt

SEQ ID NO: 103124 - DNA, 665 bp, Oryza sativa
aattcctgcagcccgagaacgatggtgtgacaacatagccaaatatacaccaaagcttcaggttctaagtttaccttattgctcacgtgtcaggtcccatctgtgcatcattctctgccttgcaagcactcactatgatcgagcttcactataatcacttgtcaggttcagtgccagagttcttggctggcttctccaatctcactgttcttcagctatccaaaaacaagtttcaaggatcgtttcctcccatcatcttccagcacaagaagttgagaacgatcaacctctccaagaatcctggcatatctggtaatctgccaaatttctcacaggacactagcttggagaatctgttcctcaataacacaaacttcacaggtacgattcctggttccatcatcaatctcatatctgttaagaagttagaccttggtgcaagtggcttctctggatcactgccctcttcgttaggcagtctcaaatacttggatatgctacaactgtctggattacagctagtaggaaccattccgtcgtggatctcaaatctaacttctctcaccgttctccggatctctaactgtggattgtctggaccagtgccttcttcaataggaaacttaaaggaattgaccacattagcattgtacaactgcaacttt

SEQ ID NO: 103125 - DNA, 681 bp, Oryza sativa
acactgccagaataattgccagaataagtgtgggtattctagatcttttactttgtactggtatgtgtagcatgcgtaaaaaataaatttatcttaggagagatttaggacctgtttggcacagctccagctccaactccacccctcctggagctggagctcagccaaacagtttcagctccatcaaaactgggagtggagttgggtggagctctctcacaaaatgtactagagttgtggagctgggtttaggcagctccacaactccactccagactcaactcctggagttatatttaggagttggagctgtaccaaacaggcccttagtattaactaattaactgagattgtaggtcaagattttgtttttcatcaccactataaaggtagcccgcgcatatccgcgggcatcttatttaaatttgttagaaattttattaggaatgtttatttttttgcgggaatagagatgattagaaatgtttatgattactctattgtaaacatgtttaattttttaataatttgtttggtgttcctttgaatgctagcaaccatcacactacgtataaattataaactaaaattacttaaaaccatgcagttttggttttataagagaaaaaatctaaatggaactatacatcatttgtacataatgcgtttcttttttttaat

SEQ ID NO: 103126 - DNA, 863 bp, Oryza sativa
gtgtagtcgcgtccttaaaattaacgggtccagcgatttaaaagaaaatcgatggtgagattatagaatgccacgtgtcaacctatgagcgtttgtaggaagccacacgacggtttgagagtgtttataggaggtttgatggaattttagtatataatagaagatagatagatgacatttcttatgttcctttcttttttatggatttcttttgataaaaaccctgttccgctctcgcttgccgctactaacgggctctcggttgattttccttcctttctagctactcaatgtttcagttcgctaagtttgaaaagtccaaagagctccggctttgacgacgttctactggtgtaatataggaagacgaaatagagaccgaatgcctcggccacttgcatcgctcgccctatatatacagacggtacacgagcacacactaggaaacgcaattgaaacagccaaaaaccgtaggctcgatcgaccggctcgtccttctagcttaattagctacctatggccggaagggcggcgccgttgaggagctccggcgccggcggccggcagctggtggtgctcatccttctcctgctcattctgttcctattcacggcgcccatcgtcatggtattcggagaggacccatcggtgaacggcaagtgcaacatccgatggcgaatagcatgcccgccgccggttcctcgaccttgagagatgatcgcgatcacctgcgaagtgtgacctaacaataggctcctgtccgcaatgcatatgtaattgcaatgatagaatatatactccctccatttcaaaatatttgacaccgttgacttttacgtgtttgaccattcgtcttattcaaa

SEQ ID NO: 103127 - DNA, 1623 bp, Oryza sativa
cccctttctttccccacccctctcattaatcccttctccatccttatcctcctccatcccttctcctctcccattcctcccccttctcttctcttcctcctcctcctaccacatgaggccgggcggtgcgcatcagtagggagggcgcggagcggcgggcggccggcaggcggccgaggtggcggcccgcgaggcaggcgaggcgggcggccgagcaagcggccagcgaggcggcggcgttccctgggcggccgagcaggcggccagcgaggcggcagcgctccctgggcgggcagcggagcccgaggcggcagcgggcgggcaccggccgccgaggcggcgggcggcgacgctccccaggcggtggcggagcccgaggcggccaggccggaggccggcgaggcggcggacggccggcacccgatctctgcgatgtggttttttcctgatctgtgcgatgtgtgtggccgatctgtgcgatgtggatttctttttctgatctgtgcggccgatctatgcgatgtgatttctttttctgatctgtgtgatgtgtgatctgtgaatgaattggtggagatgattttgtgattttgtgaatgatttgtgatgtatttggagatagaaaatgcagcttgatgtatttggggattttgtgaatgatatgtggtgttggaatgatttgtggataatatgaatgatttgtggggctcgaaatcatgcatgcatcagtaaaagaaaaagaaaaaaaagaacattagtcccggttggtaactctaaccgggacaagatcttttgtcccggttagtaactccaaccgggactaaagatccttttttaatcccggttattttaacagggactaaaaatgggtatttttagtcccggattcatagtcccggttgcataaccgggactatagtggggttgtgaaccgggactaaaaaggtttgtccaccagtatgtagtgcccatcacctgaagcttcgattcgttaaacctgtagcgttcccaaaaataacatgttccaacacagaaataacaaaatgattattttttgcgcattaactgtcttttgaaaatattacattaataaccatgtgatgtcattctagaagtattgccactctaacaaatggattgcgaccatggaaaaccgaaatatccatgtatataattgagtaacattcaaataaattaattaactagcttaactagtatacctgtcatccacaaactctatattgagagaactgtaccatccaggggttgattgatcggcctagatcgtcacacctcttgcatgtgcaactatagtacttgatttagggtcggggccatcatatatgggccaatcgtggacgacgatcagtccgaatgaagctggatgggttgatggtaccatattttcttggttgtggttctgtccagagtacacttggtccaagtacaactgcatggtaatctcgttttcacggagcacatgctttactaggttaacactgaaagaaaagctggccatattgttgggtgtaatggcaaggtgtaactaagaattgtgactctttcgattgtttgggctgtgtggagagatttgggggagggtcgggtatatttatagtgtgg

SEQ ID NO: 103128 - DNA, 622 bp, Oryza sativa
tggtgaaggaacctatatgatttatgagtttaagtagcatgtttcagttcatatataaaaaagtttgtcatatggttctcgtaataatttttttccgcaagattaataagaatgatgcaaacaggaggccaccagcccaccaattattcagcggtggataagatggcaatgaacataacatgcataaacattttttatagtagtataaaagagaacagaacaatattttacatggagtcgacgcgtatgtgtacaggatatgatatttatacggaggacattaggtacgatgcgtactgcagaacgcgatatctctacaacattagcattaaaacggtggtgataacatatagggatatggtgttttgctcatcagcaacgatggctttggccgtttgaccacatgctacgagaagggcatatgcaagctagttttgtggacacagtacttggatggtttagccatgtttggatttcctacccacctgacatatggcattgtttctcctgcaaaatggaaatcgatgtgattcattatttgggatgtatagctgggtcaacaatagacagtatttagtaatatgttgttggtacattgaaaatactaatatgtactacctct
